United States Patent 12,642,819 (COMPOSITIONS AND METHODS FOR TREATING INFLAMMATORY BOWEL DISEASE) - sequence listing, part 103

SEQ ID NO: 53 - DNA, 2866039 bp, Ruminococcus albus (residues 1-1,433,020 of 2,866,039)
  modified_base (551278)..(551376): a, c, t, g, unknown or other
  modified_base (552315)..(552408): a, c, t, g, unknown or other
  modified_base (1935508)..(1935606): a, c, t, g, unknown or other
  modified_base (1961094)..(1961191): a, c, t, g, unknown or other
  modified_base (2103944)..(2104040): a, c, t, g, unknown or other
  modified_base (2224851)..(2224949): a, c, t, g, unknown or other
  modified_base (2260447)..(2260542): a, c, t, g, unknown or other
  modified_base (2534879)..(2534973): a, c, t, g, unknown or other
  modified_base (2775625)..(2775707): a, c, t, g, unknown or other
  modified_base (2802337)..(2802432): a, c, t, g, unknown or other
tttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgccttaattttttatctattatgcatttgcactcagatcataatctgacagatcaatatcagagagatcgtagtcatcataatcaccatagtcatcataatctgactcaagatcaccctctgcatttacaagcatattgtagacctcgtcaccaagaactttctttacattagcaacaaatccatcactgtcacagcctgcaaggtatgtattcatctgatcgtcatttgtcatgtcatagatcttgtcgcctgacggaacagtgatgtcagaagcctctgtcttatttcctgtaactgccattgtaataaactgcttgccgttcatgccaaactcaacagaaaggtcaagcttgtcagcagttgaagcagaagcaagctctacccagcctgatacagcctgagaatcagatgtaccattcacatcaaatctgatagtacctgagaatgcatcaccctcttctttaaggtctttgagagtaacctcagcttccattgtgtcaaagtttatgctcggtgaaactgccatggtaggctcaagggaaagtccaccgtcagcagaagtcatgtcagcgtctatatctgaatcagccgcagtttccattttcattgtgaacttgccatttgtaacaccgtcaacagtttttgcagaacccttgaatgatgcactgccctcactgcccatgttaaggctaaaatcaacagccacaacatcgtccttaagaatggtgtaaagagttgcaccctcgccgtctttttcaaggctaaagcccgcaaaatcgtcaccgctgtagtaagcgttaaatgttgcagtttcgtcaagattatcactttcaaaaagtgaatccatagaatcagcatactgtgagattatctcatcatatgacataccaagcttgtcagcaacgcctgccttgctgaacatatctttaagcgtagcgtcgtccttagccttgtcaagaacagccttaaaagcagcctttacatcattgcctgagatagtgtattccttagttgtatagctgtactcgtttccgtcaatgtcaccagtctttttctcaccgtcaacaggcttagggaaagagtcctccataaccttcttgtattcctccagatccttttcaagtgcgtcagtatcaaaatcaacatcagcgccctcagcagaatcaaagagagaatcaaggtcaatgccctgtgaagaaagctcactgcctaccttgtctttaaggctgtcaacattaaccataagataagcgtcagaaagctcaggtatctgaacataagccgacttgttatctctggaatatacagcattagcagacacaagattatttccgccatatgtcagcgaaacatctgctgcagtgttgcttcccttctgctttgtaacagttgtaacagaaataggctgtaagctaacacctgcctgctctgtgaagccctcgccgaatgaaacagtagccgttgcgttgtaggcaaaatcaagttcgcccttgatagccttttcagccgtgccaagagtgttgtttatattatctgccacctgagtaagcttagccttgccgccctcagttttaccatcattactgtctttatttacaaaataatagccaagacctgaaccaactatgctaagacccaaaacgcctgccaatacaggtgtaagcaccttattttttaccattttatttcctccttaaagaaactcatgtttctgttcgtatttaaaatataacatacttttaacaatttgtcaatagactaacatattacaaatcagctacaaatgtccctaaaataacaaaaagagaggcacaaggcctctcttcatcatattctcttatcagccaaattcaaatccgccagtcctcactctgtcgataaagtccccgagaatatcagtattggttttcgataccgagtgcaggagataaatagcccccgggtgagccgcattcacaagcttttcaagagcctgtccttcatcaggctgattgttcacgtcccaatcagcgtaagcaaagctccaaagctcagtcttataaccgcagtttgccgtcactccaagagagaactccgaaaagtcgcccataggcggtctgaacactgtcatggtataatcatagttttcctccatatacttatggaaatcctttatctccgactcacattccgcctgtccaagcgtcggcatagaataatggtgtaccgaatgatttcccacaatatgcccctcgtctatcatacgcttcacaagctcaggatttttctctgcataatcctgcaaaagaaaaaacgtcgccttgacctttttctctttcagcacatcgaggatcttttcagtgtatccgttctcatacccctgatcaaaggtcagatatatcttgtcatcattatttatagcctttgcgttaagcttgccgtattgtgcattaaaatcaagcgcaccagtcgtcctgttcttttcgtccacaagaacgccttgaccatatccgaccttgtcatgtgaaagccccgaaagatctatcttttcctttgcggttttctttcccacagcaacaggctcgatgaccgccgagcttgttccctctgatgaatttccctcacgcactatcactgtcctgccacaagcactgagcgctacaactgcacaaataagtgccatgcaatttcttatcttcatatgaagccctccgttttcttatcatcttatactattatgttcagaaaacggctttatacaaaaatacgtttcaggtaaattctgacgtaaaacaaaaaaaggcggtaaaaactaccgcctttaaatatcagttatgactcaagataggacttcaccaatgcctgcaaaagttcatctctgtcaatatgacgaataagacttctggcattattgtatgttgttatgtaggtcgggtcctcagaaagaatataacctacgatctgattaataggattatagcccttctctttcagagcgtcatatataattgtaagtgtctttttcagctcagcctccttgtcgtgctgtactgaaaattccatagtttgttcgtgcattatgctcagcccctctgcaatgtattaatatcagcaatacgcctgatactattatactccatttgtttcaaaataacaagtcaaaaagcaaaatttatgcacattatacaaatcaggcgctatattttttacattctgagttcagcaccgatagccttgagagcttcaagaactttcttcatagccttgtcagcctgctcgtcagtaagcgtgccgtcatgtgaacgcattgaaatggagtatgaaacagacttcttgcccttttcgatctgctcgcccttgtaaacgtcaaaaagcgttaccttttcaagtatcgagccaacagccttgcttatagtcttttcaagaagagccgcagggatatcgtcatcacaaacgatagacagatctcttgttgtagcaggatacttaggcagtggcttatatgtcttctgagcaacacagcttgccataagctcaggaacatttatcttgcccacataagctcttgcgtcaatgccgtagttctccagaactctcgggtgaagctcgccaaaaatgccgatctcctcaccatttactttaacgacagcaactcttcccgggtggaaagcatagaactcgtcaaagctacattcagcagtagccttttcaaattcaactttctgtgcgccgagcttagagagcagaccctcaacaacgcccttgatgtcatagaaatcagccttcgtctcagtgtcatagaaaccaaaaccaagtctttcaggctcgttaggaagcacctcgccctcaacaggtatatactcgtttcctctctcaaagatatagcactcagggttgcggtagctgtagtttcttgcaagcacttcacatacagacggaatgatagtcgttctcataacgctggtgtcctcgccaagagggtttgtgataacaactgtctttctcagtcttgagtcagcaggaagatttatcttgtcaaaatacttaggcgaaatgaatgagaatgtagatatctcgttaagacccatagcgagcatagatctctgtatgtgtctgtcaaacttctgcgcctcggtgagcttagcctgagcaacgcctcttacgatagtgtttggaatcttgttgtagccgtaaagtctagcaacttcctctgccacgtcagccttgcaggcaatgtccactctgtaccatggcgaaactaccttgccgtcctttatctcaaagccaagccttgtgagatattcaaccatgtcgctctctggtatttcagtaccaaggaacttatttatccactcagggtcaaaatcaaccgtcttaggtgtctcgtcctcgtaattctcatcaatgtaagtctttacgacctcgccagcaccaagctcttcaacaagctggaaagctctcataagagcctcgtagcactcatgtgggtcaagacccttttcatatcttgcagaagcgtcagttctcatgccaagcttcttggctgtagttcttacgctcgcaccgtcaaagcaagcagactcaaatacaacagtagttgtatcgtccatgatgccgctgtattcgccgcccataacgcctgcaactgcaactggcttttcagcgtcagcaataacgagcatctcttctgaaagctctcttacctcgccgtcaagagttgtgatagtttctcctgccttagcgtttctgatgttgatagaagcgtccttgacatatctaagatcaaaagcgtgcatcggtctgccatattcaagcataacatagtttgtgatatcaacaaagttgttgataggtctaacgccgcagcctctcagtctttctctcatccaacgaggtgacggacctatctttacgttcttaacgataccggccatatatctcttgcaaaggtcagtgttgtgtatctttaccttgagcatatcgttgatatccccgtcaatgcccttgaactcaggtttcttgaccttcagctcagtgccgaaagtagccgcagtttctcttgcaagaccgataacagaaagacagtcaggtctatttgaagttatctcaaactcaacagttgtgtcattataacctatagcctcatgtatatccttgcctactgtcttgtcgcagtcatcgccgagaataaagattccgtcctctatagcatatgggaaatcgtgaacagaaagtccaagctcgcccagtgagcaaagcataccgtttgacgcaacgcctctcagcttgccttttgttatcttcacctgcttgccctcatggagaacagatgacttgtgctttgcaacaggcacaaaatcgccctcatgaacgttctgagcgccagtaactatctgaacaggctcgtcctctcccacgtctacctgagtgatgaacatatggtcagaatcagggtgacgctccatagaaactaccttgcccacaacaacgttagaaatatccttgccctcctgctcaaagcactctacctttgagcctgaaagcgtcagagcggaaacaaaatcctttatcggcatatcgcagtctacatagtctgcaagccatttcattgacaaatccatttattattcctccgtaatcttatcatttaccgcagttttgtatcttctcatccaagtcctttaaaaacagtggtctataaatatagaaatccttccaccgctttatgttcacagtatattttatcccgaaattatcagttatctcagctttcatgctgtcattgacaccatttgtgctgtgaactatggtcttgaactctctaatatccgtatattttataagcagtttagccttaggcacatacatatatctgtcaagtagataaaaggtgttgtatttgaactcgcttccctctatctcgctttccaaagccagcatatcctgagcgtcaaattgctccagccttgcaaggttccctctgtattgttttacctgccttttaaatcctcttattccgataaaaagcaggatacccagaaaaatcaccagaaacccacatagcacaagcatatcccatgcactctgctgttcttttacaagcatgaccgataacccaccgccaacgcctactatcagtgccataagtgtgctgatagccgccgacgttacaagcttagcctttgacggcacaagctttctgtaaagcctgctctggctcataacttcattcatcagaactgctctaaaaatctcatatcgttctcataaagcagacgcatatcgttgatgttgtatctacccattgttattctttcaagaccgataccaaatgcaaatccgctgtaaacctcagggtcaatgccacagccctcaagtaccttagggtgtaccatacctgcgccgagaagctctacccagccctcctgcttgcacattgaacagcccttgccatggcagttgaagcacataaggtcaacttcagcagaaggctctgtgtatggaaaatggtgcggacgaagtcttatctgagtgtcctcgccgtaaagacgcttcataagaagctccagcgtacccttaaggtcagccatagtgatgcccttgtcaataacaagaccctctatctggtggaacagcggtgaatgtgtagcgtccactgtgtcagaacggtaaactctgccaggtgaaatgattctgataggcggctttctcttttccattgttcttatctgaacagaagaagtctgtgttctaagaacaacgttctcattgatgtagaatgtatcctgcgtatctcttgcagggtgagatttaggcatattcagtgcctcaaagcaatagtggtctgtttcaacctctggaccgtccacaatatcaaagcccataccaaggaacacttcctctacctcttcaagagtagcgttcagagggtgaggtctgcctattcttgttttcttgcccggaagcgtaacgtctatggcttcctctgtaagccttacctgctccattttgctcttaagctcttccttacgcttattgagagcgttctcgatatcagctcttaccttgtttgcaagctgaccgataacaggtctttcctctgcggaaagcttgcccatttgcttaagtatggaagttatctctccctttttgccaagaaatcttactctgaaatcttccaacagcttggcgtcatcaatatgtgaaagttcttctttcgcacgctcgtcaatgcttttcaactgttctttcattacttatcctcctataaaaataagccctgccccgactaaacaggacaagactttgaaattcttgtttataccacctatcagtaaagagccaacactcttccgtccttaacgcagacagacgttcacgcttactaaagactatctctcattcggcatgaccactcgcaagtgaacttcattttgtcaggatataaagccgctttcagaaaacgcacacacgccgcagcttctctctgaagacccttagcaaaactactctctcggtcatagtgttttaagtgtattgatacaataatatgttatcacattctgccccacatttcaagggcttaacaaaaagtttacaactacagtccatgcttatgaagcctgtcccacttcatatcctcctcggagtaataatcgtcctcctcgtcctctatcttgttgtattccttgtgtggataacctatcttctcataaaagtcattgataagcacaagcttgcccttagtgtcctgaaagctcagagctatcataccgtcctcaggcacaaaagctttctccctgccctctttgtcctttaccacaaagcttgacttctccacatttttcagaacgcaaacgagtcttcccttgtttgtctgataagacttctctacctcctcatagtaaaggcatatgtgcagatagcttttagaaagccccatacgctgagagtgttcaatgtggtcttcgtatatccttgtgtaaacatcggcgtcccgtgaaagcgagtaataccagtacataagcccgcccacagaacaattgcaagcccccagcagtataagcagaacctttgcaaagaccgcacttgcaaacaccgcaccaattatgatgataacgaccccaagcaggatattcttatacatattcctctgcattttcctgtgttcttcaatatcatgtgccgccttgacctgcctctccgcccttgacagcttcggaggatattcataaaccgcctgcaaaacattcacctctcaactctttgacttttccatagcaagtacagattttgtatagcgtttttgctttttaacagaatgaaaaaagtctcttattatcatttgaactttcaaaatcttttgatatcaacgttcttaatgtgtctctgcactcctcaatctgcctatacagaattgcgttctcagatcttagttcttcaatcttgtcaatcattttatggtttaatgacatagattgtgtcaacagatcatacatttcgtaatatgttttattcctcattatttgcaccttcccttcacattatgcttgtgctatatgtgtccactattaataaaggagatacacagcccaacaagggttagagtttacattaagaccattaggacaagtttctatgtataccacatagtaaacatcatttctttcttcatattcataatctatgtagtccatataaatctttttgaagtctgaaagcattgactgtccttctgtaaactctattgtatctactctatcgtaccctaaatcacttggctttgcttttccttcttttcgtaaaaagtattcttctaccgtattataatctatgccgtacttccaaaactccgtataatgttccttgatatactccgccttgtctcttgaatatgctgtaagttctgccttcatagcatcaatatcagcctgtgtgattttgtcgctcttcttagttgtcgccgtcacgacccccgaatacttgccatagtgattattattcgtctttttgtcgtcctgcttgcaagcccttatcttgaactgatactttgtcgcaggcgcaagcttcttcacagtgtagcttgtccctgtggtcttgcctatctctttccattcgccttttatgttctgataaatgcggtaatttgtacagcctatcttcgtccaagaaagcttaacgctgtcagtgccaacactgcttacctttagccccttgcaagcctgcggattggtcgccgtgttccagtttgcggaatattctccgtaaactttcttgccctttacagtcttgtatgcccttactttaaaattttctctcgttgcattaggcagcttcttaactgtgtagctcgtacccttgcaatccccaagcttgttgtacttgccgttttttcgcatataaacagtgtaaccgctcgcaccctttaccttgctccagttgagctgtatctcactgtttgaaagcgtcttagatttaagccccgttaccttgccaacactccccgcttccgcaacgatagccgtctgtgagaatatccccatatcctccgccgcaggtacaacagcccccgtacccataagcattgccgccataacaacagccgccgttttcttcataccattcttcataaaaagcacctcttccgattctctataattcccaatatgtcatggtaatattatataataccataaagccaaatatttgtcaactctttttccataaaaaagacacgtcccctcacggaaacgtgccttgtatatcttacttattcttcttgctgtcattctctcttatctcaacacggcgtatcttaccgctgatagtcttaggcagctcgtccacgaactcaactattctaggatacttgtaaggcgcagttgattgcttaacatagttctgaagctccttagcaagctcaggagaagcagtgtagccctttgcaagcacgatagtagccttaactaccttgcctctgatagcgtcgtcagccgccgtgatagcgcactcaagtacagaagggtgttccataaggatactctctatctcgaaaggtcctatacgatagccagaagccttgataaggtcgtccgttcttccaacataccagtagtagccgtcatcgtccatgtaagcagtgtcgcctgtgtgatacataccaaatctccaagcgttgtccgttgcctcagggtttctgtaatactccttgaacagcgcagggttttcgcccctcttagcgtaaacaacgatctcgcctgtctcgcctaccttaacaggcttgccctcgttgtcaactataccgatattgtaaagcggtgtaggcttgcccatggagcccggctttggctccatgccgtaaagattgcccacaagcacagcgccctctgtctgaccgaagccctccataagcttaagacctgtgtactcataccacttgttgaatacctcagggttaagagcctcaccggcgatacagctatatttcagtgaagaaaggtcatagttttcaagaccctccttgatgaaaaatctgtacattgtcggaggtgcgcagaaagaagtaagcttgtaatcctgaattactttcagcacgtttgcaggaataaatctgtcgaagtcatatacaaaagttgttgcaccgcagataaactgaccaaacatcttgccccatgcacacttagcccagcctgtttcagaaacagtaaggtgcagtgagttctcgtcaagatgatgccagtgcttagcagtgataatgtgtgccgcagccagtgaatacttgtgcagtaccattttaggatatccagtcgtaccagagctgaaatacataagcattgactcagtaacgtgtgtttcgatcctctcaaaagtctttggatacttgtccatttcgctgagaaaatctatccaaccctctttagcaccgtgagtgataaacttctctttcatgccgctgtactgctcaagagctgaatccacctgattaggaacatcgtcctccgcagttgccacgatataagagatagaagcagcgtcaaagcggtaaacatagtcttttttcttgagctgacaagttgcaggcacaaggatagcgcctatcttcataagaccgtaagcaaggaaccagaactcataatgacgtttaagaacagccataacaaaatcgcccttcttaactccgtgtgccagcatcatgttagctacctgactgctcttttcagaaagatccttgtaagtgaagatatgctcttcaccctcctcgttgacccactgcatagccaccttatcaggcacgttcttagccagctcgtctataacgtcatatgagaagttgaagttctcaggcaggtcaagcttaaagcttttaagtctgccctcgctgtcaagctcctcgtcaacaaatctcttgtaaaaatcagccattacaaaactcatatatgaaatcctccgttttaattatatcctgtttatctcatgacaaatgctcactatgtcctgcggaacttccgcaatatacttcgcacctgcattttcaagttcttctctgcccctgaagccccattcacagccaatgcagtcaagacccgcattttttgctgtcataacgtccacatcagaatcgccgataagcacagcttcctcagccttgaccccaagcgtgccaagaatattgtatattatctcaggcgcaggctttgtcggaacaccgtcctttttgccctcgatcaggtcaaaatctttctcaccgaaaatattctttacaatgtagttcacaaagccgtcaggcttgtttgaagccaccgccgtcataatgccctcattgcgaagcgtgtcaagcacctcgcagatatgctcataaggcttggtcttgttcacacatctcttgttgtattcctcagagaactcagcatgatactttttgatgttctcctcacttctcagcttctcaggcaaagcccgctcaacaagcttcaaagtaccatttcccactaaatgcttgtaggtatcataatcaaacacaggaaacccatatctctcaagaaccgcgttcatggcgtccccaagatcataaatagaatttacaagcgttccgtccagatcaaaaataaatagctttttcataaaaccagctatataaaaagcctttcctccctccgactttccataaacttgtcggtcaccatgcactaattcttacacttatcgcaagtttatacacatatcataactttgtacacttatcataagtttgtacatcaatcgcaaatttatacacttgtctaaaaatcacgagatttattatacactgatattgtggcttgtttatgaacatacacacctgtaattgttaaattaaaattcacaaagatatctatgtgatacatatttacgtgaataagcaaattgttttaaacaaatatagtctgttcagcaaatattttaagccctatacatattaaaataactcccccaactatccttgccttgcttttgagttttccgctgaatttgttaccaagcataaacccacagaacgataaggccgccgtaacaacacatataaaagctgccgacctgactatgcccacaccaagtgccgcaaagcttatgcccacagccagtgcatccacagaggtggcaaatccctgcacaagcaccgccccgaaagtgagcctgccccctgtctggatctcatcgtcccccgaaccgcatatcatgttcaatcctatgaacccaagcagtatcaaagctatccagtggtcgaacctctctatgtactccgcaaaattcatgcccagcgcatagccgattgcaggcattatcccctgaaaaagcccgaatatgataccgcacatcaatgctcccctgactctcccttttctgacgcaaagcccattggtgaccgataccgcaaaagcgtccatagaaagtccacacgcagtaagaaaaagctcaaaaatactcatataatccccctgtataatgtataaaaacagctttacattcaatcttgacttcccttatatttttatctgcacccacactttttacgcctgctaccacaccttttttgtaggggcaaacagcgttcgccagtcgaagcaacaaacccatgctttcatcaaacaaaatagcccccactcaacaaaaaaacgccatctcggaaaacacaaaataacatctttgcattttccgaaaacagcgtcataccgttatattttgttaatcctcacactttgaagcaagaagcgagctgtattgatttctgaactgctcaaatctgccctcgtcaagagcatctcttatcttctccgtgagcgtgttatagaaatacagattgtgcataactgccagcctgcctcccaactgctcctcagacttgaacagatgacgaatgtatgccctgctgtgattacggcaagcaggacaatcgcaatgctcgtcaataggtctagggtcagtttcataccttttattagtgatgtgcataatgccgttccatgtgaacagcgttccgtgacgtgcatttctgcttggcattacgcaatcaaagaagtccacgcctctgtaaacagcctcgattatgtttgtcggtgtgccaacgcccataagatatctcggcttatcctttggcataaaaggctcgaccttttcgataatgttatacatcacctcagtaggctcacccaccgcaagaccgccaatagcaaagcccgaacagtattccatttctcttatgcgcttcatatgctcgatacgcagatcctcataagtacagccctgattgataccgaacagcatctgatgcttgtttatagtctcctcaagtccgttgagccttttctgctcagcgacacatctctcaagccaccttaccgttctatcacagcttgcctttgaatagctgtgctcagcagggttctctacacattcgtcaaacgccattgcgatagtagacgcaaggtgcgattgtatctgcatactctcctcaggacccataaaaattctgcgaccgtcaatatgagagttgaagtacacgccctcctctttgattttacgcagcttggccaaagaaaatacctgaaatccaccactgtctgtaagaataggcttgtcccagttcatgaacttgtgaagtccgcccattttgtatataatgtcatcgcccggtctgacgtgcaaatgataggtattgcaaagctccacctgagttttaagctcattttttaaatcaatggaagaaactcctccctttatcgccgcagaagttcccacgttcataaatacaggcgtctgaatagttccgtgaacagtttcaaactgtcccctgcgtgcagcaccctcttgtttaagtaatgtaaacataaattctcctttatcattctattatatcagacggcagccagccgactgtggcattttccgtaattaccaaagacattgtttcatcttcgtcaaagaccgatacccgctcaccttttctgacagcaggaaacgatgacaaaaactgatatacatgaggcttttcatcaaaaaaatatatttcacggtcaggaataagaccctcgccccctgaatactcatctctgacctttgtcatatatccatttttctcaattatcgttatatcctgcttttcccaatcaacataaacaggtttcatgtcacatgaaaaatcctttaagacagttttctttggcatatctgtatcccaaattattctatgagaataattctcgccgcacttatcaatgataaacaaattcatctgacaagccttcttgatagtcattccgccgtcaatacatatcattttctttttgctgtcgattatcggaagattagtcacatttgaacgcttataattgtatgtgggataatgcccgaatacaagctgctttcctgttggattttctttccgcaaaaaccacggaacagttatagcataaatatcatctgtatttctccaatcaggacggttttcaagccctgcatgaacaaaaacatattcatctgtttcaaggcacgttggaagctctctgataaaagataacagctcgccatacttctctacaactttttcttttatctcaagccagttgccctcccagcagtcaacatatcccagcgtattagccatttgcctgaacgtgttatgctcattgcggtaaaactgctgctggaaccgcttgaactcatagtgataagccattcttgaacacattatgtcattattgcccattaataatattgccttgtcacttttatcgcaaagagccttgacatattcaagggtctttatattgtcactgccatgttcaagtatgtcgccgactatcacaagatagtcattttgcgggtcatattttgcctttttcagcagtctatcgaaaagatgccaatgggtatggatatcgctgacagcaagtatcctgcatttttcaggcaacgaaagatcaatgatcttatccattaattctcaccatttctaagatcgtacatagccatactttctcttgttctgtactcatgcttttcataatatccaataagctctcccgcatcatttctgagagctatcatataaacgtccttattttccttttcgttgcggaaagtatacaccttgttgttgcccttgtcctttttgaaccatgcaatgacctgctctatcttgtcattagaatccccgttgtgacagccctttatggacctgcccacaagagccgctcctccacgcttttcatatcttttgaccgctgtcggattcatatatactatcgtatgctcaaggtcgcaaataaccacaggtgcatcgtctgcgtcaataacgctcttaaaaaagttatttcccatttccgttctcctttatgatatcattcctgccccttattcctttaagcaccatatccagaggcacaccaaatatttttatgcaaagcaccaatacaataggtatcgctgtaagtgccagataaagctcccaacgttcaggaaaagcctttgcaagatatgcctgataaccatagtatgtgagcatataaactatagttctgtgccagaagtacacctgcaaagtcctggagccgcactttgttatcagtggaatcttcacatcaagcccaataccaagcaccgccaaacaaagcagtgccgagatacccataacaagaagcctgctcaaaaaagtgcaatccatgtccgttgcttcagatatggcaaaataagagtttcttcccgtaagaagcattctcagcggataaacaagctttgtttttccaaagcagaaataagcccaaatgcctatcacccccaaggacagcacccttacataccacttcttcacaaaaccagccaccttttcagggtcaagcacatatccgcagtagtaaaacgggaaaaacaccactatcctggatagctcatattcatcgcccacgcaagggtcataccctgccgaaagtgccgtcaccatagccgccgtaagcaccgcccaaggtctgctgtttcttaacagatagcaaagccccataaacgccgccattgcgaacatataccaatatacaccgtcgccgcctaaaaggtcaaagaatatctcgccatcactgttttccttgtcaaaatccgtctgaaatctcacctgcgaccaataattcaggcatttcattaacattccgataacaacaaatccaagcgtctttccaagcactttcctaccgtcatcatgccccctgttgaacagtcctgatatgaataaaaacaacggcatatgaaaagcatacagaaacacaaatgcgccgctaaaaacctttgcctgcggtacacctgtttcaccgccgccgtcaccaaaaagcttgacagtgctgtcgtctatcaaatgccccaagaccacaagcactataagcagaaatttcagattatcatataaataaagccgctttttctcccctgacttaacgtcattcatatagaaaaaacctccgtaaaacaaagtttgaaataagatatcatcgccgcaggcgataccttaattcctcactcagatattatgagcatacaatcaccaaagctgaaaaatctgtatttctcttcaaccgctatcttataagcgttcatagtgttctcgtatcccataaatgcagaaacaagcattataagcgtgctttcaggcaggtgaaaattagtaacaagtccgtcaagcaccttgaactcaaagccaggataaataaatatctccgtgtaaccgtcacatggaactatctttccttcattgaatgccgccacgctctccagtgtcctgcatgaagtagtacccaccgcaataacacgtccgccatttttcttcgtttcgtttatcatgtctgcggtttcacggctaagctcatagtgctctctgtgcatcttatggtcaaggaccttgtcctccttaacaggtctgaacgtgccaagaccaacgtgcaaagtaacatacgcaatgttcacacccattgcctttaagtcctcaagctgttgttcagtgaaatgcagaccggcagtcggcgcagcagacgagccaagctcatgagcataaaccgtctgatatctgtccttgtccttcagcttttcagtaatataaggcggcaaaggcatctgacctatctcgtcaagtgtggcaaagaaattctcctcgcactcaaatcgtgcgatacggtttccgtcctccaacacatcaattatctccgccttcagcttaccaccgccaaaaacaaatcttgtgccgatcttggcttttttgccaggtctgcaaagaatctcccagaccatgttctctttctgctccacaagcaaaaactcaatgaacgagcctgtgtcctcacgctcgccatatatcctcgcaggaagcacctttgagtcgttaagcacaagcaagtcaccttttttgagataattgcatagattatagaaatggtcgtgtaccacctctcccgtctgcctgtttatcttcatcattctcgaagcatttctaggctcaacaggggtctgtgcaataagctcctgcggcaggtcataataaaaatccgatcttttcatattgttgatatcaagcattttaaatatctcctatttatttaaaatataataattataataatgtagggaacggcgtcctctacgtcccactctcaccattctcaaagtccttattccaacaactgtcaacattctttaaaaccatttaatttcatataaacttattaatttacagaaaattaaaatatttttatctatatgtattgacagaacgctaaatatttgttatcattaaacagaacagatagaggtgcagttgaaatgagtatcatttttcgtgtgaccccacacaacagcgtcccaacgcctatggtaaatgagaaaggtaaaactgccgaagcggagtatcgggaacactcctgctgactgttagtttaatagactatcagttgtcatcattacaaatggtggagtgctatcggcataaatttttatgtcaacattcttattatattgtatgatgaactggttttcaaccagtttttttattatttgtttattttttatgttttgtgcaaaataacatttgaacagcggcatattttagtgtataacgccaaagaaaattgttaccatggcacaggaaaaggagttttaatatgaaaaagtacaatgtcggtatcatcggtgcaacaggaatggtaggtcagagattttctctgcttcttgacaaacacccatggttcaatgtagtatgcgttgccgcttcaccacgttcggcaggcaaaaagctcaaggacgcagttgcaggcaagtggaagctttcagagcctctgccggaagctatcggtgagcttacagttctgaacgccgaggaagacgttgagaagatcgcttcaatggtagatttcgtattctgcgcagttgatatgaagaaagacgagataagagcccttgaagaaaagtatgcaaaggctgaatgccctgttgtatcaaacaactccgcacacagacatactcctgatgttccaatggtcattcctgaggtaaaccctgagcatatcgagataatcgcttcacagagaaaaagacttggcacaaagagaggatttatcgcagttaagtctaactgctcactccagtcttacgttcctgctcttgctcctcttatggataagtataaggtaacaaaggctcttgcctgcacatatcaggcaatttcaggcgcaggcaagacatttgaaagcttccctgagatccttgacaacgttatcccttatatcggcggcgaggaagaaaagtctgagaaagagcctcttaagatctggggtcatatcgagggcgacgttatcgttgacgcaacagctccagctatcacaacacagtgcctgagagttcctgtttccgacggtcacacagcagcagttttcgtatcatttgagaataaaccttctaaggaagagatccttcaggcttggaaagatttcagcggtgttccacaggagcttcagcttccaagcgctccaaaacagttccttaactacttcacagagaacgatcgtccacaggctaagctcgacagaaaccttgagggcggcatggcagtttctataggcagactgagagaagattcacagtatgactataagttcgtttgcctttcacacaatacactgagaggtgcggcaggcggagcagttctgctggctgagcttcttgcagcaaagggctattttgactaatataacacatatatacgcacgaaaggagtgctgtttatgaaaaagactattttcacaggtgcaggcgttgctatcgttacacctatgaacgctgacggctctatcaactttgacaagctgggagagcttatcgatttcaacatcgataacggcacagacgctatcataatctgcggaacaacaggcgaaagtgctaccatgacagacgaggagcatatcgagtgtatccgctatgctgttgaaaagacaaatcacagaattcctgttatcgcaggcacaggctcaaaccatacagagtatgccgtaaacctttctaagaaggctgaggagcttggtgctgacgctctgctttgtgttacaccttattataataagacttcacaggcaggacttatcgcacacttctccgctatcgcaaaggctgttacactgcctatcattctttacaacgtaccgtcaagaacaggtgtgaacattcttcctgaaacctgccgtgagcttgcaaagatagacaatatcgttgctatcaaggcagcaagcggaaacatcagccagataacacaggtggcagctctctgcggtgatgaccttgatatctattcaggcaacgacgatcagatagttcctatcatggctctgggcggaaagggtgttatttcagttctttccaactgtatgccatttgaaacacatgagatcacacagctctgccttgatggaaagtacgaggaagcaagagaaaaggtattcaagacccttggttttgcaaaggcacttttcagcgacgtaaaccctatccctgtcaaggaagctcttaatcttatgggctttgaggtcggcgagtgtcgtctgccgcttgtaagaatgagcgatgataagatagaaaagctgaaagcgtcaatgaacgctctcggacttatcaagtaaaaaaatacaaagggcggagaaattcgccctttatgtttaccattataaaattgtactaatgtaagggttggcgtccccgacagcccaaacgctgtctttgacattatcacttacgtttatctacaaatcaaaaagaaaaggaatgatataaatgactaagatcgcaatatgtggcgcctgcggaaaaatgggcaggttcatatatgacgttatatcagagcgtgacgactgcacagtaagcgcaggtatcgacaaatttggcgaggcttatgcagacttccctgtagtaaaagaacctgccgacctgcctgaaaagcctgatgtaataatcgacttctcacacccttccgcactggacggacttctcagctattgcctttcaaacggcactgcccttgtaatagctaccacaggctatacagaagaggatacagcgaagatacacaaggcttccgagcagatacctgttttcttcacattcaacatgacccttggtatcaatcttcttgcaaatcttgcaaaaactgccgcaaaagttcttggcggtcagtatgatatcgagataatcgagaagcaccataaccagaagatagacgctccgtcaggcacagctatcatgcttgccgacgcaataaacgaggagcttgacaacaagtatcactatgtttacgatcgtcattctgtaagagcaaagagagaaaagaccgagatcggtatgcactctgtccgtggtggcactattgttggcgagcatgagataatctttgcaggcagagatgaagttatctccctcaagcacgaagctcattcaaagcaggttttcgctgtgggtgcagtgaatgcaggcgttttcctttgtggaaagccggcaggactttacgcaatgagcgatcttcttgcttcactttaattaaatatcagatacagtgggcgtccttgacgtcctgctctttcggaaaattttttacactctcaggctgctgttttatacggcagccttttttcatacaaaaaaaatagccgtgcgtgatttttcccgcacagccatttcattacatattcttatcaagctccaaagtcgttttcacacgctttgtgagctttttccattgtactttgtactctgcatagaccattttccactcggcttcatcaggaacatatccaccgaagcaggtcttttcaaaaagatctataagaccaccaagctcaactccacgcctcttaacaagatattctcttatcatttcaggcgtgtatccagatagcttgtcattagaagctatggtcaaaagccttaccacccgcctgtaaagccttatgaccttttctccgttatctctgaatttaagtgacagtctgaaaaatacctcgataattctgttaaggaatacgaaaaccacaagcacaaacgctacaccgataaacagtgcgatcctgctgaaatagcttacaaaagttgaaacatcaaagttcgtaccgtttgcactgtagtcacgctgatagcccggaactgtcgggtcaaaagtcatccagccaatgcctgtgataaagacctctacaaaagcgtgagcatggctatctcttaccacaaactctccacgttcattcttttcatatgctgcaaagccctcaacataccttgctggaagtcccagcattctcgccataagtgtcatgcttgtggcatagtttgtgcagtttccgcgcttgctcgtgaaaagaaaatatgcgatagactcatcgtcaggctcatactcgttatcgtaaacatagccgttctgctcaaaataatccacaagcgcctgagctttctcataatcatttttgcagttttccgttatgtttttcgcaagagcctccatttttccgcctttatcgtcatatgcagaaacatctttgtacaacgcatatatcttataaatattcagcgcttgatttgatgtgacatctccgtttgtcaaaccataagaaagcagaagtttgaactgattttcggtcatatcaagatttgccgcagcctgtctttcgctctccgtttcagggatatactcaaagctaatgccaagcttatttcctgcggtgtcatatggtctgtagacctcactgtgagttgttttgatataaacgttgttctcccctggggttatcatcagtggagcagggatatagctaggggtaaagctgtcgctgaactgattcatgactgccttttcactgaacagatcatcaggaaactgtgacctgtccatgccaagatccttggtgtaatccttatctgcgagtgactttgctatgctgtaaacatagctcggtgagttcacctcgttgtcaccgtaaagatgaacatttttgtcaaaatcaaaatcgtagaagctatcgtctgttacccacttctcgtttttgaaaaggtcaaaggattgtctgcggaggtaaatgacctgttcatcagaggttgtggtgaagttgaaaagaatctcgcccgttgcgtctgcgccaaatctttgggaagactcatcactaagattatcatatgtgccactgcttttgatattcacatcaaagaagttgctgtttttttcaagataagatgtctttgaggaagtcggcataagcattgcaagcgcacccacaagggtaacgaaaaccgccgatgccgccacataagagccgtttataacaaggtcatgcttgctctcgtctgaaacaagtctgctgtgcaccataagtgcaatgaacacagtgagcattatggttatgtcaagagtatccattgaatcggcacgctttccgtaaataaaaaacggaaaaagcacaacgagcatcgttccaaagcttctatagcgcacaatggtgaaataataaagcaccgaaatgataaagaagcctagtcccacaaatagaaagtagaaatattcatctatctgacctatctcctgcctgtttacataaaaccaattgataaatgattttccagaatgttcaaatccagcacgaagaagctgaaagcccaaaaacagcactgccaccataagggcggtatagacaagacctcgcaggacttttttcggcttcagccactcaaaaagagcgaacagcagacattcatagaccacatatccaaaagtataaagtctgacattgtctacaagataggtcttaaagattatgttcatgaccactgctccaaggagcagcggcaaagcatattttgaaagaatattcacaagggtgttttttatctgagcagttttagtattcaaaagccacaccccctatgtcattttacgaaactcgaaagtttcgtctacaagccatatattttctgtctgcttatcaagaccgctaagacgtgtcactacaaaagaaccgttaaattcttccataagagaagaaaaatccccctgagaagtcgccatgcaggctgtgaagcagataggagctgttttgcctatctcatgagaaaaggcaaaacgcttttcctgcggatatggtgctattgccgcaaggtcgttttgaagctctattatatcacctgcctgctttattttcatgcttttccagccgtcaagataataattatactcactctcaaagccctccatgataagcattgaaagcattgcaaggctcgcttcgactatattatcaatattcatagcaaacatagggtcatgattttcgcttggtatatcaaggaaaaacgcctgacttgaagccgtgaccttttcatcaaggcgcaccataagctcgtcacgctttgaagaaagcttccagtttattcttttcagcgggtcgcctatctcatactgtctgtggtcatagcccggaacgcctgtaagaccaagtgcattttcatctgattcgctttcgttatcgtcaaatgaagcgttttcggaagttgctttaagaagctctgtttgagagccagtgtcagggatattcggcattatctttatttttcccacggctttttcataacgtgaactgtcaaggtgcagagtgattattccaagatagtcatgcaaatgtatgctttttattttcactgtgccaagacctgcatagcgtgttttaagcttaacgctgacgctttgctgtctgccgcctgccacgatagttttaaattcaagtgggcttacagcaccgatattatctgtacactctgccgttacctcaacaacgcatgagggaataatgcgtattgcatttaaaagcattatgtcagcgtcaaactcctcgttctttgcacttatttctgtggaaagctttatggctgccacaagtttacgcttggtaatgagaagtgccgcaagagatatcacaaaggctatagctaaaaggtaaagcacaagcgtaccaccgcttccgtttatataaactctaagcagtatcgccaccgccacgcaggtaagataacctaaaagatttttcatggggtcatatcctctatttctctattgcgtcaggtgattttactgtaagagcgatattttcaagagcttccctttcattttcaaaggcggatttgccttttggagaaagcataagtctatgtgcaagaacgtcaggcataacagccttgacatcgtctggcatgacaaatcctctgccctgaacaaaggcataggcttttgaagctttaagcagtgcgatgcttccacggggagaaacgccaagctttacataatctgaatttcttgttgcggtaacaaggctcaggatatattttctcacagaaagctctgcggttacattttcagcgtagcccataagctcacggacgttttcaagggtcatgacaggctggatattctttgcaaagcctgatctttcggctcttgacatgatatcaagctcatcatcatatgagggatagcccattgatatcttcataagaaatctatccatttgggcttcaggcaaatgataagtgccgtaagtttccacagggttttgtgtggcaagcaccataaatggcaatggaagttcatgagttttaccgtcaattgatatctgatgttcttccatgacttcaagcaagcttgactgagattttggggaggctctgtttatttcgtctgccaagaggaaattgcacattgccacaccctctttatactcaagctcatgagttttctggtctatcatagaaaagccaacgatatcggacggcataacgtcaggggtaagctggatacggttatatttgccgtccactgaccttgcgagggctgatacaagctgagttttacctactccaggcacgtcctcgataagaacatgaccgccgcaaagcatggctgtgattattttaagcacagagtctgtcttgccgacgataactttttcgatattatctgtgagaagttttaccttttcgttcaatttttttatccccctttttatcaggtgttctgtttggtgtgagcgatatcatttttctttttaaaagcaccacattttcgatacctgtggtatgcgggaacatatcaacgggctggataagctgtgctttatagcctatttttgcaagaagcttcaaatcacgctcgagagtttctattttacaggaaacatagactatcttttcaggtctgagtttacccaaggcttcaacaaattcttctgttgtacctgctcttggagggtcaaggaaaactgtatcacagctctcacctgcctgcgcaagctttgtcatgaactcacctgcgtcctcattataaaacctgatgttgtcaagcttattgaacttggcatttgaaactgcgtcctttacggcttcggcattaagctcaacgcctgccacgtctgcaccgctttttgcagcgataagaccgatagtacctgttccgcaatatgcgtcgataactttatcgccttttttaagatccgcacaggaaactgctttagaatagagcttttcggtctgctcggagtttacctgatagaaagaatggggtgaaactctgaacttacagccgcacatctcgtcggtgatatagcctttgccatacattataatatcacgatcacccaaagtaagaggggtcgtgcctttattgatattctgaatgatagtggttatatacgggtgtttttccgtgatagctttaacgaaatttttctttgcaggaaatatgggggtagctgtaactagcacgagcattacctcgcctgttgtttgggaggtacggataagggtatgcttaagaagaccctgaccactttcctcgttatatggaagtatacggaagtcagccataagctctttaagtgtagcgactatttgctgtgctcttatatcctccaaaaagcaatcatcagttattaccatgctatgggtagaggactgatatactcctgagacgatacgctttgagctattgaccttatagacagtttggactttattgcgataattataggggtcgtccatagttattatctgctgaggtctgcaaaagcggctcaacattctatcggcttttgcctgcttccattctatttgctgggcgtagaccttatccaactgacagccgccgcagcgtttaaagcagctacattttttctcgccagttgtcttatcgatagtggtatgtttattcatcacatttactcttttcattatgtataaattttattttaagtataccattttatatgaataatgtcaacaaaggcggttataacaattaaatttagcagtatgctcatggggtatagctaaggtgtgtcggtataaatattcaattttcaagcttcagacggagtgcaggaagtgcttttctgtgcgatcagaacctctcatcgtgttcacctaactcacgttgacaaaatgtttcctcatacactgtcgctccgcaaggtttccgatttgtggtgaaaccccttctacttatacacgaaaagtgggtattttgttgcagaaaaaatgcaacaattgcagaaatgttgccaaattaaattataaatcatttgtttgcacaaatttcggggtgtgaattggcgaatttgacgaaaagcacatgaaaaatgtatagtatttgggtataaaaataccgcccgaccttagtcaagcggttatttgtattattcaatatcgataagtcctgcgttgaaacgaaaattgactcacacgctcacgtggagcgtgactagtcaggtaagtctgctattaattctacaaagatttcaactcacacgctcacgtggagcgtgaccaatatctgtattttgaattgctaaatatagatatttcaactcacacgctcacgtggagcgtgacgcttgtagctttcaacagaattattgtgtgctgaatttcaactcacacgctcacgtggagcgtgacataggttttctgtgagggtatgaccgttgagatcatttcaactcacacgctcacgtggagcgtgacctttcatttcaacttcgaccttgacaacaggctttgatttcaactcacacgctcacgtggagcgtgaccttgacctcagcttgcattgcagatatgttaacatttcaactcacacgctcacgtggagcgtgacctgtaaacccgttacagcgaacatcattaccgtatttcaactcacacgctcacgtggagcgtgaccgcaggttgacgtccgcaggcttaaaggcgatgtcatttcaactcacacgctcacgtggagcgtgacgaatatgggcgcgcgaagcgcggtcgaccgcaggatttcaactcacacgctcacgtggagcgtgacgcgccgtcgtatcgcgattaccggcaagcttcaatttcaactcacacgctcacgtggagcgtgaccaatctaattatagcagactatacactgtctgtcatttcaactcacacgctcacgtggagcgtgactaattaactcacttatatcatcatatcttaaaaatttcaactcacacgctcacgtggagcgtgactccgtcctcagcctggataaacgcactccgcaaatttcaactcacacgctcacgtggagcgtgaccgggattctataaccgcaaataacgtatttgtcatttcaactcacacgctcacgtggagcgtgacctttaaatattgtctaaattcgccttgtacaaaatttcaactcacacgctcacgtggagcgtgaccgtaccacttatcattaaggtgtacaagcagaatatttcaactcacacgctcacgtggagcgtgactaactgttccgtcctcagataccgaaaaggtacctatttcaactcacacgctcacgtggagcgtgacgcgtcatttgttcatcgctgaagccgacagccatatttcaactcacacgctcacgtggagcgtgaccagcaacgacagctatcgcataccagttccaagcatttcaactcacacgctcacgtggagcgtgactacgaggaaatcacaggagaaaagtatgaaagcatttcaactcacacgctcacgtggagcgtgacttcaggattgtcataaacgtttccgacaatctcatttcaactcacacgctcacgtggagcgtgacgaacaagggctgatttgtaaatctgttacctgcatttcaactcacacgctcacgtggagcgtgacgctgacagggggaaaataacccctgagcagtacatttcaactcacacgctcacgtggagcgtgactgtccgtccgcctgccgtttgtgtgcgctgcggatttcaactcacacgctcacgtggagcgtgactgaggggaattattcccctcttatatactcggagcatttcaactcacacgctcacgtggagcgtgacttcagcagagacatatcgttcatatatcacgggatttcaactcacacgctcacgtggagcgtgacgacccgtttgccatgacattttagcagttcttccatttcaactcacacgctcacgtggagcgtgactctattgacgcagtagcagacgcagaccagcgagatttcaactcacacgctcacgtggagcgtgaccatagttcttacccttgacaacttcaaattcgtccatttcaactcacacgctcacgtggagcgtgacgtatgcttatattttgaattataaggctactagcatttcaactcacacgctcacgtggagcgtgactttatacgccctatatactcaaaatgaccgcatgatttcaactcacacgctcacgtggagcgtgacataactgctgcggctgaaaaaggcgagccgttggatttcaactcacacgctcacgtggagcgtgacgttcaccagttccctgcgccctgaagatttgaaaatttcaactcacacgctcacgtggagcgtgacttgacaattattgtaaaaaatcaaatattagcaatttcaactcacacgctcacgtggagcgtgacctaatcaagacggtttgcggtggtcactgcaaaatttcaactcacacgctcacgtggagcgtgacaccgattatgcgtaaatcttcgtcaatttccatatttcaactcacacgctcacgtggagcgtgacttattccagctttaaatgactttttgccgtcctcaatttcaactcacacgctcacgtggagcgtgacgattcaatcgtatagcggttaaaataaccgctaaatttcaactcacacgctcacgtggagcgtgacgggattgagtattaaaatttaggcgtgttttaatttcaactcacacgctcacgtggagcgtgaccaaagtgcaatcgtgaaacttaatgacctggcaatttcaactcacacgctcacgtggagcgtgacgatacggaagataacggcttgagctttgaaaacatttcaactcacacgctcacgtggagcgtgaccatgtttgctcttgaggacgtgaaaagagttataatttcaactcacacgctcacgtggagcgtgaccccagaaattcggaaaactggattaaaagcattttatttcaactcacacgctcacgtggagcgtgactgaggcaatcgagtatgagctaaattaatttcaatttcaactcacacgctcacgtggagcgtgacacttgatgttgtgtatatctggtgcttgctcaacgtgatgcggacttatttttttatttaatgggtatcggtttgattttgttcactgtgcgttcacaaatagcatggcattttcatgcgaacttactagggatttgtggatcacttggggtacgctggtcaaaatattaggacaccttcggggtcataggtctctttggtgccgtagtgttctattctatgcttccaattgttgcctaagtaatatatccgcagactatcatgctttgggtctattattttcagaagtttatctttcactttcagaaaagtgccatagtctacgtctatttcaaacacgctgttctgcactcgctgtccataattttgacactctttcgacacttttctcagccttgttttacccttattatctgttgttgatacatcatagcttactaaggtcatcatttatatcacctctatttcagcaaatagttcgggtactcatctagctcgccacggatatattttgcgagaagcgagctttgcacatatgggagtagcccttgctgtatcttttcgcccagatatgggtggactatgcttgtgcgcttacgctcctgccatgcggtgaggacttttttcttgccctctttggagaggtatactgcgccactgacctgagtttcaaagtcctcgggctttatcattttcaagtttatcatggtaagcacaagtcgctccaccacgcagcgaacttcctcaacaaggtcgcaggacaggctgcttctgcctgaacgcagggcgtggtaaaagccgaggcagctatcaagtcctacgctttcaagggctgatgtatatgatgaaattgcgatagtatacagaaacgagagcatggcgtttactctgtcgaggggtgggcgtttggtgcggttggcaaggtaaaaattttctttttggtggagtatcagtcggtcaaatatatcaaaatatgcctttgcacagcttccctctatacccatgatgatatctttatcggcagtttcatagacggtctttatgccgttttcaagatattttatacaatctgtaagcgctccgtcactgtttatatctgggttatcgtggagcgaacgtctgataagataacgtgtatttgaaagctttgcggcgacagtattcctgataaggtcgagctgaggggtagaaaaaagctcaaactgctcttttcgcagatatacgttgccctttgttttgccctgaactcttgcgagaaatttaccttgaggagaaataaaattaacggctatgccatattctgcacacttgcccataagcgcaggtgaacagcccgaatagctgaaaatatagatatcctcgatattagtaaaaggcacacggaacttctcgctgtcctctgccctgcacactatgttttcgccgtcaagtgtgaggtaggcagtttcttcgagaatataaagtgaattgagcagtttacgcattgttttcgcctccgttcatggagaaaatcgtatttttcacgctatattttttcacttttggaaagcacatatccgacagtgaacagcctgaacatttctgaccttttacacgctttgggataatatccgctgcaagtatctcacgcatttttccaagatagtcgcaaagcattttatcatactctgcaccctgagtatcaaagggcaattctgatcgtctgcgcacatctgcatagtacagaaaacatcgactattgcaatgaaatacgttatccacgcaaagcttctgcgcatagacttgtatagcgtcggtctgattgaactcccctgctttgggcttggtgggtttatactccacaatttccacacggaatgtgccgtccagggtatctatatagtcgccgcatttgtcacggacgaactcaatacaatctacaactccaaaaatattgtacttagggtcatcattatacactgacacgtcacttcggacgatcttacgcttattttcaaagttgcgctcgccgctgtggacgttctcatggaggaggtttgctttgacgacaaaggcgttttcagcccagtcgtcattaacttctaaaagagcaaacctgcgtggacaatacatataatgctgtatgtcacggatattgatagttacatcttcgctcatcagagcttttcaataagggtaacgccctcaggcatatccttatctatggagatatcatagtctgagtaatgtcttggagttgtcacgccgtctttgagcttaactgacaccttgtcaaagaggatatgtgcaggggcattgcccagtgcggagtcatgcttgaacacgataagcttacgcatacagagttttcctcttgcggcgcttctgtcatgctcgaacatattaataatagatgtccaaagaagctcaaggtcgtcctcactaaagcctgttatcttctgagcgagcattgcggaaacatagccctcgccacgatagagagcgtatgggattatgctctttttgcccatttcggtctcaccgctctgctgtctgtcttctgttgttcttgcctgtcttgtgattgtgatatcctgagcaaaaacagggtcgatacttcttgcaaagttgagctgtacaggacctcttacaatgccgcacgggtcatcgcctgtactcattactgcaccgaaagttcttacgtcaaagtagttctgacagatatagtcacgagcctgtttaacgtcatcaggattcttgcctttctgctttgtggcaaggccaagggtattataagcttcggtgaactttgtattgagggctttgtctgccttgataaggatattgtagcctgcttcgccctctttggtaagctccacaaagtttcttatcttccttttaaggcacacgtctgtaacgatgccaaggcttgtttcagggtctgttctaggcatattgcctgcgtcagggtcgccgtttgggttgccgttctcaacgtcaaaaagcattacaaattcatatctgttcttgattgcgttttccataatatttcgtcctttctttattcttctgattttttggtgtaaagtgctttattctgctgtgcatagcctacaataaatctgccctgatcgtccaaggagagtgtagacgggaatttgccgtcaagtccgtcaagtatctctccgcagagtttgttatagaatattgggcttgaaagcttcttgatatggttttgtgaaagcttatacagctttggaaaaactgttgacggctttgagcatgcagaagcaaagtatgagtccttaattgttctgttaagtcctccgcctgaagcgtcctgctggatcttttcaagcactgcgaaaagtcttccgcagagataagcctgatttttgttttcaaggtctaatgacattttgatctcctccttattttgtttacggtttatgcagccctttatcaagcctgcccttgtatcattgagttttataaaatggttgttctcctcgtcgctgtcggtcttgacccttgttattactgtggaaagcagttcgtcagggtatcttgtacctttgagtattgcttcaaaaagtgcggcgatgagaggtgacggaactttttctttggacgattttggtgagataagctcacgcttgatacgttcaatgcttacttgatgctgaccctcagtaaacgagatatcctgctgatgtttgagtacattgtcaaatatcctgccgaacttatcgtggaagatgaacttctgggatattcttgaactgtttggggtaaagcctgcaacgtaaaattccacattagggtcatatggcatatctgctgtcctgccctgtttaagctgggtcatgacagtgtttatgtttcggtcggcttcggtcacaacggttttatttaattcgtcctcaaatccgctgaacataccggcaaacatattgcattcttctgcatcgttcttcttcattgcgaaatagactattgtcatatcgtcaaaagtcttgtaatggcttctgtcagcaagcaaagaattaaatgcagaggtatacattttcatggctttctcagaaacattgctgttgtaggactgcttcttgccataggactcaaaggcagattctttcattccaacgagaacacagcctgaggacattccgcctttgataccctttattttatcatggatacgggcttgcgggagcttctcaccaagaatggaacaggtggatagttcggtatcgtcactgtcgctgtcggcgttaagctgggcgagataatcctcataggcggctttgaatttactgtcattgtgaagcttagtttcaggagagccgtcaagtccaaactcatagtaggagcttgaatactccttgcctagggcaagaaggtgtgggttttgggtttcctgctcaggttcccatgtacggataaagttaagataggctttgcagataggtgagtcgatattctcaaagaacttctcattccattcgcaaaagcatttgtgtgattttgccgctttgttggtagcgtctgtaggggtcaaagttcctttatcatagttcagaccgaatatgtagagtggtctgtgttcgatcgtgtttttgtctatgcccggtttctgcgttcttacaggaagctgttccatcaccggatcatagactgtttttgtctttttatttttcagagggataattcggggtactctcaaatcgtttattgcggctatcttgccctcgggggtaagaagaatttcaaagtgtatggcttgctcacaatagcctgcaggagttttattctcctgcaaagcactgtaatcgcacaaggcttttatcagcatttaatctcctccctgtattttgcaacatcgataacaccgtctatcatatgcggacggtagtaaactgcgtcggccttgtcagaaaacttagggtcattccaatcattattgacaggcttgcctccgtcctcaaacttcatgccgtaaagcataaagccaaggtctttatcgcccatattttgtggtgctatctgcgtaaggtcaaagtcgtcaacaagttcaatactctttattgcaaattcacggcagccaaggcatggctgtctgaaatgctggccgtttctgagacgtctgagcattatgttataatgcttctcatcagattcgtcggggtggtctgatttaagataggtgcgctcaaacgtgaactcgataccgtatttcacatttttcaacaccattgccgcacgctgacttcgtatctccgaggtgtacatctccgccgagcctccgcctttcatttgctgtttcactgatgataacagcagcttatctttgacctcgtttcgtcggatattggtaaactcgatagggttgaacaccactattttgtttatctgatagcgcacggcaggcttccaataaattgatttgataagtccctccagtgcgcttggggtgggtacgtcgtaacttacccgttcaactttcatttcaggtcttgcaaagcaagcgtagtcacctgtcacgatgatcttaaaaccatagctcattttttacatcactccttttaaacttatattagtattcgatacattgcttttcgttctatatatatgatacaccattatgaataaaatgtcaatagttttcatgtataaaaaaagtgtcggattttaggcatatttcacaattccacgttcaatggtttgtggtataaaaaagttgactttttaaaataatgtttgtataatatacttgtctatgctttacgcatatgtgagttgaaaaatattcgtattcgatacgatatggaatgcagcaagtggcagactgtcttggtggcagcctgccatttgttttagatgaaataatcctgcattgcggcttgggtgttcaagcctgtttcattattataatagctttgatttacaagaatgaatatgcctgtgccatgatctttgagaacaccctgagaatagagatccttgaaaacattcatatagatggacactgaatatttctgcaatgctcttcttactgacatatcaccattacgcaaggtttcaacaagttcatggcaagtctggtcgttaggatcgtcgataacgatagagatagtgtcggcagagatgtattcaaactgcattgcatagcttcggaatggtatgctgtatggtgacattaagccttggcggtcgaatgagttgctttgttcgttatatttcgcaatagagttttcagctatacgactttggttgaaatcgaaaatgccgtcgtagtattctttaatacaatcataggaagttatgtcctggtacttttccagcaaacctttagtcttgttaattcgcatggcaaggtcgcttcccttgcggtatgtttcgtcaatgtcgaaaacgtacacatagcccttgtcatctttaccctcacgattacatctgccccctgcctgcaaaatactgtccaaacctgaaagctggcggaaaactgtgttaaagtcaaggtcaacgcctgcttctacaagtgaagttgaaactactgtgatatgctcgccattttcaagcttatttcttactacttctatgacacggcttctgtgggctggggtcatattggctgaaaggtgatatttttcaccttgaacaaggctataaagctctgccgatgttttcttggtattcacaacgatcagggcatttttacaccgagaggcattttctgcaatggtttcaagagaggttttgcccatgtctttatattcgcatttcttgaaatacttaaaattggttcggtcggtaacaagcttattatagttcacatcaggcaggaacttatcaaaaagcttagaataatcgggcattgtggcggagagaaaaagggcttcgctgttaagatattttgttatatagcccacagctttaaggcaggggcgaagaagttctgttggaataaggtgtatttcatcaaaaactatcacgctgtcacggagattgtggagctttcgcagtgctgaacctttataatggtatatggattggaaaaattgcacgcttgtggtaattataagtggtgcgtcccaattctcgcaggtccttttgagcttctctgcggttttcttttcttcctctgtgtcaccgtcataggaatagtttgaatgatgctgtaggacagggagaacgtcacgaaacatctcctcgaaatctttggctgtttgttctataatgcttgtgtatgggataacgtatatgatatgctttttgccgctttcaacggctttttcaagggctattttaagactgcaaagggtcttgccactgcctgttggcatatcaaggacggatatgtggctgccttttgtacaatggtctatagcttgcttttgtatactgcttcgtgcctgctgtaatttggtttcagaacgcatatttttcatgcgctcattaagaatggaaagtgccttttcaaaatcaccgctcatgccacgttcaacatttttattgcaaaatgtttcggtatcgagaaaatctgcgtctgtcaggcaagagaaaacgtacttggtgaaaaaggcgtaacgctcgataagctcggtggggtcttttgcagaaagcagttcatttaatggcggtgttatttcttcctgagttagggtggcaaattctatttcagaggcgtatgcgctgtagtcactatcgcctgtatattcgtctgctctttttagtataccgtttagggtcgggctgtcagagttgtctgcgcctgtgccgccgtccataagtcctgtgtggtgtcctgcgatgcaatattccataaggggtgcgaaacaatcgtttttatctgcaagatttttatactctatcgctccgcaggaagcgtggctgaattttactttgtcatcatcaagccgtttctgaaagttaagagcatacttacctatatcgtgatacaggctcgcttttttcgcaaggggtttcaaaagatctactgaaaagtcctcagccaatttgcttacgcctataaggtgggcttttacagtttgcctttcaccgtcctcacgggtgtgtgcgtaatattccatggtcattcctccttttttgatagacagatctatttttgtatttattatagcatacaatttaatacttgtggggaaaatttttgtacacataaacaaatatttgtacaaattgttatatttttattataatacattataatatataggtcaacataaagcattcgacattttgaaaatttgacttgattattatttaaaaatgtgttaaaattaaactataagtaaattagtatttttttaaaatgttatgagaggaatttatatgaagtacagacttttatacaataagatcacagtagtggctctttcagcgatgttgtcgctgagtgctgtatcatgtggtaagcttgacgcgagcaagcttgacggaaacgctttgacagtgaccgaaaccgagagcaaagcggaagtcaaaaaaactgaggacagctccagtaaaaaagaggtcgaggtgaatgaagaagaaaaggaacagccaagctacacctgctcgctggtttgcgtgggcgacaaccttatacacgacaacatttataatgaggcgctaaagcttggcggtggtgaaaaatatgatttcacgcaggcttatgaacacgttacaaagtacatagaaggcactgatgtggctataatcaatcaggaaacgcttgttacagacagcgttgaaccacaaagctatcctatgttcgcatcgccaactgctgtgggcgacaaaatagttgacatgggcttcaatgtggtttctatgtcaaacaatcatgttctcgaccaaggtgaagaggggcttataagctctcttgattactgggacacaaagggcattgtgcattacggtgcttatcgttcgcaggaggacgctgacaccatcaagaccatggaagtcaacggcataaaatttgcttttctgggatatatggaacacaccaacggcaattatctcagcggtgacggtgctaaggtgatatatcttgatgaagaggacaagataaaggctcagatagaagaggctgacaaaatggcggacgttgttgtggtttcatgtcattacggcacagagatacagaacgagcttaacgaacagcagacggagataacgcctaagcttgtggagtggggtgctgacctgataataggcacgcaggcgcacactatcagcacttgcggatatcttgacaagcctgagggcggacaggcattcgtttactacggtttgggcaactttatttccactatgtatgacacaaagtcgcttgtaggacttattggcaagctcaatgttgtgaaggaccctgacaccaatgaggtgacattcgagaacgttaaggcgataccgataatatcgcactttgagggtgattcatactatggcgattggtacaactgcactgtttatccttatgcggaatacactgacgagctgtttgccaagaattatgtagagggcttcactcgtgagagcgtgaagcaatgcttgtcttacatacctgatgagtttcttagtattgagtagtcggggcaatatgtaggggacggcgccctcgacgtcccgtttgcaaaattgataaagaatatgatatttctgcggacgacttttatgccgtccgctttttttggtattgtgtaaaggtttacatatatcttaataaatttatataatgtaaatatcaattcatgaaatgtttacactaaaatatgctcaatccattaaaatacttgcacatatcacttttttactattgcaatttaggcaaatatgctataaaatatacataaagggggaggaacggacttcccgataaaattttcatttttttatattctgaaaactactttaaatttacaggagggtttattacatgaaatttgctgacggtttctggctcaaccagagaggctacgaagtaaactatgcaaatcaggctttcgagatcgaagagatcgaaaacggattcctcgttgtggcaacacctttcgttgtatacaacagagctatgatgctcggaagtgccaaccttgagatcgcttacacttcaactcaggagaactgcgtaaaggtaagcatcacacaccacaagggtcatgttgacaatggtccgcactttgttctcgaggacaagggcttcaaaccacaggtaactgttacagacaaggaagccgtacttgttacaggcgacacaaagctcgttgtttctaaggagaactggagcttcacatactattataaggataagaaactcacaagtggtggctggagatcgacaggcgttatttttgagaatgcttacaagcagcaggcaagacttcagacacagctcgacgacacattctggagctaccctgccgatcctacaagaacatacatcagagagcagtttgacacttctgttggcgaatatttctacggtttcggcgaaaaattcacaacattcacaaagaacggtcagaatgttgagatatggaacgctgacggaggcacttgctcagatcagtcttacaagtctatcccattctatctttcttcaaagggctacggtgtattcgtaaacagcactgacaaggtttcatatgaggtttgctctgacactgtttctaaggtatcaatgacagttccaggtgagagccttgaatactatgtattcggcggtgctaacctcactgacgtactcaagggctacactgaccttacaggcaagccttcactgccacctgcattctcatttggtctgtggctcacaacttcatttacaacaacatatgatgaggagactatcacatcatttatcgatggcatggctgagagagatattcctcttcaggtattccactttgactgcttctggatgaagggctttgagtggtgtaactttgagtgggacaagtcacagttccctgacccacctgcaatgctcaagagacttcacgagaacaagggtcttaagacttgcgtatggatcaacccatatgttggtcagcgttcaaagctctttgacgagggtatgaagaacggctacttcatcaagaaaactgacggctctgtattccagtgcgatgagtggcagcctggtatggctattgttgacttcactaatcctgaggcttgcaagtggtatgcaggatatctgagaaagctctgcgaaatgggtgttgacacattcaagacagacttcggtgagagaatacctacaagagatgttgtttactatgacggctctgaccctatcaagatgcacaacttctacacatatctttataatgagtgcgtattcaatgtactgaaagaatattttggagagaacaaggcttgtttgttcgcacgttctgctacagcaggcggtcagaagttccctgttcactggggcggagattgctcaggcaactacaactcaatggctgaggttgtaagaggctgtctgtcactttgtatctcaggcttcggctacacttcacatgacatggcaggctttgaagctactgctacacctgacatttacaagagatgggctgcgttcggtatgttctcatcacattcaagactacatggtaaccagtcatacagagtgccatggctttttgacgaggagtcctgcgacgttctgcgcttcttcacaaagctcaagggcaagctcatgccttatctgtgggctcaggcaatcaagacacacgaggtcggcgtacctgtaatgagagcaatggtcatcgactttgctgacgacccaacttgcctgacgcttgacagacagtatatgttcggcgacaacattcttgttgctcctatccttaatgacgagggtatcgctgaatactatgttccagagggcaagtggacagatattatcaccggcaaggttcttgagggcggcaagtggtataagcacaaatgctcatactttgagatacctgctcttgctaagccaaacagcattattgcatacggcaactttgaaagacagatagagtatgattatcttgagggcacaacattcactatctacgaacttgaagacggcaagagtacagtttgccctatttatgacactgaggcaaacaaggtattcgagctgacagctacaagacatggcaacaagatcgagtgcgaatacactgacacaaaggcaagcttcaagatcgctgtggctaacacagacaaggctgttgaaattgctcctaacttcagcggcaaggtcatcattgaactctaatgactaaataaaactatcgctccgagagatcggggcgatttttttgcgttcacacataaaatcggggcaaatgagggtaaaaattctgtatatttgctcttgaagaaaatatgagatcggggtataatatagatagtacgatttgaggagtaattttatgaagtcaagaatacgaaatgctataccgaaaaagataatcggcataaatatcagttcgcaaaagcgtgatatcattgaagatattgctaaaagcgaaaatgcggaggctgttttctttgacaatgagataatgggacagcaggtgggatatctttgcggtttcaagggctttgtcaggtctgaaaaagagggcgaggacatcacggacgaatgccttattttttcgggcattaacggcaggagccttgaccctatactgaaaaagctcagggaaaaagaagctacggtgaagttaaaagcaatggtcacggcacacaatcaaagctggaacgttggcgagcttattaaagagctgaggcgtgaacacatttacatgaacggaggtgacagagatgaaaagtaaatacaaagctattatttacattattctgtcggctttttcgtttgcattcatgttcgcatttgtgcggctttcgggagacttaccgacggtgcaaaagacctttttcagaaattttgtggcgttgtttttcgctatcggagtgctaaagaaaaatcacatacgctttcacattgagggcaaaaagaacaatgcggtcatttttgtgagggcgcttgctggcacgctaggaatgcttggaaacttttatgccatagatcatcttgtgctgtcagacgcttccatgctaaacaaaatgtcaccgtttttcgttatcattttctcttttattttccttaaagagcggctgactttctttcagggtttcactgtaatttgtgcatttataggaagcttgtttatcatcaagccgagttttcagaatgtggacttcttccctgcccttatcggttttttaggaggaatgggagcgggacttgcttacgcttgcgtaagatacttaggacagcatggagtaaatggtgcggtgatagttgcatacttctcgggattttcctgcttattcaccctgccatttctaatattagatttccaccctatgacgattttccaaatactttgtttattgggagctggcgcaggtgcggcaggcggacagttcgctataactgcggcttacactcacgctcctgcaagggagatatcggtttatgattactcgcagttgatttttaccacgattttgggatatttcctttttggagatattcctgatggctggagctttcttggatatttcattatcattgcaatggctgtgcttgtttttctttacaacaatgtttggcacaatgacagcgaagtcaagggctgacaaaaaggtaaacaaaaagagcgtttttactttctcggtaaaaacgctctttattattaatattgtagtttaagctccgcctgcgataaatctcttgagatcctgtgggtttacgcacttttcaagcgcaacgtccatggagatcgttcttgaacgaacgagctttgcaagctcctgatccatggtctgcattcctgttgctttacctgtctgcatagctgaaccgataagatgcaccttatcgtcacggatcatagctttgatagagtctgttgcattaagaatctcacagcaagctacacggcttgtgccgtcgaatgtacggcaaagtgtctgagtacagatacctacaagaacggaagcaagctgagttctgatctgatgctgctggtgagcagggaaaacgtcgatgatacggtcgatagttgacggtgcggacgttgtatgaagtgtactcataacaagatgtcctgtttcagcggcggtaacagcagcttcgatagtctcgaagtcacgcatttctcctacgaggataatgtccgggtcctcacggagagcagcacggagagcaagtgagaagctcggtacgtcaggtccgatctctctctggtttaccatacatctcttatgagcgtgcatatactcgatagggtcctcaatagtgatgatatgagctgatttatggatatttacatggtcgatcattgcggcaagagttgttgacttacctgaaccggtagggcctgttacaagcacaagtccacgaggtctcattgagaactctgcaaggataggtggcaggtcaaggtcggtaagggtcgggatatcgtttctcaaaagacggagagcgatggccgtgtttcctctctgacgatacacgtttacacggtgacggaaacctcttgaagatacatatgtaaagtcggtatcaatatggtctttgatagactgacgctgcttatctgtacacatatcctcgcatattttgagaatttcgatctcggtcatatcaggatatgaggaaagctttctcaggttaccgccctgtctaactatcggcggaatacctacggtgaagtgcaggtcggaacagccaagggctcttgcttcatcaagaattttgttaatgtcgattgccattagaatttacctccatatatttcttttttatacagcatatgttacacggataagttcgtccattgaggtcttgccttgctgaacaagctctgaaacgttgtcacgaagcaggtgacagccctctttctttgcaagctcctgaatttcgtcagcttttgctccccttgtgataagagcctgcatagacggtgttgcgagaaggatctcatggatagcggttcttcccttatatcctgtgttattgcactttggacagccacatgggtcgtacacctgtactgaatggtcaagacccataagctcattttcttcctcagttgacattctaggctttttgcactcagggcaaagcacctttgtaagacgctgagcaacgataccgataagtgaggttgcgaccatgtatgcttcaacgcccatatccacaagtcttgttacggtagaagcggcgtcattggtatgaagtgttgacagaacaaggtgtcctgtaatagcggcacggatagcgatctcagcagtttcggtatcacgcatttctccgaccattatgatgtcagggtcctgacggaggatagaacgaagggctgcaccgaatgtcatgcctgccttttcgtttatctgacactggtttacgccatcgatctttttctcgactgggtcttcgacagtaataacattgttattaggctttgagatctcaccaagcgcggcataaagtgtggtagatttacctgaacctgtagggcctgttacaagtacaacaccctgtggcactttaaggcaagactcaaatctcttatagttatactcggtcatacccaggtcggtaatttttctcagtgacatatcacctgttgcgaggatacggagaacgactttctcaccgtataccattggaaggttagatacacggaggtcgagagttgtgccgtcaacaacctgtgacatacggccgtcctgcgggatacgcttttcggcgatattcatgccgctcaagatcttgaaacgggtaacaagcgaagtatgaagtgcggcggaaagagtcataagctcgataaggtcgccgtttacacggatacggataacggttttatccttgaatggctcgatatgtatatccgttgcgtcctgacgctgggcgttctcgacgatagcggtagcaagtttaacgataggagcgttctcgattctctcctcggagatatccttgagttcttcaaggttaagctcttcctctttttgctttgtagcttcgtcaacaacggagttaacctgaccttctgagtacatcttaccgatagcacggttgatagatgactttgtggcaaggacaggtgttatgctgcagcctgtgataacacggagatcctcgaaaatatagaagttgatagggtcattagttgcaacggtcatacgcttgcctattttgctgactgcgatgacgttatactttcttgcagttgcctccggtatcttcttgacgatatcaggcataagctcagtattatcaaggtcgatataggacacattcagtcgctcggcgaggacctgacagaactgaacatcggtaacgagcttcatgtcaataatgacatcaccaaaaagtcttcccttttgctccttctgtttggcaaggacttcctgaagctgttcttcagttataagacctttctgtaccagatactgaccgatagggccgtttctcatatatattactccaatcctccgcattgatttagggatccgacgctgcggaaacgtctgctgcggtgcaaaaaccgcaaaaaaatcatattatctattgtaatcttcatgaaagtatgataaaattaatatattaactaatgaatccaaaggaggatcactgtggataatttaaccttatcatacataatcatttatgtatttgtgttcatcttcggagcgtgcataggcagttttcttaacgtctgcatataccgattgccgaaaaatgaaagtcttatcaagcgaaattctcactgtatgacctgcggtgagccgatcaaacggcgtgacctgataccgatagtaagctggtgcatacttcgtggaaagtgtcgaagctgcggtgcaaagatatcggcaagatacactatagttgaaacgctgaacgcactgctctacttatgggtattctaccattttaatggaattttcaatccgcttcgtgcagcacttgtctgtctgttattctctgctcttatcgttgtattcttcatggactgggacactcagcttatcaacacatatgttgtgatattcataggtttgcttggtgttgcggaatatatcttctgcaaagatcagacgggacttacgcttaaatcacacttgatcggatttttcattgtgagcgtgcctttgcttattatttgtcttatcacacatgagaaagcaatgggcatgggagatgtatatctcatggcagccgcagggctgtttctcggaatgcagggtgctttggtagcgcttcttatcggactgataacaggctcgatcggcggacttatccagaagcaccgaagcggtgattcagtatttgcatttggtccatatctctccataggaattgctgttgcagctttgtactcagagcagatcggttcatggtacatggactttaccggtcttaacgagatgatgaacgaagcaatgctgataataagatagttgcaaattccgcagtttgatactgcggaatttttttgctcaaaaaatcctcttaatagaagttttctgttaaggggattttttcagcaatcagacccgtggtggggtctgatcgtgaaagactataaactacatctttacataatatgtttttccaagatcactggttgtaagagtaacattagtaaaggcattatcaatattttgccactctttttcccaaagatttacacggcaaggaacgttataaggaattgttgcagttataacataacgaacttctctgcccttatacttagaaatatcaatattagaattaccagtaaagttgtctacaatgacttcattatccgtttcgttgactatcttagcattcatattacaaaagtatccatacatataggaataattattacctgcactacaatcaattataatggtaactctatccgactgacttgtaggcaaagatggcttttcaacaaatacagcttcaaacactgtatctctagtaattgtaacactggttatctcgtctgatgtaccttcaacgacccacttagaaaaaaccttattagcgtctgacgaaacaggggtagctcctggataatttgcatactgtccatcagaaacataaatagttgaagcatttattaaagaaccgtttaatttaaactcaaccttatgcttgttctgtacaactggaacgaaaacaactgagctatctgtaatagaaacatcagtaagaccctttgagttatctgatttgtatacccacttaacaaaatcctgttttatagtatccatgtcagttggaattcccgggtcatttgcaaagtcgccatcatagacttttgttgttgtaaatgtagaaccgttgatattctcaaacgttacattaaattgggctttcggtgcaacaggcggataaacacaggagaataccatatccttatttattgttacgcctgttgtaaaatcagcaacgttattcttgctgtctacccaataaggtgtgccatagcctgttctttttgccatggttggcggcgtttgataaagtgtgcctgccttgaccgacttagtatctatctgtttaccacgaagcgttgaatcagggtcgcttgcagagtagataaactttacactgtatgtttttgaacttgaaactgttgtcttatcgtagaaaatataagtatatgtgtttgaagcgtcaaggctgtaatacttttcctgctgagctgtgcaacctgcaggagcagtagttgcctgaggatatgtgacataatcaggaagtacagagaaatctttatagtcattaacattgtatgaatcgccttcatctatgttaatatttgtgagatttactgctgcgtcctttttatactttgttttcgtaaaagtatagcttccgttctcatatgttggctgataggctgtaagagaaacgtcgagagtacgcatttcctcaatattgctgatacttgcaccgatatcaaacttataattgtcgtaaaaatcaacgcctcttgcaacagcagaattattaaagtttaagccctctgtatttaccttacctacattgaggatacagccttttgcacccattctctttgcggctgtatccgtgtcgttgcctgaatagtttttcagactatagccacgaagattattattgtcaataacgatacaatttgaataggtcacaccgcttccaccgatagtaccagaggttgaaacatcaggcacaccaatataatctttaagcacaagaacattggtcgaatatctaagctcatcatcaagatagtctataagacctgaacctatgatattgctttccattgttgcatcagcgtcatgataaacgttatttgcaggtttgatcatattaaggatagctccgaggatcacgccgaaaatcgttaccacaacgataagctcaacaagggtaaaacccttgcggtttttattcattttcaagatcctccctccttatggtgttgattgtgcatcgtcatattcagcctggtttttgtaatcagagccacccatataatggataactacataacctgtagctttacctgacgcatctttttcaagataatggtcaaaggtcgcatctgtgatcttaaatgcagctgcatcggctgttggagtgctgctgtaaagatcagatgactgtgagaagccgaaataatcgcttcctgttacgcctgaaagcacaacgccaaactgctgatttccaccgtcaccgatagggataagaagtgaatttcctgatgagttattatttacatcaaagaactttccgcctgtaagctcaggcgtaagagcatagaaattcatatctgcccctgaattgttataaaactttacccagtaaacgctcttttcaggattaggcgtaatgtttatgtccttaccctgaagaaatttgagctgatagcctgcgtcttcatcaatattattaagctttgctttaaagccataggctgtagtattgaactttataccgcttccaaagtctgcctcaagggcaaactcatttgtagttttgccacttgaagagaacttgtttaccttcaactcgttcatattgacggtcttgttatcattatactgctcggcatttactgcctgagtatacatttcattgttgcggtagtagttttcaagattctgtttttttgccgctacagcaactgtaacaagcatagctgacatacctgacaaaagtgccattgctatgatgacctctacaagagtcataccctttttatttttgctgttctttttcatgagtatactcctttcaattaatagtgatcatatctgtcaagagtatatccgaacgctgaatcgtccttaccgcccttcgcattctgcattacagaagtagttgaaggcttagtgtatacatagaacgctgtattggcgttaccaaagctgtttgcgataactacgccgaccgcacagcactgaacggtcattttttcgcctgctgagtctgttaccacaagtccgccaagaccgcttgttgcgatattaacgatagcctgtggtgaatagaatgagccctggaagaagctttgatctgtagcgttaagtgttgtgttctcaccaaacaggaagatgatgctgctgtttttcggtctgtaagagcctgcaacatctacagatgtagggttgagaacaaagccgctctgtggtaagccagggttaccctttgtattattgagaacagaagaatcaaacatacgaacgtaagtatcataatcaaataccttaagtcccttaaagctatagttacaagcactagagcctgaatgctgtgacttgcctgttactgagtcgataccattaagtgtaatagcactgcctgagtctgaaacaaaatagcagttgtattttctgtcacctgtagtcgtatcaattatagttgaacgatttctaacaactattacaggtgaccattctgctccaagattaagaccattctgaagtcttataacgatatcacccgaagaatcagaaacatcaacgaggatccttgaaccattgccataatcattgaacgaaagatcagatgcccatgtacagcttgatgttattctcaatttgtagcggcttgtaactggagtcttagctcctgttcctgtaaggtctattagctcagtaagcgtgtagtcaacattattccaatagcttggatcgcttgcaaaggtattgaaagttttagtgtttgagccatcatagaaagcctgatattcatcagagatcgttgtcacattagtatcattgctcatgaagaaatcttccggataatatacataggcatcagcagatacaggtatctgtggctttgcgtcacgacctgctttgctaagaacagctccttcatgaatatttgaagcctggcagacgatcttatctttacccgtgatagtgccggtaacataaactgagcctgttaccttaagtgactttgtgacattaagatcaccctcgacatagagagagccattgatcgtctgaccatttgcaccaaatgttgcatcgccattataagcacctgcgcccttataaacgtagaagttaccatactgtgtatagtcatttccgccaatgttagcttcacaacagaacaaatcgacatcaaaacctgaagaaccaacgtccatatggtttgaagtggaaagcttctgaccgatattaacatagttatatccgtctgctcttgccattgtggagttgatgcggaatttatttgaaacatcaaggttttcagaaattgtaacagttgaaccctgcttttcatctacaagactaggcttgagcatgataagaggctgagttgaaacctccaaagaaccatacataagataagaaccatagatactggtattgtttgtaaatctatagaccttaccagttgtattattgataccagccatatcaccgataacgttaaggttatcgtaacctgcgccgccgttaccaacaagctcgatagtatttgtatactcggcaggctttgtaactgactgcgtggaaatatgagctgctaccttttcagtttttcccagataagtagtttcacaggtaacaacgatatttgcaacacttgtaccctcctgtgctacagttatctttgtggtaccgatattatcgcttttaccatttgatccattatagctgacattagtagttgtaccctttccgctattagcacttgctagctttttaaggttatctatggcctttttctgctgagcctttgcagtagggtcattggttggagcagtatcagtttgtatctgattaataaagctttcaagagtagatgaagctgtcagataagcctgtttgctcttatagttatcatttgtttttgtcctgtttaccgaaacaaaagaaacagttgcagtcaaaagtattgacagcatgagcatgacagcaaccgctgtgaaaagcacgactccgggtttgtttctttgtttcctcttcggagtattcttcatattaaccacctttcttagttttattatcacttatgctatacttttttcattttacacaagttgattacttatataaaatttttaatcattatatagcactaattggcaggacaagaaatattccttatcctaccaaatagttttctcttagctggcagaaggatcagcaagcttcttcagaacgtacatattcagtgtcatagagcctgagatctcgctctcgttgacattttcaatgctaacattctcgatcaccatgctcttttcgttgtttgttgtcaggttgtcagcaaaattcttgaaacctgaaagcgagcttttgaactgaatgtcaaggctatagtaacctattgtctgtgcagctgtttcattggtatcagctgcattttcatctgtgtttgcgtctgcagctgatgaatcaattgtgcttgcattattgtattcatctaccttagtgtcaaaatcagtagctgttgctgttgactcataagcaaaaggcgaaagaactgtgctgccgtatgatgaaatagtcatattggagtttttgatctttacatcatcaacattaaaaagctcacgaaccttatcagtagccttgtatgctgcctgataatcatagaagttagctgcgacctgtgaggtgcttgtataaagtgtctgaatctcagcggcaaggttcttatccttgtctacctgatcttcaagctcgctgagctgtacctttgctgattccagctcactacttgcctgactacactcatcaatagcaggcttaacaaaaagcataaaacctgcagcaattacaagcagtacgaatactactatcaaaatcattttatcacgataattcaacttcataattattcaccctcgccctcttctttaagataaagtgtcagcgaatcaagcgttacgcctgagctgccgtcttcaccgatcgaatatccgttgtatcctacatcttcctggaagagtcctgtacctacaagggcatcgattgctgtttttacatctgactgatcatcaagctcaaccttagtaagtgttactgtaccagcttcaaggttatatgtaaagccctcatacttgaaagaaccaagagcttccttgatgtcgtcaaacatctcacttgacacgaccggaagtgtttcaagagctgcatttgctgatgtaacatagtttgaataatcctgcatgatcttcatcttattgtgaagtatctggttctgggcgatcttctcattgcaaacagctatcttatcattagtcttgtctatatctttctcgatagaactcttcctaagattaataacaagtgttgcacctgcgataagcactgcggctgccgcagcgaagataccgcctgtcatgagcagcgaacccattccgctgctgccgcccttacctgtggactgatcgacttcgaggagattgatcttctctgttgccttgtttctcttatagagagcaccgatagcattagcgaatactgtaaactcgaagttctcaaaacctgtgatctgagcaggcacaccgagaacagaagcctttatatcaagaccgtcaagagcgtcaacgagtttgatgtagtcctcgataaagccgtagagaataacattttcaagtcctgaaccgcctcttgccttattgaactgctccattctgaagatgttctcgttaagagcttcagtgatataatcgtcagaatcataatcttcttctgagataggaacgtatctggcgaatgccatctgtccattctcaaaaagagtaagaccaaggaagttcttatcgatctggcaaaccaacagaggcattttctccatgttggacttgtcagcaagaacgattcttgcgatagagttacatccgatgttaacagatctgaggttcatgcccataatgttataaagctttctgtagctttcaactatcgtactagggcaagctgttgcaagtaccttcactgcaccaggattatcctcacctgcttcacctactactgtatatgagatagaatactcatctgtgatacccatttcctggctcatatggttctgtaccataagcaggaactcattaccctttgcctttggaactacaagctccttgaatacgatgttgctcgatgaaaaagtaacgatagcgtccttatccatcatatcctcagccttgatctgagtgagcagtaactcagacagacctgaaaggttgatgacctcaccattaaggatcatatcctcaggaatgtccacctgcaaagatctctcgatccttatcttgttagaggagttatcacctttaacaatgttgatttgtctatcagaaatatcaaatgatagcatttattccttcacctcttaaattatttttcaaaacaaatatcttccctctccgttttaaaggagaggagatatttaaaattaacgaacataaaatgcagacccttagttttccagacctgacaatgaaccgtagagcagtgggaagatacccgcaaggcaaagaccgatcgcaacacccatgaacacgatgagcaatggttccataagtcctacaagtcttgtaacggctgcgtctgcttcttcctcatagtagtcagcagttttctcaaggatctcatcaagagcacctgattcctcaccgacatagatgatggaagtaaacattccttcaaatatctctgtttttgcaagtgacgctgaaagcggtgcgccctgcttaacttcatcaactacctgaatgaacatcttatcaacataagcatttccaagtattcttgacgaacgttcaagacactctaccattgggataccgcttgaataaagtgatgaaagagttcttgcgaaacgaccctcgtagatctttaccataagctttccggcggcaggcatctttatctttatgtagtcaaatttaagtctgactgacggtactttcaaggcgtatatccaaccgaatatcaaagcaacgaccacgataagaatgatataccattttgccttgaaaaagtcactgaatgagaagagagccttagaaagtgcaggcatctgatcctctggcataagacctgcaaatataggcatgatgaacgtaaacataccgattaccatgacgatacaaagaacgccaagtatgataggataagtcatcgcactctttaccttattgttcaacttgtttgagtttgcatagtaatcgctcagacgctgcattgtcatatcgagcgtacctgaggtctcacctgcgtctaccattgagatgaaaaagtccggaaagcttcctcttcttgtatcgagggcctcggtaaagctctgacctttctgaacatcgtcataaacgcttctccaaacatcctttgcacccttattctcctcttccttatagagaatgtcgagcgctttaacaatggtaagacccgatgtcatcattgccgcaagctgacggcagcagaaagcaagttccttagtattgaacttgtgcacagattgtttgcctgcaccgcccaatgcttctgaataacttatacagaaaagaccttgttcgtggatcttgtccagtacttcctgtgcatcctcagcctcatagataccctttatggtttttcccgaggtatccttagcaacataggaaaatttcttcataatatgtagatacacctccacttatttatacattttgtgcattcataacaaaaaactttaaaaatacacaaaacgcatttttataattataacattattttcatcttttcgcaagtgattgagtgctttttaagcgttaatttatttacaaaataatcttcacaaatttatcgaatttgtacaaatagaataattaaactaacattttaaattatatttaacattcaaagcgagttcatacagatttccgatagtaaatactcttatttatgttcaaataatacaatttatactttattatctgtcttgcccgcactaaaagatttcatacttttgagaatgacaggatgcttatgaacatacactttataggctatcagatagaaacaataggacgctgcaagaagaagtcctatgccgatgatcacgcttacaaggtagttcatgcccacgccttcattcagccatatacacggataataaagcaccttatagaagatatctcccttgccctcctgactgaatgaatccctgaatattgcaggaataaaatacactagaagcataagaagatacactattgtaatattgacccagctccaattttcatatgcggcatggcgtttgccgtcgtcataaaaaagtctcaggaaaaatataagcatgaccgcaaagcccataaatgagtctacattactatttgtcataaagcttttgaaagcagatgtgcttgacggaaagaccgtaaccagagccggtatcagcacaatgcctgcaaaggctgaaaacagtgtaagaacgatcattatcccaattctcgacagaatgtactttaaaaattttattgcctccataactacctccgttttattcttttactttataaagcctttatgctttacatctcatcttacacgataaagttttcagactttacatctttcaattatctgacatagttttatcaaagagtttatccacaagctctcttagatatatattttctgtacgctcaagtttagggtctgcgtttctgataagctgtgcggcttcctgtgcttttcttagtatatccatatcctgtgacatatccgctatcttcaatgcaggaaggccatgctgtctgcttccgaaaaagtcaccgggacctctgagtttaagatcttcctcagatatcttaaagccgtcgttagtcttgcccaaaattttaagccttttcacgctttcctcattcacgttgtctgtaatgaggatacaacttgatttatatttacctcttcccacacgaccacgaagctggtgaagctgggaaagaccaaatctgtcagcattttctattaccattattgccgcattaggcacgtcaactcctacctccacaactgttgtggaaacgagcaggtctattttatgctccttgaagtcgttcatgacctgttctttctgagcaccgctcattctgccgtgaagaagtcccacagtgtaatctttaaacgtaccctgagaaagctttttagcataggtcttaacgtcctgcaagtccatatcactttcctctatcattggacagactatataaccctgtctgccctcgtcaagatattttttcacatagttaaaagcacgctcgcgaagctttcctgtaacggcatatgtttcaacgggctgtctgcccttaggaagctctttcagtacagaaatatcaaggtcgccgtatatcataagggcaacagttctagggataggcgtggctgacataacaagcttatgaggattttcaccctttgaagcaagtgccgcacgctgttcaacgccaaagcggtgctgctcgtctgttatgacaagggcaagctttttgaacttcgttgtctgctgaacaagagcgtgtgttcccactgcaacggcgtattcaccgttttcaagcccctctttcacaagctttttctgttttgcggtcatagagcctgtgagcagtgccacctttacgcctagcggttcgaggaagcctttcaaggtttcataatgctgttctgcaagtatctcagtaggcgccataagtgcgctctgacagccattttcatacacaaaatatgccgctcctgccgcaactgcggtcttacccgagccaacgtcgccctgaacgagtctgttcataggctgttctttctgcatatctctgatacaatcctctatggcggttcgctggctgtttgtaagggtaaaaggcagagcgttataaaaactgtccatatcctgcgttttcagcacaaagccgcttttttcacggcttcggcttttcataagctgcataccaagctgcaaaacaagaagctcgtcaaagacaaggcgatttttcgcaagctcgcaggtgtgcatatcttttggaaaatgtatattctccaaagcatattcaagagaacagaaattatacctttgcattatgctttttggcagcggctcatagatattcttattaaaaacattcagggcgagccttactgtttttctgagcatttgctgactaagaccctctgtgagatgatagacaggctggactttatcttccgtatcggcagaaagtatcacaggagaatttatctcttttcgcacaaggtttcctgttatcctgccgcagaggtaatactctttatccacttcaagctgtttatacatatactcgctgttatagataactattacaaggtcggtgacgtcgtcggtaaaaatgactttgtacactgacagaccttttctaatatgggcttcagggagctttttaactactctaccctttactatgcaaggctcgttaattggtgcgtcggctatgggcacgggggaggtataatcgatataacttcttggataatgacaaagcaggtcatagaccgttttcacgcctaatttctcataacattcggcacgtttttccccaacgccttttagatactctattggtttctcaagatcttttaacaaaccctcaccacctgtcagctttcactccacttaatacgattatatcatacatcacataaaaggtcaatgacttttattcaaatcatacatatttacgccattttccctgcacgttttgcatttttgcacaaaaaaagaacagatgaaaaaaatcatctgtccttgataaaaactatatgttattatattttctcgccaaactcagaatactcgatagaagctctgatgaaatctctgaacagagggtgcgctctgtttggtcttgacttgaactctgggtggaactgaacaccaacgaaccatgggtgtacattctttggaagctctactatctcaacaagcttttcgtcaggtgaaaggcctgcaagcataagacccttatcttcaagaagctttctgtattcattattgaactcccaacggtgacgatgacgctcacggataagattctgtggtgctgaataaatctcagcacatcttgaattgtctgcaagcttgcatggataaaggccaagtcgcatcgtgccgcccttttctgtgatatctttctgtgagtccatgatgtctataacaggatatggagtgtcaccaaactcggaagaatttgccccttccagtcctgcaacgtgtcttgcaaactcaacaacagacatctgcataccgaggcagataccgaacattggtatcttatgttctcttgcatatttgatagcttcgatcatgccctcgattcctctgtcaccaaagccgcccggtacgattataccgtcgcagccgtggagcatttcagctacagtgttctcattgagattttcagactgtatccacttgatatcaacttctgcgctgttctcaaaaccgccgtgacggagagcttctgctacggaaagataagcgtcctcaagctcaacatacttgccaacaagaccgatagttactttcttgttacagctatgaactctgcctatcatttcctgccactctttaaggtctggctgtctgcactcaagcttaagatgatgacaaacaacatctgcaaggccctctttttcaagccagagaggcacttcataaagtgatggtgctgtaagattctgtataacatcctctgctcttacgttgcagaaaaggcctatcttctgcttcatatcctctggtatctccatttcagaacgaagaacaaggatattaggctggataccgatagaaagcagttcctttacggaatgctgtgtaggctttgatttaagctcctttgagcctgagatataaggcagcaggcacacatgtataaatacggaattttctcttccaagctcgatagaagcctgtctgatagcctcgaggaatggtgtggactcgatatcgccaactgttccgccgatctctgtgataactatatctgtgtcagttgatttgcctaccctgtaaagacgatcctttatctcgttggtgatatgaggaacgacctgaactgtgccgccaagataatctcctcttctctccttattaagaactgtccagtatatcttacctgtggtaacatttgaattgatagaaagattttcgtcgataaatctctcatagtgaccaagatcaaggtcagtttccgcaccatcgtcagttacgaaaacctcaccatgctgataaggtgacattgtgcctggatcgacatttatatacgggtcaaatttctgaatggtaacgctgtagccccttgcttttaacaatcttcccagtgacgcagcggttatgccctttccaagacctgatactacaccgcctgttacaaagacatattttgtaggcatatcatttctcctccatatatcaaaaataaaacacaaaaaaatcaggtgagatcatgtggacacaactcaccttttcgctcttactaatatcataacaaatttttatacaaaaggcaagtgttttttctatttttctctgaattttttataaattatcaaatagctgaaataatctcttgtaaaattgttgtaaattaaagcggttttatttgattttataaaaattgatgtaattttaaagtcaaattcgtacgaaatttatgttgtaatttgaggtaaaatagtatatactattattgtattatgcttaaacgagctatagacttccggcttgctgactttaatcggaaacgaggtttattttatggacaacgacaacaagaacacctccaacactcagggagataaggatttacagtcgctaatatccaatgcaatagaaaatagaaagatacttgatgcttcaaactcaaacggacctacgggggtcatacctatcccctcaaaggaacagcagaaagctgacccgatacatgagtctgatccaaagcaggataagacgccaaaaaagaaaaaaggctggagcaagaagaaaaagacgggtattgttcttggaataatatttgtagcattcattattataattgccattatcgtaggtttgtttttccactacacaggaatgcttgacagaactaaagacactaagataaattcaggcagagcgcctataaattccagcgagcttacaagtgaggcggatacatttgacgcaaaggaaaaagaggacgagcttaaggctcagctacaaaagcagtcctccaagatatccagcgaggacgtaacaaacattctgctcattggcgaggatatccgtgatacagaagaggagagccgtggaaatactgatgttatgatgataatttccataaacaccaagaacaagactattacaatgacctcccttatgcgtgatatgtacatttacatggcgcagtttgacgagggcaacaggctcaacagcgcttactggcatggtggctgtgagtatcttgaacagtgtattgaggattatttcggtatccagatagacagatacgcaagagtgaatttctactcgtttatagatatagttgagactgtaggtggtatcgacatggaagtgtcaaaggctgaagccgagggcatgaagaagccgatggctgaacagaacaaataccttaaaaataagaaaggcactgactatataagcgacgacatatttgcgggcaagagtgatgaggataaggtaaagcttcatcttaacggaaatcaggcacttgcgtttgcaaggcttagatatgtaggaaattccgactatgagcgtacggaacgtcaaagacgtgttatctcagagatcataaccgaatccaagaagctcagtcttgttcagcttgacaagcttctgaacaaagtccttcctgagataaatacagaccttactgatggtgagatcgcaaatctgctcctcaatgcttttgactatatgaaatatgatatccagcagcttagaatacctgctgacggctatttcacaaacgaagtcatctatagcatggacgtgcttaatccggactttgccgcaaactctgcattcattcaatatatagtttacggcagttgtaaaaacattgacgaagctatcaagcagtatcaggaagaaaatgcttacaactacagctatgacactgggtattacggctactaactgaataattgatatccgctttcctttggggaaggcggatatttttttgctttctgcaaaaaatataaaaaatggttgacaaatacccataaggggtatataatatatatgcagcaaaagataccccgtatgggtatttgatatagtaaggaggcaaaaaacatggacaacagaaatgataaagaactgtcatgcggatgctgtgatacttgcaggcacaagcacactcctcgtgatgataaggaaataaaacagctaaagaataggctaagcagagtttcgggacaaataaacggcattatcaaaatgcttgacgataaccgctactgcggagatatactcattcaggttgcagcggttgaaagtgcaatgcaaagcttcggctatcttattttgcaggaacatatgaagacctgtatgacagaggagatacaaagtggcaacactgaagttgtcgatgaagtattagagcttatgaaaaagcttaaatagaaaggcaaatatctatgaaaaagttaaaattcaatgtaactggcatgagttgtgcggcgtgtcaggctcatgtggaaaaggccgtgagtaaagtaaatggcgtaatggacgtaaacgtgaacttgcttgcaaacaaaatgacggtggatcttgacgagggcgtaactaacgctcaggcggtcataaatgctgttgaaagtgcaggatatggagcaaacgagataggcgacaaagaaaacaaaactgcatcacctgttgcggcggctcaggacgaaagtaaaaagatgaagaaacgcctatggtggtcggtgggatttttgataccgctgttctatatttgcatgggacacatggcgaacatacctatcccccctatttttgcagggcacaaaaacatgatgatatatgcactcactcagcttttgctcacagtgcctatcattgcaataaactttcactatttttcaaacggcttcaaaaatcttatccaccgctcccctaacatggacagccttatagctcttggtgcggcggcttcattcatatacagtgtttacggcacttacagaatggcttactttatgggcaggggcgaccttggctcggcacatgagtatatgatgaatctatattatgagtcatgcggcatgatactcacacttatcactgtgggaaaatatcttgaggctcgctcaaaagacaagacggctaatgctgtgaataagctcgtgagccttgcgcctaagacggcagttgttatccgtgacagcgaggagatggaagttcctgcggagaacgtaatggtgggagatgtattcctgctcaaagctggctggtctgtgccatgtgacggagttcttattgatggaaactgcacggttgaccaatctgcactcacaggcgagagcatacctgtagacaaggcagtgggtgacagagttatgagtgcaagcgtatcggctggcggttttgctaaggtaaggtgtgagaagcaagctaaagactcaacactttcacagataatcgcactcgttgaggacgcttccgcttcaaaagcgcctgtagcaaggcttgcagacaagataagcgctgtgttcgtgcctatagttataacgatagctcttatttcactggtagtatggctgctacttggctatagcttcgcatttgctcttaacatggcaatatcagtgcttgttatatcctgcccatgctcattggggcttgcaacgccaactgcaataatggtaggaacaggtaaagcggcacagttcggtatcctaataaaatccgctgaaagccttgaaactgctcacagcattgacactgttgttcttgacaaaacaggaacttgcacagaaggcaagcctgagcttatttcagcgcaagcgtttggtgattttgatgtttcagagcttaaaaagctttgtggctcggcagaaagcggttcatcacacccacttgcaaaggctgttacaggccactgcaagacaaatggcattgaactctcccgtgctgaaagctacacagaaacagcaggcggtggtatatcggctgttgttgagggcagaaacgttcttatcggtaacaagcggcttatggataacagcggagttgacatatcaatggttgaggagacggctcatgctcacgctgacaatggtgagataccactttatgtagcgatcgacaacaagcttgcaggcattctgttcattgcagacaagataaaagagacaagtgcagaggctatagagggcttcaaaaaggcaggcattgaaactgtaatgctcacaggggacaacgagaaaacagctagagcaatacagaaaaagcttggcatttcacaggtaagatcacagcttatgcctgaggacaaggctacaataatcaaagaattgcaggagcagggcaaaaaggtagccatgataggcgacggaataaatgacgcacctgcccttacaacggcagatgttggaatagctatcggtgcaggacaggatattgctatcgagtcggctgatatcgtgctaatgaaaagcgatctgaatgatgctgttacggctgtcaagctcagtaggagcgttatgaagaacatcaaggaaaaccttttctgggcgcttatttacaactcgcttggtattccgctggcggcaggagtattctacggcttgcttggctggaagctcaatcctatgttcggtgcagcggcaatgagtttaagctcagtttgcgttgtgaccaatgcgttaaggctcaatctttttaaaagtgtcagagaaaacaaagccgcaaaggctgaaataaatactaaaacggaggacggaaaaatgaaaaaggtaatgaagatcgacggcatgatgtgttcacactgcacaggcacagtaacgaaggtgcttaatgcgatagacggcgttacagcagatgtttcccttgaggacaagtgcgcttacatcacacttgacaaggacgtggctgacgaggtgctttctaaggcggtgacggacgctgggtataaggtaaaggggataaaataacgcagatattttatctcacgcatagtaattgcgtatatgtaaaaacggtggagagtgtttgtcattctccaccgttttattatttacgctattccgttttgtcatcggttttttctaccgtatcctcctgaattatcggcatttcgactatcgccttgaacatatctccgtctatttcgatattgaagataccaccgcaggcttccgtgaagctctttgatatggataatcccaaaccgcttccaccgtctgttcgtgacttatcccctcgcacaaatctttcaagtatctcttcttccgtgaagtttatcggcgttgccgaaatgttcttctcggcaaatactattctgtccgcttttttgtacacatcaaggaatatccttgtgccgtccatagagtaattcagagcgttgtcaacaatgttttggaacactctgtaaagcttgtcgccgtcgcccattaccattgcgctgtcggcatttatgtttatctttactatcttgccactgtcagctatcttgtcctctgcgtctgcgatgcactgatttaacagcatcacaaaatcaagctttgttaggtttacatcaacgccgcttgtggcttttgctatgctgaaaacgtcagacacaatgcctttgagcttctgcgcctttttatcaagtatcttcacatagctcgaagcttcatcgtcaagatccattttcttaagcaggtcgatatagctgataatggaagtcagcggtgttttcaggtcgtgtgaaacgtttgtcacaagctctattttcaaacgctcagactgtatctgctgctccaccgactctctcaccttatcctgaactgagttgagtttttcagattcagcatacaccggcgaagtttttcttatcttgccctcataaggcttttcttctccaaggctgtctatctgtttgctgagctttgaaagctgtgagaagtcacgaatatctaacaccatcagtatcaaagccacaacaagcaagaacggctcaacatctgcactggaataataagcggattccaaaaacagtataacgcctatggctatcgttcttatggatagtttcactccaagcggaagtccatgaaaatagtgatacagtgatgtttccttgtacttgggccataggaacttacatgatctgcaaataaggctttctttgaatatgcttcttgtctttatcttgccaacaaactccataagcgagccgaagcctgcaaaatatgccaatgcaaacaatgctacagcaaggatatttctgaaaacggaattagccaaagcattatcaaaaatattttttgtaatgctcacataataattccagcaggcgccaaatacaaaagcaaatgtgatagccaataccattaggataaggtaaacttccgtaggcactttttttagaaaattgccttgcttccaacgttcaacgctctcaggctctgcattatatgcacagatcaggagcagatagcacacaagcataaattcaataacgccaaaaacgatcacaaaaagctttgcacgatacatatcattcaaagcctcggtgtattccttttccatggccgtaagcttttcagctttcggcgcaaagaataccgttatacctgaatcgtcattgtctgtcgctttgtaatcaggcaggtcatagaggttttcacattttgcccatgtgtttccgtaatcgtcctcataataatatatgccgttgtcatagtcatagtattcattgccgtcataagtgtcataatcgtcaccaatttcttcatcttcaagcctgtcggaatatttcagaccgtttttcaaatcaagacctttaataacattatatcttgagtctacattatagaaagctattggatcataattgccgtaattgtaaaaatatctgccgtagttatcataataacttcctcctacgggcacaagattgtcggcataaaactcttctgtcacgttatcctgatactccgctgtattgtaatagtagtcaactatctgtcctgatgaagttctgtcgctcattacctcgttatcacggcggagtatatagtttttgtgcgacgatttaaaagcttttatcttatccgtttcactgtcataattttctatatcttttatatttgacagatatcttgtttcgccattttgagtaatccccacatagtaatcaaactgactgtctacaagccgtataccgtcttctgtctttttgtatttatagcggttgtaatcaagataattcagatagtcattgagcaggtgtctagactgagtgtaattccgatcctcatcaacatatctgagataagccgaagctgtaacgcacagttcctcatacatttcattggaagccaacttatagctttctgatttaagataagacttactgctgctgtcagcatggctgttagcataaagcaccaaagacaagcaaaaaccgcctgcaataacgcaggcaagcacaaatgctataattctcatctttttagctgagaatatcttaaaccattctgcctgctcaaattttctcgattttgtagccaattccccacaccaccttcaagtatttcggctctctagggtttatttctattttctctctgatgtgacgaatatgtaccattaccgtgttttcaacggcatatgcgtcctcgttccatacctttgaatagatctcctcggcagaaaatatcctgcctgcgtttttcataagaagctcaagaattttaagctccgtggcggtgagcttgacaggttctccgtcaacctttaagctttttgccttagtgtcaagctccagaccgcctatttctataatatccgttttgtttgccgtgtcgatagcgccaagctgcatatatcttctcaggttgcttcttacccttgccacaagctccatagggttataaggctttgttatgtaatcgtcagcgcccattgaaagcccaagcaccttatctgtatcctcagatttagcggaaagcacaagtatagggatattctctgttgcccttattttcatcattgtagaaagtccgtccagcttaggcatcatgacgtcaatgagtataagctgtatgctgttctcagtgagcttctccaaagcctcaagaccgtcataggcctttattaccttatagccctccatttcaagcagttttgcgatagctcccactatatctttatcatcatctacaacaaggattacaggctcctttatctccatatcggcacgatcctttcttttacgtttattattataagccacattctttaaaaacagctcaacataattcttaattaaatcttaatgtactctctgattatatcacattttttctgacattacaacaaaaaaagacgggcgaaataaattccgtccgtctttatatggcaagttatattacttattcttttccaaatatgcgtgatactgctcgttgagagttttaagttctgaatcaaccgtacccttatactgctctttgagctgtgtccacgtatactgtgagccattctcatctgtcttcataactgaagtatacagataaggaataacagcttccttagtatcatttgttgcagcgtcattatctgacagagttgtggagatgccataaccagggtcaaatatcttagtgaacttgtctgtaacaaggtcaacgtaagctacgttatacatatcttctgtccagttaggattgtttacaaagaacttctccttctcgatatccttatatgtatcctgagtataaactatctttgcacactcgagccagcacttcatagcgtcattctttgtcgaaccctttacccacatatacgcattcatgtcgatagttgtataaagcttatcagagttaggatcctttggcattggaactacgccccaattgtcgccgtcctttggtgaatgtgtaccggtagaagcccatggacccattgcatagaagaggatattcttcttgaatgcgtcgcctgcctgtcctacccaatcaggatagtacataccattctttgcaatatcataaagcatatcagatgctcttacaaagtcagcgtcattaagatttgaaacatactcgtccttatcagcgtcatatgtgataagagtcttgcctgttgactggaagataaatggtgcgaaccaaccgtttatgccgtatctctcctcgtcagcagcagcgccctcaacatattctgacatcatgtcataccatgcgttccaatcccactcgccgttctgataaagctcatatggatcatcaagaccagcagcgtctatcatagacttatcatatgtgataacagaacctggcaggaagttgataggtgcaacaaagtgcttgccgttgagagtgaactgctctgcaacgtccttgacatcgctccacatagcactgtcgaaatcaacgatatcatcaacaggctggaacatttccttgatacagtttgcagggaatgtcatagactgctcataccagaacatatccggtggattgttagacataagtcttgctgcgagcttatcatacttgttcattgatgatgtctgagaatacttgatcttaccgcccttttcctcaaaaagagtaaggtcggttctcttttccggctctttcttagttgggtttatgtcaaaataagaaagccactccaactccttttccgaaccatcagggatagtagcaatatcgtcggtgcttgctacctttaccttatcaacataagagctgcttgaatcgccgcctgatgagctgccgcatgaagctacgctcactgctgacaagagagccattgcaccggcaataacacgcttggaatttttcattatacataacctccgtaacagatcgttttcattagaaaacgtatccttgattcttacaaagctattatatcactgaatgtaatcgttgttaacaaagttacaaccactgttgcattcttttaaatacttttggtgatttcaacaaataaccattcatttttttggtgattaagcctacagcataaaaaaaagcggaaacaacattcagccgtttccgcttcatataaaatacgatatctacgctcttaccagcttattgattcgttttgctctggaatacttcgccacataacgccttgtatccttactgataacaccgctgagagcaagcaacgctataaggtttggcaatgccataagaccattgaagatatcagcgatcgtccaaacggcagaaaccgtcatatatggtccgataaatacagcgaggatatagagatatctgtagaccatgaccaccttcatgttgctgttaaaaagatattccatacacctttcaccgtaatagttccagccaaggatagttgtgaaagcaaagaacacaagacaaaccataagaataaatgcaggtatcattgacggcaggaacgagaagccgttctggaaagcatgatttgtgacctcaacgccctcaaaaggcttgcctgttactgggttgatagcctcgtagcttcccatcattacgatagcaagacctgtcatagtacatacaacgatagtgtcgataaatgtgccgcacatagaaacaagaccttgtcttaccggctcttttgtctgagcggctgcggctgcgataggtgccgaaccaagacctgactcatttgagaaaattcctctggcaacacccttttgtatagcaatgaacattgtaggaagagatccgcctgcgacagccttgaagctgaatgcctgttcaaaaataagggcaacagcgtgagggagcctctgaatgtttataacaataagtgaaagacaagcaactatataaacgaccgccataaaaggcacaactacctgagaaacacttgagatcctctttatgcctccgataataacaagtgcggcaaaaatagttatcaaaagtccagagattataacagcccatgtatagtcagtaccaaaaatattcactgtatgttcctttttaggatcaaagaaagcctgaactgccgatgagataccattcacctgagagaaagtaccgataccaaaaagaccaacgcaagcgccaaagaacgcaaatacctttgcaagccacttccacttcttacccatgccgtattctatgtaatagaatggtccgccgcaaacgtgtccgtcagcgtccatacgtcggtatttgatagcaagaaagccctcggaaaattttgttgccataccaaggagagcagctatccacatccagaggagcgctccaggtccgcctgaaagcacaccaatggctgttgcaacaccgacgatatttcccgtacctatggttgctgaaagtgcggtgcatagtgctgcaaagctcgatatctcgcctttgccaccattttcgttctgaaacataaatttcaaagcctttggcaggtggaatatctgaagaagccttagcctaaaggtgaggaatattcccacagccataatgagtacgataagcggtatgccccagacatagccatctatcgtttcaagtatttttgtaaatttctccatgccctaaaaaatcctttcttacagaaaataggcagtttttacggaaaaactgccttatttctcccctatctatttttacgaaagtaattagtcgcctgtggactctcttagaattatcctgtggtcaacagtataataatgattatccttagtagtcttattcatgttctcaataagctttgccacaacaagctcgcccatttttgagcaaggctgttcaaccgttgaaagtgtagggattatccactcacacatggatatattgtcaaatcccattatggcgacatctttgcccacatcaatgtccatatctattgccttgtgcattgcagagatagcaagcaagtctgacacagcgaaaatcgccgtaggcttctcagcaagtgcattgaaatattcaaacgctctgcctccgcagtcatagtcataggactctttatagatatattcattctttatctctatgccatattcttttaatgctcttatatagccgttctctcttgcagtggaggagatagccgaagagttcgttccgataaagcctatccttttatgaccctttttaataagagcagcgacagcgtcaaacgcagcctgttcatcgtcaacagcgacagtaagcacatttgcgcccttcacgccctcacagcacagagcaacgttataattctctgcgagcttattaagtgaatctgcgtcatactgagtgccaagaaggataacgccgtcaacagttctgttaaaaagcatattcatctgccttgtttcagcggtcgaggttgaataggaaactgcagttatgatatcgtaaccaacttgtcctgcataatcctgcatacccatgactatctttgaataaagggaatgttcagaggtcggcataattacaagaataacattcgtttcgcactttctaagatttcttcccagaaaattcggagaatagttgagccttgcaatagtttcattgactttttttgttgactcatctgatacgttacagcttccgttgagaacccttgacactgtcgccactgaaacaccggcttccttggcaacatcttttattgtaatgctcatagatcttatcctttctgcgacagcataccgctgaaatagtcataccattatcaattataacatattttgaacaattctccaatatacattcctaacaaaattgtaaacgttttttaggttaatttaattaagaagcagactaaatgcttgaaaaaggaacagtgatatgctataatatcataaacgaatgatttttgaaaggaaaatatgcaatgctccatggttattttgatatacccacatttcactattttgaagaaaaaaacacctggtctggcagcaattacaccaatttcagctaccgcatagaccctgttctcggcgatgaaaaagagctttatgtcagagtatggtacggcacaaagtgcgtcacggaggtaacagactttgtggcagaatatcacgaagaatactctgaaaagggtcttgaaaacgttctggcagacctgacgaaagaatttgagaaattcaaactcatcagaaaagagctttgacaacaaaaatgcgaacacggtttctctgcattagcagaaacgaactgtgttcgcttttattttttgttatcaataccactcgttttcctgagtattgtaaacgtcagcagaagagtccgtctgcatcggctgtgtcatagcgtcaaccgcagaagaagaatccttattgttcacaggcttctcaggtgagataagctgttcagacataagtcttttgccactttcatcaacaagaccaacatcaatagctgtctgaactataccatcagcaatagcttgtccatactcggtaaggtgttcgtcaaaaagcttattgtcgatatcctcggttataaatccaagctccacaagacagcttggcataacagtgtcggcatttatgtagtagtttacaccgaaattgccaacgtagccatactgtactcctctattttcagatatacctaccttttcaagatcatcaagtatattctgtgcaagctttgtgtcatattcaggctcagaattgttcacccaaacctcaacgcccgaaatatcaccgtcatagctgtttcggtgaagtgaaacatacatatcagccttggcgttatttgcctttgcacatctttcgtcaagctcaaggaaagagtcatcatctcttatcatcaccacattgacaccgtatttttcaagatatttctgcacctcaagtgcgacctttaagttatcgtctttttcatatctttttcctgaggcgtcagttgtgccgccgtcataatcaccgtgacctgcgtcaacacacactgtaaagtccatatttgaatacttcgcaggctcgtcttttttatcttcagcagaagaagcgtcctccttcacagcgacagaagatgtattattcaataccttgtttgttttttgcgtatcgtctcctttgatctttgatactaccaaggctgtcagctttaccagaccagtcacaatgccgataagtattatcaatgcaataataattctgttccagtatatttttttctttttcacccttctgacaggctttcgtccgtagatctgttcaaactcctcatctgaaagtgtattcattagatcaaagctcctgtaaaaaatttatccattttaattataccacacgctcaacgttatttcaagactgtttgttaccacattgtaagaatttcgttacttttaacgattttgcatatcacaaggctattaatatacgctatctgcacaataaaaaagggcaagcaaagactgacacacagcctttgcttaccccattaagctctttttttattccaccaatgttctctcgtcacaatattcgcaaacaagcgttgtgccatcgcctttgaaccaatgtggaagatacttttcgtggtgagtgatacagttaggatttgaacaatcaatgtgcttatgcactctgcccttcataagcggctgcgaagcaccatcgccgtttataactgtaagtatgagtgccattctgatatacataccgtattttgcctgcttgaaatacattgctctcgggtcgtcgtccacctcgatagctatctcatcgactcttggcagagggtgaagcacgataaggtcaggctttcccattgaaagctttcttgtatcgagtatgtaatttccgctctgagactgatactcctcctcagaagcaaaacgctctttctgtattcttgtcatatatagcacgtcaagctcaccgataacctcttcaaggtcggtaacttctttgtactccatgcctgccgcttcaaggatatcctttacatacacaggcaaagcaagctcagaagttgaaactaatatgaacttattgtttggaaaacataccattgctttaataagtgaatggactgttctgccgtttttaaggtcaccgcagaagcctatggtcaggttatcaagtctgcccttttcttctctaagtgtaagcagatctgtaagcgtctgtgttgggtggaggtgtccaccgtcgcctgcgttgataacagggcaatcagcagtgagtgccgcagcctttaccgaaccagcggtagggtgacgcattaccatgatatcggcatagccggaaactatctttgtggtatccttgatattctctccctttgcaacggaagaagtggcaggattgtcaaagcctattatcgttcccccaagacgtagcatagcggtctggaaagacatctgcgttcttgttgacggctcatagaaaagagtacccattatcttgcccttgcaagcctcgctgtaggcggcaggatcctgaactatcttatgaccgaggtcaagaagtttcagccaccaagatacgggatagtcattaagatcaataagatcaagtctgtttttttgctcactcacatcaaacaccctctcaaatattcagacatacattatgccgcacattccttgtacggcattttctttattatatcacatctgttccattttttcaagtacatagcccatattatttaagcaggtcaaaatttgtttcatctgcaaactggtcgcagtcatacataaataatatctggtcatatgcactcgtatctgccacgtcagaaagggtcttgccctcctctttgagcttgtcagggtctaccaaggttatctcgctgtagtgtggggtaagaaacggcacaagggtattggcatagcttcctttgatgataagaagctttggtgcgtcctctgcagttgtcttgaccgttgccttagtaaagttgtcaccttgcaggaagatagccgttttatctgctgttttcagtgcagatctaaaataaacagattttgaggtaagcacctgacctcctctgtaaagctccacagaatccacagtagtcttatacttagaacggaagatgttcactctgtctgcgcctatgctgttatagcaaagttcactgtaaagtcccccataataagaatttgaggtatattcttgatcgtaattggacagaacgaccggctcaaaacccagctcttttatgccgtctgcataggcaaaatacgccccgaaggaagtccactttctatctgtacgatagtaaacgtaattatttcttgcagaatacataggaaaaaacgtatctatggtgtctatcctgctgtctaggtcataatagatattatctatcatttcacgctggtctgtgtttgaagtataagcaggcagcttagcagaatagatacctgcggcagtcggagctaacataacatatacaggtgtatctgtgttttctgaaaattcatttatctgcgagatgtttttatcaagcctgtccttatcaaaatctgtgatctctacaagacgatttttaaggatatagatattatcaaaatttttcttaccagtcatcacaaacatggtcgttctgagcgacttccaatttgagcttagaggaaaattactgctaacataggtctgaacgttatgtcttatatctgaactgtctgccttttcactttcagatccatgtctgcccatcacgagagtatatgccgcaaacattatgactattacaaaaaatgcgcttactgcgatataatcagcagcctttttcattaatgttcactcctcccattttatctcacgaacaaattcatagacgaattacctccgcccacaagaaacgctgtactgataagcagaaatcctatagtgagcattggctcgattatgtaaactatattagtattgagctgcattatcctgcgtttgagatatctgccgatacctgttgcaaaaaagccgcagataagatacatcacaactcctgtttttatcacatacgatgcaagaacatctcctgcaaagcttcccccgccgagcattgcggcaacatatccgcaggctgaaggcaggctgtctatcgcaagaaacggcagacctataagaaacagaacattcatcaccgcacatcttacccctgtcggcacagccgcaagaatgtttttcaagagatattctatgccaagcataacacaaataaacgctgcccacagcattgtgtgtctgccgtagccataccaaaccgagcctgcaagcacagacagtatcaatgcccaaaggcaaacgctgtctttatttctacatataggtctgtagaaataatctctcacccaactataaaaggtgcaggcaaatcgttttataagctcattgaagcctgctgacataaacggcagatcaaagttatcaggaagtttaaagccgagcattgaaccaataccctgtgcaatatgcgaataagctctaagctcatagtagaacgcaaatgagaaagctattatcccaagccatgcacaagcggcggagagcgaatctgtacttactccccttatgtgctgccacatctcgtacataggatccgacagaaaaagcttctccgcaaagcctataagcataagctttatgccctctgcaagctttccagaggttatgacaggttttctaagctgttcgcttatatccgaaaatctgagtatcggtccacagtaaaagcatgggaaaaagcatatatattgagataccaaaagaaaattcttctcaggctctatttcttccctataaatatccatgcagtaggaaatgccatggagagtgaaaacgcccgctccccacacagggaaaagctttagcattgcgcctttgcctgtgaatatagacgtcacgtcatagctgctgtgaccgcttcttatgaataaaagaagcactgccatatttgctaccaccgataatatgagccatagccttttaagtccttttttgtctgcaaagcggtggataagcctgccgcaaaagtatgatacaacagcacacaccgccattggtattatcccccatgtggacacccacagacacagcacaactgttccaagcaggaacacggcttttctgaaacgcacccctgacaaagtgtatactcccataaaaacaggaagaaagaaatatataaattcaagactaaccaacgctattctccttgtctttattgttttctgaggtcaaattctctatgagtgcttgcaagctgtctttatcgagcattgtgttcaccacttcaagcagtgcgtttgcagtgagctttttgggcagcgacagcttttcgcacacaagctgtctgagcctgctgctgtcaggtctgccgcttagacctagctcataaaagtcaagcttggtcatgagttctctgtctgcgaccttttcgcctataatgcctgctttttcaaaggcttccctgataatatccgcaggaacgccctcgacccctaacaagccctcttttgacggctctgtcttgcgcttttctttgccgaatatctcaggaacatacacgttcacgatatcgcctttggggacgataccctttatatgccctcttatgcgaaagcctgctgtgtcagagtcagtaagaattgctactccgccatgctgagcatagtatcttataagtgctgccttgtcagggtctttatagatacgaaagccgttagtgacgattataacgccgtcaactatggacgaaagctttatcttatcatattttccctcaacgattattgcccttgatattttaagtttttccatttactaacaccttaacgccattgaccttgcaagcccctgctcaagggtgagcatatctccgtcttttccccgtgaccttgttttgagcataaggtcagtttcagaaagtatctcaagcgtttttcttatacgctccgccgagatatttccgcactcggaataggcgttttttactgcaaactctctgtttttcgcataggaaaaatctttagccacgtctgcaacgctcctgccagaggaacgtgcaagcttcgccctatagatatccgcaagggaaaagcctattattcctattatagcatatggttcataattctgcacatcgagttcacgcaaacgtgtgaagaccattgccgcattgcctctgaggatatttattgcaagagaatatccgtccgactctatacgcctgatacaaagcaagtcgatatcctctctcgttacctccctgccctctgcataagccgaaagcttttcaagctccttgctgataaatgcagtgtcgcacaaacagaggtttgcaagatactctgcgttgctttttgttatggtacagccgctttttgcaagataggtggatatagactttccaaggtcggaagcccttttgtattcaaagttgcagacagtgccgtgcttttcgcagaaatctgcaaagcgcttgtttttgtctgtaagatactttttgttcttgaaaaggtcaactcctgtggcatagattatcactgtggtggtttcgccaagagagcccaggatctttttcaggtcgtccaaatcgtccttagtcactgcgtctatattaaggtcgtttatagtcaccaccacacgttcagccataaaaggcagagcttcgcaagcgtctgtaagcattggaaaatcaagatttttgccgtcaagcttatgaaagttcatgacctgagcgtcagcagggcaaagcttgttcacaagcctttttgtaaagctttcaagtgccgctgtatcatgtccgtaaaaataataaaggctgtcgatatcattctctcttatcgttttaccaagagccgaagccgtaagcaaagccatagtccgtcctccttatctgcgaatttttcatatctatcatcaatgggtattcttcatctgttgtgtcaaggtttctgccgtttatggtgacagaacctttttctatagtgaccacacagccctcggtggtaattttatagccgtcctccagtgcttctatcttaacaccgttccaatcaagctgtgcgcctgtcatgaacggcagttcgctgtcattatcaggctcgccatttatataaaatctgtcaggttgtatagtcatctgctcgttatatttcgttatagtgtaatactgttcgctttctataaatgcgccttttagctcttttatgccgtaaagctccaaaaagctttccataccgctgttgagcttgcccttactgcccatatcgaaaaccataccttttgttttatcatacagcacagcctgcactgcatttccttttggcattacaactatctttaccgagcctccaaaagcaagagaaaaattatacaccgctgtccaacatacaagcattagagcagtgcaaaaagccccaagctttactgactttctcagaaacatgaccgccacaggtacaaggcaggtaacgagcattacaagaccaagtggtcttactccacgaggaagataggcaaagctgaattttgaaaacagctcagcaagaaacagaacgactttcagaagatactttaccaccgtcagcacaggataggctattattgccgcaccgcctgttaccgcagttattaccgtcagacccagagcaagggtacacacaggcaccagcaggatatttgatagtggtgcaacaagagatatctcactgaaaaacattagctgaacaggcattgtgcaaagaagtatcgtcaccgcatttactgcctgccgttcaaggctgtacaaaatgcctttgccctttacaagtgccgctgctttcgggcagaccgtgcctatcacaaatgttgcagtgaatgacagcagaaacgagctgtccgccgccgcatatggtgaaagagtgagtataacaacagcgcaaaggcagagagtatttgctgggtctggtctgcggtaaaggagcggtgcggcagtgaccaaggtcagcataacagccgccctcacaacggatactgaaaatcctgcaaagaccgcaaacgcccacattgccacagtttggacggcaaatatcacacgcttatccttgcttagtttctgcatgagccagcctatcatggcacttattatgaccacatgagttcccgacacggaaaatatatgacctatgccgctacgatagaccgtgagcttcgtttgctttgaaagctccgttttatctccgcagagcattgcagcggcaaaaccgccctcatctccgcctattatatcgtttatcaacatgaacatcttgtcacgatagtgcattatactgcgtaaaatggtgtttccactgcctgtgacttctatgttttcagcggtcgagccttggagaaaaacgcctttaggccggtcatactgttctgatttgaaattgatgctgtcttttatcctgctgacctttactgtcgccacgatattgtcatagtaatcatattcaatgtcatctgcataaaaggtcagcctgccttttactcccccaacggtaccattgacacttagtcgacaggtgtcagagcctatatagcttatgtcggttatctcgcctttaactgttacggtctttccgtctaaagctgtcagtttatcatagaaaatgtgagtataagcggtattgactcccaccgctatcaggaacgaaacaaagcagagagctatatgctttcggtatctcttaaaaagcgcaaaggctgtaatggctacacacgctgacgcaagtgcaaaaactgcgttgttccttccccagccaatggtacagagaaacagccctgcaaaatacgaaaagccgatataacagctttttctcaccattgccgccatcccccttaaaactaagggcggataagaaatttacccgcccgtttgatttctttaaccggctggccaagcaagtggtctgcctgcaagaagatgaaaatgaatgtggaaaacactctgtcctgcctgctcgccgcagttggaaacaactctgaaaccgtccttaaggtcgaggtctttggcaagctttgcgataacttcatagatatgtgcgataactgcactgttctcaggggttatctcgtcaagctttgaaatatgctgcttagggataacaagataatgaatcggagctgtgggagcaatgtcctcaaaaacgtatgtcagctcgtcctcgtatattttctttgaaggtatttccccggaaataattttacaaaaaagacaatcttccatttatctctccgcctttcaaaaaggggtaggctgcacagcattttgcacagcctttgcccatattattttacaaattcgccaactatttcgtttaccttgtcaagtgcctcgtcgatcttgaatctgtcgcctataccagccatagcagaatcaggacgtccgccgcccttaccgcctgtgagtgctgctaccttgcctgctatcttgcctgcgtgtgcaccctttgcaacagcattcttgccgcaaactacaacaaggtttgccttttcaccgtcaacgcctgcaacaactgcaactgcgtcagcttctcttgctttaagctcgtcgcccatttttctgagcatatcaggtcttgtgttggtgagcattgcagtgactaccttaacgccgttgacctcatacggattatcgaacagcgactttgttttgagatttgttatctcagcctgcaaagcgtctctttccttttcaagatccttgacttcctgcatgatagtgtggcatctctttacgatgtccagtggatttgcaagcttaaggctttcagccgcctgctggatagttgctgctctttcctcaacgagctccagaacgcctctgcctgttacggcttcgatacgtcttacgcctgaagctacagagctttcggagattatcttgaacagacctattcttgaagtattgtcaagatgtgtaccgccgcagaactcgatagaagctgtttcgtcaccgtcacccattgttacaactcttacagtttcgccgtatttctcaccgaacagagccatagcaccaagcttctgagcttctgcgataggcatttcttccatttttatatcaagagcttcaaggatatacttgtttacaagtgcttcgaccttgagcttctcctctgctgtcattgcgttgaagtgtgagaagtcaaatctaagtctgtgagcgtcaacgagctgacctgcctgatgaacgtgctcaccgagaacttttctcagtgcagcctgaagcagatgtgcacagctatggtttctcataacagcataacgtgtctttctgtcaacagtgaagtgagccttctgacctacagctatctcgccctcttcaacaaccgccttatgagcgaactttcctgcaacgaccttctgtgtgtcaacgactctgcacttaccgctttctgtagcgatagtaccgatatcgcccacctgtccgccgctctctgcatagaatggcgtctgtgaagatacgatatatacttcatcgccagcctttgcgttttcgataagctcatcatcagttgtgatgaatgatatctcgctgtcgccctcgagcttgtcatagccgatgaactctgtgtggaaatccttgtctatcttatggaaaacagtttcgtctgcacccatatactttgttgcagcgtgagcgttcttggctgtttctctctgctttgcatagcactcagcaaagccctcctcatcacaggtcatgcccttttcttcaaggatctctcttgtaaggtcgatagggaaaccgtatgtgtcggaaagcttgaagcaactctcaccgtcaagctccgtcttgccgtctttctgcatctgtgcgataagatcgtcaagtatcttcatacctctgtcgatagtggcattaaagttctgctcctcagttgtgagcacctttacgatatagtcatacttttcttcaagctcgttatactcacacttgttgcagtcaacaacagtttttacaaggtctttgaggaaaagtccgtttatgccgagaagctttccgtgacgaacggctcttctcagcaaacgtctcataacgtatcctctgccctcatttgacggcaaaattccgtctgatgccatgaatgttacagaacggatatggtctgtgataactctgatagaaacgtcctttttgtactccttgccgtactcacagcctgctatcttacaaacatgatctctgatagcctttactgtgtcaacgtcaaagatagagtcaacgtcctgcatgatagaagcaagcctttcaagacccatacctgtgtcgatatttttctgcttaagtggagtataagtgccgtcctcgtgtctttcaaactgtgtgaacacaaggttccagaactccatgtatctgtcgcagtcgcagccgaccttacaatcaggcttgccacagccatatttctctcctctgtcgaaatagatctctgaacatggaccgcaagggccgtctgttccagcctcccagaagttgtcttccttgcccattcttacgatatgatccattggaacgccagcgtcctcatgccatatcttttcagcctcgtcatcgtcctcataaacagagatataaagtctgtcctttggcagtttgagtacctgtgtaacatactcccaagcccatgaaatggcttccttcttgaagtaatcaccgaatgagaagttaccaagcatttcaaaatatgtgccatgtcttgctgtcttaccaacgttttcgatatcgcctgttctgatacacttctgacaagttgtcattcttgttctcggaggtgtttcctgacctgtgaagtaaggcttcagaggtgccatacctgcaacgataagcagcaggctgttatcgttctgaggtacgagagggtagctcttgtgtctcaaacaacccttgctctcaaaaaatttcagataagattcacgcagttcgttaagtcctgtccattccataaattcagatccttccaaatgaaattattcgcaaaataaaaaacggctcgtccctaaacatgggacgaaaccgacagttccgtgttaccacccaaattgccgaactcatcgcccgaccactcgaagccctttaacgcagagcatacgttgctgttttcagcaccgctcaggttagccaccgaacttgccgcaaaggctttcacccaccgccttttctctttaccgacactgtttcggataattccgtcaccgcattttgcatatattgatattataaagcataacccgacgattgtcaagcacttttttattaataaaatatccattgctaaaagcagagggaaatgctataatgttcagggtgatttatatgtatgtttgtccgatatgcaaaaaacggcttagaaagcttgacaacgtatggcactgtcagaacggtcacagctttgatattgcgagaaaaggatatgtaaatctgcttaccacaaagggcagaaaccctaagaacgcaggggataatgctgaaatggtaaaggcgagaacggatttccttgaccgtgactattatctgccgcttgcgaagaaaacggctgaggtaatgggcggtctgcttgaaaatgtgaaacagccttacattatagacagtggctgcggtgagggcttttacactgtgaactatgccaaggcactgccaaaggcgaagttttacggcattgacatatcaaaggcggcagttgcccactgcatgacgaggatacattgcgaaaatatcacaaattgcgaatttgcagtggcatcgtcatttcagcttccgtttatagacaaatttgcagaccttatcgtatgtacatttgcacctgtttcaaatgacgaatacgcaagggtactgaaagacggcggaaagcttgtggtagtttctccgtccccaagacatctgtttgagcttaaagaagtgctttatgagaagccttacgaaaacaagcccaatgtatatggacttaataaatttgacgagtcagaggagatgatttttgaatatcctgtggtgcttgaaagtcatgaggatattttcaatctttttacaatgactccgtattactacaaaacatctgccgaggcggtggagaagcttaaaaaggtgaacaggcttgagcttacctgtggcttttctatcaggacatttacgaaaaagagaggtttttgatacatgaataaagatattttctgcaaaggatatacttggggatttttctccaagagaggtgattttcagacggaagcggcagaaaagtcaatggaaaggcttgcttcaaacggcttgaactggatatgtatccctgtaaacgcattgcaggagagctttgcgagcacaagagttttcagtgattatgagagaacacaatctgacgaggacattgccttcgctataaaaaaagcaaagtcactgggacttaaagtctgcctgaaacctatggtggattgccttgaccattcatggcgtgcaaggatagacttcccgcctgagaaccctgaatattgggacaagtggttcaagtcatacacagctttcatgctccactatgcaaagcttgcagaaaagctcggctgtgaaatgctctgcacaggctgtgaaatggcaggaatggacaagcagtccgacagatgcagaaagcttatcgcacaggtgagagaggtctacagcggtatcgttatgcacaacatcaatcacggcgacgaacagcgtttcgattggctcagcgacgtggatatcattggcatctcaggctactaccctgttacaaacggtgtgaacagggacaagaaacatatgctcagtcgctggaacgaagttgtcggctcccttgaaaaggctcacaaacatttcaacaagcctataatgttcgctgagataggcgtgcgaaacgaggagggctgcacgcagtacccttgggatttccatgacaggctcgacaagccacttgacgagcaggagcaggctgatttctatgacacagccatggaggctacatgggatcttgactggttctgcggctatttctggtgggattggaaagctatcctgccgccaatagaaaaagccaaagagaaccgtgacttcacagtttacggcaagcttggcgaagaagtgctgaaaaagtggtacacaaaagattgatatgtacaaaaatacggactgtttatcattggatagacagtccatttgtttttatatgcgttggtgaatgacgggcgaatgtaagcgtgtcaccgtcccctatatttacaatttttgcgtaggggcgacctgaggtcgccagttaattatatttttacatactgagcagtacaaataatcgtactcttatccaaccgccgcagatattttttcttttcctcgtttaacaatgacagggtattccttgaaaatatgtctgcgtataaaattatccgcaagcacaccaatataggataacccaaaccacacaaaagcaaatggcaggcatatctgtccgtcaaaattcagcggcacttcctcatagctccatatgcccatgccgagatagcggttgagatactcccctgcaagaaattctatggcagtgataaatgctgccgacactgcaagcacagacagcaggctaactcctcgcctgcgctcgccattcatgatatggataaccagcattgaagttcccccaagcacccccattgtgatatgagaatatcccctgttaagtatttccatgaaaccatagcatattgcgcccactgaaaaaagcgtaagtatcttatacatctttgccgccacattctcaccgccctgtttttttatcgccctaatattaaaatgtacagaaatcagtgatttaaaaccttgaatacaaaataaatttatggcaatttcaagatacaaaaaaacgggcagcccaagctgtccgttttattgtactaatatgatattttatacctgccagctgttaagatatttctcctgctcaggtgtaagcttatctatctcaagctcccagaatttaagctttctgtttgcaacttccttgtctatctcatcaggaacataaactatcttgtctgtaagcttgtctttgtttttaacaagataagccgcagaaagggcttggatagcaaaggacatatccattatctcggcagggtgaccgtcgcctgccgcaaggtttacaagtctgccctcgccgataacatacaaccaattaccgtttggaagcttataaccgtcaatattgtttcttgcaagcttgctttcaacagacagctttttaagtccagccacgtctacctcgcaatcaaagtgacctgcgttacagagtattgcaccatctttcatgttcatgaaagctttctcagtaataacgtccttacagcctgttacagtgacaaagaagtcgcccaccttagcggcgtcaaccattttcattaccttgaagccgtccataacagcctccatagcctttattgggtcgacttcgcagacgataacgcttgcaccaagaccctttgctctcattgcaacgcccttgccacaccagccgtagcctgcaacaacaacgttcttgcctgcaacgataaggttagttgttctgtttattccgtcccatacagactgacctgtgccgtatctgttatcaaaaagatacttgcactttgcattgtttacaagcatcatagggaatttgagctgaccgtccttgttcattgcaataagacggataatgcccgtagtagtttcctcacaaccaccgataacgttcggtatcagctcagggtattcattgtggataaggtttacaaggtcgccgccgtcatctataataatgtttggacctaccttaactacctcggatatatgtctgtgatactcctcgtcagttgcaccatgccatgcaaaaacgttcagaccgtcatgcacaagacctgccgcaacatcgtcctgagtagacagcggattgcttcctgtgatgtacatttcagcaccgcctgctgcaaggactttgcaaagataagcggtcttagcttcaaggtggatagaaagtgcaactttcagccccttaaaaggctgatctctcttgaaatcttcctcgacgcttctgagcaatgacatattctgtcttacccattctatctttcttttaccgctttcccacaagctttcatctcttatttcgctcattttatcaattcctttcggtttattattcgatccatataataattataccctatttctccccatttggcaagaggtcaaaagcaattcattatacttcgcaaatttacagcacgttcataaaattaaattaaacaatttcttgacaaaaaaacaaggtaagcgtataataatattatgtgtgcgaatagtaaaaacgtgcataaatcatgatttttaaggagtgtgtacaaatggacgacgccagtcagaatacgatcgcccctcgattgcagagcggctcgcccgtttgtggcagcctttttgtgatctaaatatcaattttaattgaataggacgatctgtgttttggtagatccttatatttgtacagagttggtataagtacaattatttgtactgttgtgcttattaccgctgctgttagggggaatataatgtttaacacagtattggagttgctcaaaagcagaaactacaaggctatccgtgaaatattcatggatatgaacgaagccgatgtggctgctcttttgcaacagttttatgacgatcacgaggtcgagaaatacgagcttccgttgctgttccgtcttttgaacaaggacgttgcggctgacgttttcgcttatatggacagcgatacacaaatgatgcttatcaatgcctttacggataaggagcttcaggagatcgttgacgacctttatcttgatgatacggtagatattatcgaggaaatgcctgcaaatgttgttgcaaggataatcaagtctgctgacgctgaaacgagaaagcagataaatcagatactcaaatatcctaaagacagtgcaggctctattatgaccaccgagtacgtttatcttcacagaagctacaccgccaaggaagcactggattggataagacacgttggtatggtcaaggaaactgtaaatacactttatgtcactgagaacagaaagctcgtgggcgtgctttcactgcttgatatcgtaactgctgatgataacgataaaatagaggacataatggaggacaacgttatttccgttgatacccttgaggataaagagtatgttgcttccatgttctcaaaatatgactttctttctctgcctgttgttgacagagaaaaccgcatggtcggtatcgttacatttgacgacgctatggacgttatcgaggaggagaccactgaggacttctcgaaaatggctgccgttgcgccaagtgacgattcctatttcaagacctctgttttcactcatgcgaaaaacagaatagcatggcttttgatacttatgctgtcagctacccttacgggtgctatcgtaaacaaatatcagtctgcttttgcggctgtccctgttttggtatcgttcctgtcaatgcttagtggcacaggcggaaactgcggctctcagacctcgacccttgttataagaggcatggcgcttggtgagataagaatgaaagactttttcaaggtcatgtggaaagagttcagagtcgcgcttctttgcagcgttatccttgctatagtcaatgctataagaataattcttgtgtatcacggtgacacatctgtggattgctacaagcttgcgttcacggtgagtatggctatcatggcaactgttgtgctttcaaagctcatcgcctgtatgctcccaatggctgccaagaaacttcatcttgaccctgctatcatggctgccccgcttatcaccactatcgttgacacttgctcaacactgatattcttcacattggctactatcgtatttgatataaaatagaaaaaaatatggcggttatctcctttcaggctatcttctgcaaaggtgcggccgcccgttttatggataaaaataaattggattttgatttgaaaggaaatagttatggctcagaattatgacgtagttgttgtcggtgcaggtgcagccggcgtattcatggcatacgaatttgtcaagcttgacaaaaacataaaagtttgcattatcgatcagggcggacctgtcagcaagcgtaagtgtcctatagatggcaaaaaagttaagtcctgcattcactgcaaggtatgctccattatgcacggcttcggcggtgcaggcggaatgtcggacggcaaatataacatcacaaacaatttcggcggtgacctttacacatttaccggcaaggaaaaggctatcgagcttatgcagtatgttgacaagataaaccttgaaatgggcggtcaggacgctaagctttactccacaacttcttccgacatcaaggcaatggctctgaaatatgacctccacctccttgacgctcaggtaagacaccttggcactgacagaaatatgcagatactccagaacatctatgactttgtcaaggacaagatagacataaaattttatgaaagtgttcagggtataacaggcaaggagaatgacttcactgttatcacagacaaggacgagtatcactgctcaaacgctgttgttgcggcaggcagaagcggttcaaaatggatatctgagatatgcgacaactttggtatcaaaaggcgttcaaacagagttgatatcggcgttcgtgttgagatacctgcggctgtttttgagcatatcacaagcaaggtatacgaaagcaagatagtttaccgcacaaagaaatacggcgaccttgtaagaacattctgcatgaacccatacggtgaggtggttaccgagaatacaaacggcatcatcacagtaaacggacacagctatgctgaccctgcactgagaactgagaacacaaacttcgctctgctggtatccaacacattctctgagcctttcaaggactcaaacgcatacggtgagtctatcgcaaggctgtctaatatgcttggcggtggagtgcttgttcagcgtttcggtgaccttgttgcaggcagacgtacaaatgaacaccgctttggtcagacgttccttaaccctactctcaaagctactccgggcgacctgagccttgttatcccaaagcgacagcttgacgatattatcgaaatgatatacgctctggacaagatagctccgggtatggcgaatatagataccctgctctatggtgttgaggtcaagttctacaatttaagagttgacgttgacgagaaccttgaaactgctgtcaaaggtctttacgtccttggcgacggctcaggcgttacgcactctctgtcgcaagcttctgcatcaggagtatttgccgcaaggactatttcagaaaaattcaactgatctcatatatcacaaaagccgcactgcaaaaaaagcaatgcggctttatttttttatgccttactcttcaagaagctttatatatcccttaatgatatcaacgcacttgtcatagctcatgtcgctggtatcaagacacagattgtagtttttcgcatttgtccaatccctgcctgtgtagtgacgataataatcgcttctctccttgtctgtcttttcgattatcttgacagcctcttttacagaaacaccatacagattgacgatattcttgaccgcagtttccatatcagaatatatgaaaaccttaagcacgtcttttctgtcacggaggatatagtcagcacatctgccaactattaccgcaggctctctgtctgcaagctgctttattatcttcgcctgataattgaaaagatttctgtcagaagtaaagtcgtgatcatcagggtcaagaagctcacccttgtaaactccgccctttctcagaaaagaacctttcagtttttcatcaacaagcccgaaaaagcgttcatttatgccgctttcgtcgcttgcaagctttataagctccttatcataatattttatacccatatcctctgacagcatttttcctacagttcttccgccactgccgatgccccttgcaatggttatgatccttgccataaagctcaactcctattcacctaaatatgctttcttgaccgactcatcattgataagatcagacgccttgcctgacagaactatcttgcccgtttcaagaacataagctctgtctgagatagcaagggctttctttgcgttctgctcaacaagcagtacagttgtgccgctctttctgatatcctcgattatcttaaatatggttgacacaaggatcggtgacagacccattgacggctcgtccattacaactatcttaggtcttgacataagcgccctgcccattgccagcatctgctgctcaccgcctgaaagagtacctgctatctgattttttctttctgcaagtctagggaaacgctcgtatatatcctgaatatccttcggtatattctccttgtcttttcttgtaaatgctcctagcttaaggttatcaagcactgtgaggttttggaatattcttcttccctcaggaacgtgtgctatacccatttccacgatcttgtgtgcaggagtttttgtaagctccacgccgttgaatttgatagaacccgattttgcagagataagacctgtaagggtgtgcagagtggtggtctttcctgctccgtttgcgccgataagggaaatgacctcgccctcgtttacctcaaaggagatacctttcaaagcagctatcatgccataattgacgtgcagatcattgatttccaacattgccattttacttacccccttattcgcccagatatgcggtgataacttcaggatttttaagcacttccgctgtcttgccctcgcagaggagctgaccgaagttcagcactgacagcttttcgcagatacctgaaacaaggctcatatcatgctcgataagcagcaccgtcatatcaaaattatctcttacaaagcggatagtatccataagctccgctgtttcgtttggattcatgccggcagcaggctcgtcaagaagcagcaacttcggctgtgttgcaagggctcttgcgatctcaagctttctctgatcgccatacggaagtccagaagcaagcagactcgccttatcgtcaagctcgaaaaccttaagaagctccagcgcctttgcgtccattgccttttcaagcttgaaatatcttggaagtctgaaaacgcctgtaaaggtgctgtatttataatgattgtgaagtgcgaccttgacgttgtcaagcaccgtcatatccttaaaaagtctgatgttctggaatgtacgggcaatgcctgcacggtttatttcgatagtgtttttgccggtgatgttctttccgtcaagaacgattgtgccgtctgtcggcttataaacgcctgtgagcatattgaagatagtggtctttcctgctccgttcggcccaataagaccatagagctgacctttttctattgttatgctgaactcgtcaactgcacggagtccgccgaatgagatgccgagattttttacttcaagaagtgccatatcactcagcctcctttactttttcacgcttgaacaaagccttgaacttagcagtatttgcactgataaaagtctttgttttttcatttgaagttattatcatcattacgataaggacgatagaatagataagcattctgtagctgtttatgcttcttagcatttctggaagcaaaacaagcacgatagctgcgataacacttcctctgatactgcctataccgcccagaacaacgaataccaagataaggatagacaggttatagtcgaacttagaagcctggagcgtatagaagttatgagaataaagcgcacctgcacagcctgcaaggaatgcagtcaatgcaaaagtaataagcttatattttgtgatgttaagacctacagactcggctgcgataacattatctctgatagccattactgctctgcccgttcttgaatatacaaagttataggcaatgataagagtgataagcaacataacagcgccgataatgaatgtagaatcgttaggtgtgccgctgataccctgagggccgttcagtataagctttccgtcaggctcaaggttaaggtttgacagacttttgagagaaacgtgaacgcccttagaatcataaccaaggtaaagtgctgcgaaaacgttctttatgatctcaccgaacgcaagtgtaacgatagcgagatagtcacctttaagtctgagaacaggtattcctataagtatgccgaacactgcggcaattattccgcctataagtatagccaaaggaaatctgatccacacattttcaatagtttcagaagtaacgatagaaaatatcgcacttgtatatgcgccaacgcacataaagcctgcctgacccaagctaagctcgccaagtataccaactgtcaggttaagggatactgcaagtatagagtatacacacagaggaacaagaagtcctgtgagcatacttgagatatatccgccgctgctgagtatctgcattaccacaaaggcaactattaccattgcgtatgtgataaagctttttctggtctgcggcttaaaaaactttgtttttgcgctagccccttcttttttcacaaaaaaccaatcctttcagataaaacagaactgcaaagcaagtctgctcgaaaattttaagttgacttttataccttttcgcttatcttcttgccaaggatacctgtaggcttgatgataagcacaagtataagaacagcaaaaacgatagcgtcggcaagctgcggtgagatataggcacgtccaagtatctcgataactccgataaggataccgccgatcatagcgcccggtattgagccgataccgccaaataccgccgcaacgaacgctttgataccaggcattgcgcctgtggtgttctgaagcgtaggataagctgagcaaagcagtgcgcctgcaattgcggcaagacctgagccgatagcgaatgtaagagagatagtgcggttgatgtttacgcccatgagctgagctgcacctctgtcctcagatactgcaagcattgcacgtccgctcttggttttgttgatgaacaatgaaagaccaactacaatgagtatagatacgattattgcaactgatgtttctccggaaataactatctgtccgtcaaaaagcttgatgctcggcacgtttacaactgatgtaaagtttacaggcttttcaccgaatataagcagtgcgatgttctgcaaaaagtagctgacgcctatggcagtgataagcaccgcaagcgaagtagcttgtctgagcggcttatacgccaccttttcgatgactataccgagaagtgtgcaggcaataactgcaagaactatggaaagccaagagtttagtccccatgtggtcatgcaggtgaatataacatatccgcccaccataataacgtcgccgtgtgcgaagttaagcattttggcaataccgtatacaagcgtatagcccaaagctataactgcgtatatactgccgaggcttattccgttgatgaggttattaagaaaacccatatacaaacattccttccttttggaatagacaaaacacaagatgtaatcacatatattacatttgtccttgtcataaacacaatatacaataaattataacataaccccgtagtttttgcaacacattttaatgaaataaatcaaaaaaaaccgacaatttttcgcaattgccggttttttcatattaagcgtactctttgtacgcacttcatttcagctattactgagcagtagaagcggcaatgtcatcagctgtcagtgctgaataagcaccattcttgatgataacagccttagggtccttagatacggcaccgtcttcgccccacttcatgcctgtacctgtaagtccgtcatatgagaagtccttatcagagatagcctttttgagcttatcgcagatatcagaagcagacatatcggctgtgatgccttccttcttcatgagttctgcaagtaccattacgccgtcataagcgtctgcagcgaactggttaggtgtttcgccgttgtaagcgtccttatacttcttaacgaagtcctgagttgcctgatcctgagcgtcggcagcaaatggtgtaaggaacattacgccctcgcaaagtgaagtatcaaagttcttgatagaaagaagtccgtcaagaccgtcacaaccgaagaatgttgggttgtagttagctgacttgcactgtgtaaggataagtgaagcctgctgatagtagataggcaagaacacgaggtctgcgcctgcattcttagctgcgcttatctgagctgagaagtcagtcttgctgtcctttgtgaatgactgctctgcaacgatatcaagacccttagcctcagcctcggatttgaatgtgttgaagatacctgatgaataagcgtcagagctgtcgtaaattacagctatctttgtagcaagcttgttttctgcgatatagtcggcagagcctttaccctggttagggtcagtaaagcaaacctggaaacagttatcgttcttggtaacgtcctgagcagatgcagaaggtgtaagctggaagatgttatcctgctttgtcttttcaataactgcgaggcaagaacctgttgttactgttccgaccattacctgcataccattgtctttcagtgcgttataagcatttacagccttatcgcctgagtcagcctcatcgtcctcgaaaacgtatgagagctttgttccgtttattccgcctgcgtcatttacgtccttgacagcaagctcgatagcattcttaacagcaacgccgtactgtgcagcgtcacctgtgagcggaccgctgcagccgataacgatagtatcgctgttcttttttgcaccgtttccgcaacctgcaaagcaagaaactgcaagggcagccgaaactgttaatgcaagaattctcttgacatttttcataataatctctccttcgttcacatatgtcactgcatatgcttttttcaatagtattaatataacacgcagaagcccgatttgtcaatattaaatcttacaaatttaacgttatttaaactatgtttattgttacaaacaatatgcgcgttcacagaaaattaattttgtgtattttcaatgaacgatttgcaagttttttgataatatcctgcatacatacaccactgacttataagctgcatatgataaaacagccacacgaaacctgtggtatatgagattcagacaacataaggagtgaacttatttggatatgtttgacaacctgtcgttaggcaggatacttgctgacgacacagaggataacacacctgcctgcccttttccgaaaggaagatttcctgaggatacgccgctggcaatggcatatgtgccttttcagatgtgggagaagccttatgaggcagatgtaggactttcaagaggaactatcttcccatccatagacaaaccttttataggagaggaggctgtaaagaatgcccatactaagtgaaaaggagaggcttcttagaaagatacaggcgtgcagctttgcccttgtagaggctaatctttacctcgacagccaccctacctgcagagatggtctggcatattttgcccgccacaaggcagaaaaagagaagcttattgctcaatacaatgagaaatacggaccattgacgatcacgcagaacaattcgtccaagaaatgggaatgggtaacatcaccttttccgtgggaaaggagtgttgactaatgtggcaatatgaaaaaaagctgcaataccccgttaagatcgctaaccctaatcctgctttggctaaggtcattatctcgcagcttggtggccctgacggcgagcttggtgcagcgcttcgttatctcaatcagcgttactcagccccatgtcgtgaggtgcaggcaatactcaacgatatcggcacagaagaacttgcccacatcgaaatgatcggcactattatctatcagctgacccgtgacctctccctcaaggagataaaagacagtggttttgacacctattttgttgaccacactacaggcgtttaccctatagccgcctctggtgtaccattttctgcggaaaccttccaaagtaccggtgacgctattgctgatatacacgaagaccttgctgctgagcaaaaagcccgcctgacctacgacaacattctcaggcttgctgacgatcccgatgtccgtgaccctatcaagtttcttcgtgaacgtgagatagtccactatcagcgcttcggcgaaggactaagacttattcaggatatgcttgacagcaaaaatttctacgctttcaatcctagctttgacaaataataaaaaaagcgggctgttgttatcagtccgcttttttgtacatatatcaaaaatcttccttgtccatctgcttgccgctcctgctgacctttttattaagtatcagcgaaaaagccagcgttgcggctatgagtgctatcatcacaagcactgattttattgtcaaatgcttcaactgtgctccaatatatgtctgcacaagcatttcaggcatcactcccattatcgagccaagaagatatggtctgtaaggcattcgcagtgcgccgtgtatcattgaaacaaggtcgcccggcacaactaccacagcccttgaaatgtaggaggcgaacagattattgtcatgcccataatttacaagctttcgtgccttaggatatttcatctcaataacacgcatgatatcgccaccagatattcttcccacaagataaggaacagtaaaacacaccgatagtcctattacattcaacaaaatgcccacccagaacggatatattgcacccacgcacacaaaaatagccgcaagcgggaataccaccgacaaagacttcaatccataaaatcccaatataacaaatgcggcaagccacaaattgtccgggcaataactgagtatctcagaaaactcatggtctttcagaaaaagagcacagcaaaatattatgataatagttaaagcaaagggtacatatcttccatattttcgcacaaagctatccataactcctcgctcctctccgattctttagggtattataccatatttgaatgttcaattaattatcaatcaatgaaaactgtgttacaactttcgctgtcaaaacaaatttataactttatcgttcgtcaaattgaccaaccattctcatttttgcacaatatcccactattactataatttttataagtagaattatgtcgacttatgtcgtgaagtgttcttaaacaagtcgatttctgttttaatttatgtatatctgattaataggttaaatttgtacaatattgctattgaccaacgtaccaattaatgttataattaattataagaattatttgggaggtatttttatgagatacacagtatacaacaaagcaatgaaacgtccagtttttcaaacaaatgaccttgtagaagccattgactatacacgccgccacccaaggaagtcaagacgacactgcatatacgatgacaaactaaaaacttttgatataaaaaaaataagacatgccgcaggaatataaaacgcacagggtgtaaaactctgtgcgtttttgatgtatttatgaataaacaagtcttacagtcactctgctgtaaccgctccatgtgcaggtgaacaaggtcagatcccagtcactgccaccaccttttatgagcgatggcgaatcccagccgctcagcagttcgctgtttgtgacagtatagttaaattctctgccataaacatcggtgaaaatgacctcatcacctgagctgagcttatccagcttatcaaaaaagcctgtgtaattgtgagcgcagattataagatcattgtctacacgtctgccgctgtactgacaagctgcagtattcattgcagcatagctccagccacgagtcacaggaaactcctgccccagtgtcgggaatgaaatcaaacctatataagagttgccgtcaagcacgatatccttatccgggtcatctatctcgctgtccgtggatcgactatcgtcaaaaatgtcaaagggtgaactgctgtcgctatcctctgcactgtctgagatctgcgttttcaggtcactcagcacagcctccatccttttattactttgcttttcatgaaaatagttgtaataattaagggataatgccgccgctatcagcattatccccattattatcaacaaaagtcctagcttttttttagtcactatttttctcctgttgtaaaggcgagcctatgtggtttcgcctttatttctcttttttgcttactctccagcctgccacgataaggataactccaccgcctataagtacaggcaccggccagttgagcgaaccagtctgtggtatattgtcaggcgttgagcttgatgaatcagagcctgacgaactgctgtcaggtgtgcttgaactactatctgtattactcgaactgtctgacttatatgtgttctctataagaaacagcttgtcattgtttttggtaacaactgtgtagttggcaggaatatctatctccttaactgtccactcagccgcagaattgtctttccaaaaatactcccaattgttgtcagcgttaagagtaacagtatcgaaaagcttgccatcacgatatatctccaccttgatattatcaggtatgagcttttcctgaccatcaggaactatccacgactttcttacaccataatcactgtcccctgctgggatctcttcgtatgtgaacttggtgtaaactgttatctgaccctcagccacgatatccttatctatctcgataagtgacggagaaggtgtaaacttagctgttgtgttttcaaaactcttgcctgaaacaagatacagacccacagaatcagcagaaagctttacttcaccgtttgcgtccgtcttgcctgttgaaaccggtgttatgccatcggtttttgcgtagttgtcgagcgtatcagcgacagcctgcatttttgaagcgtcagtaaaatcagacatatctataggataatcgctgaactcgccggtaaggacaaagtcagcttccttacgctcaccgaccttatatatactccactcggcattactaacagtcgttgtatcatttttgcacactatatccacattgatattatccgctgcagaagctgagatcgtcatacttcccaaggctgaaacagccattgccgccgtacacaaaacagcctttgcaagctgagaaaatttaagtttcatctttgctactctccttatcaggtagattttcaacattatcgtcactctctggcttatctagcattgccacaagctcatcatgagagatttttttgcgttttgaatccacaaaccaccacacaagcagtaccacaaacaatggtattgctacaaaaggcacgaccacaagagaatcgagctgaacagcgtctgccgttatttttgaaacactctttgtatcgtccgcagtttcaactctctttgcacgaacaagaagcctgtgagaattgactccgtatggtgtgcaggtagtcaatgtaacatgatcctcacccggaataatgttcagcttatccatttcattaggcagaactatataaacagcctcgacctcatatgtatagacctctttcaacactgttatagtgaactcatcgccctctgcaagcttatcaaggtcgctgaaaagctttgccgacggcagacctctatgtgctgaaatgaccgaatgagtgtccgctccgccaacaggaaggcttgaaccctgcagatgtcccacagcgacatttaacacgccgtcacttgtgccatgataaataggcaactccacccttatagtcggaatggaaatatagcccataacacccgtccccgtgatatccaggatatcttcatagcccttgacctgatcataatccacaaaaggtcgggcaagctttgctatctcttcattatattttctggcacggctgagtatctcttcattctccttgtcagaaaggtcatttgccgctttctgataagtcgccactgcacggctttgcgtttttgaattccaccaatcgcttattgttggatataacatcacggagagccccacaagcaataacaagaccaataaaattgtagttgatttaccgcttttcttcctcatggagtcctccctgatgcctgccgaccgagatcggcaggacaaaggtaaaaataaattcaaaaattagtcgttcttagctctcttcttagcaatgagaagcacacctgcgcccagtacgatagctccgcctacaccgtagaagatctgagtaccgataccgccagttgttggaagtgagccgcccttctggtttatgatcttaactgttgaaccgcttgtgcctgaatcagtgccgtcgagcatacgaatggactgaagcgtattagcaggatcatatgttgtgtcaaacttgaactcatatggatcagctctgttatactgagcaggagcttctgtctcaacaagcttgtaagttgtctgatcatcaatgcccttgatagtgaacttacctgttgcgtctgtccagatagtatctacagagcctgcctcatcgccaatctcaagtctgtaaacattgtcttctatcttgacaagtctaatagcatcgccgtgtttatccctaagctggaatgcagcacctgcaagaggctcgccattttcgtttaccttgttaccaacaagtgagaatgtccagtcataaactgtaaccttaggtgtttcacctttctccttacctgttgtgtcctgaggattgtttgaatatgtcagataagctgtgttagggttattgtcttttgaattaggaagtgtacctgttacaacgttagcgttctcgttgagtttagcagaatagagagtttcgatcttatcaacatttggatattttttcagaagctccttgatatcgaaagtaacatagaatgtctctttgaaatcagcagtgcttggatcatcaacacctacagttgtgttaggacctactgtaacaggagtgatctcattgccgctagcgtcatagtatttgtaagtaaggttattattgaatgtaagaccctcgctgagctggtcacgaactgtgtatgtatacttgtcataagctgatacatcgcttggtatagttgttgtgatcttgaactctacatcgtcaccaattgcgttgtcaccaacatcgccccatgtgttattctaattatgcttgatctgctttgtaagtgttggctttgtcctctttggagtaacgtctgttgtgcctgaaacgttaaggataagagctgagttagccttatcaacaccattattttctgttgcatcgacaacgagataatagccagcatttggaagtggaatagtgtactcaccgttatcttcataggcggttacagacttgttgtcgatgatgcagccagaagcgacttttgcaaacttggcagtatcttcctttgtccaatgatctgcgtctgagattatctttgcaacgtctgctgcgctctcggcactgtcaaactgtgacatataagtgctaaggccagaagttttcaggctggtaagcagagcatcgccattaatgcctttgccccacttgatagtatttgttgcagatgcctggtcaaagatctgataagccttatatactctgtttgtatcagaatccttgataacaatgttattaacgccagcatcagtagtagcaaatactccgaatgctgatgttgcagcaatagctgaaactgacataacggttgcggcagcaagagctgcgaatttcttcatcttcataattaattatcctttcatattggtttatttacagcgtttttttgcgacgctttgtaactaaaagtaatgttgcagcaacagtgactgttccgcctgctgccacgaatgggataacacccatgccgcctgtttcaggcagctctcccaaagtttcctcagagttgttatagacctgaacatactgatcaccgttctttgtcatatcaatgcaattctcattttctgagccattgtatctgtagtaagctttgtatgacgatgtgcttatcggctgaccgttcacgtctgtctcctcaaaccaatagtaatacttattacccttgatgtcatttttttcgagagaaacggcatttgaccagttgttatcagccgtgagcgttatctgcttccacaagaatacttcaccgctaggtatcgcatctttattaggaacaggtgtaacgttcgtcttctcaggtgtgccaagttcattagctgtcacctcataagagcaactgctatcatcattgacctttgctgtaagctcaactgtaacatcggaagtaatatcgctaaggtcaactgtgaacttgctggaattataaagatcagcaactgacacacttatatacttacttgaagcgctccatgacgcaacactctgatttttgtcaccgtcccaaacatcccgatctctgtagaactcagcaagaacatcgccagacgaattgataagccttactccggaatatttcatatcgcccctttcgagccatgcgttattaagggtgaagctgaacttagccgagccatacatggtatactcagaggcaaagcttccgttctgagccatttctgcaccattgcttgtaaggatcctgaatttaacattctgtcccttatccattgtgcctgtaaacttgttatatttttcaggcacgtcagccttatttgttgacctatagatattgaacgttaccttatcattggtatgggtattgctatcgccgtcagaccatgccttttgcaggcgaacgtccatattttctaccttctgcgggttcttggtattgacgatcgtatcaaagcccgtggcactgccgttatttgaataagtatatgtaacgccaaagccgtcaggtatattcttttcaagaacatagtaatacttgtccttgtcaagaccgtcaagagttaccgtccaattcttagacttttccagagaaacagtttttataagtttgcaatctgttggtattccgttatctccattcactcttgaagttgaatttggtgcaacagaggactcataaacatctgcctagatcttgtcgataccagcaggaagctcgctgtcagcaagcttgtttccaagctcatcacgccattccttcgtaatgttaagtcccttgacgttcgtaactgtaacatcagtgtttttgctcattgccgttgcactgtatacagcctcatatcctgttgcaagatcgatctctttgatatagtagtaaagctgcttgtaatcattgccgaccttcgtatatccaggaagctttgtccactcatgtttccaattgttagcttcgttaagagttacctcagcactgccccactgaatatcatctggaacaccgcttaaaaccttagttgtagacgagccaagaaggaactttacgctctctgccgagtgattgccgtttccatcgctccaaaccttgcttgcagttatcttaaactcttttagcagatttgttactctgaacatatctccgttcttcacgaactgatatccgtcctcaccgacttcacttggaactacagccggacgcactttaaaagcaaaatatataggagtttcgtcaagaagataaccctctggactttgcttttctataagcttataaagatggccctcagtatttccgatgcctgcggcaggttcaaggtcaaggttgtatgacccgtcagaatttacattgaatgtctgcgccttatcctgcgccgaatttccccagataactgatcttctgtccttcgcagcattttctttgaaatctactgccgggagccaatcgtatgtgccattttccagcttagtgtatctgtagatctcaaaagaagccttaagcataatactatagtctccgctgtctacctttataatcttaaatggctcaacagttgttgatgacgcctttgactgatttatcaactcaaactcggaatcattatcttcactgtcatttacagcagagccgtttgtgtcaaatgatatattattgaacacatggactttatagccatcgttctcagcgtcctcatcatttgcaggacttcctgtataaacgtaaactaatttcaggtgacgctgatctggaacgtttatttcaagtttctttacaaaatctcgtgtcttcgctgtcagtgcggaacactttaccgccgaaagcattttttcattgctgacttcagtgtttgaaaagccgctgccatccctgtattcatattcgactctgaaaacaccgcccgccttctcagaagaaacctcttccacagggacggatatgcttgagccaaaatctgaccactcgcttctcttgttggcaaaggcttttacttctttgaagctgttgccgtccatatagccataagccacatagtaactctttatatttccgttttcgtagccttcaggcaaagttagatcaatagtacccttagcgccaacaatactttcacttggaataaagttagcgataaacttgcccttttcgttggtaataacatctgcactgcaagaaactgtgctgtcaactgcctccggatctgatatcacataactgtaatcactcacagcaagctctgcacccgtatctgcgtcaaataccttgatagacttcagatccatatcaacagcggaattgccatttatgcttaccgtttttgtctgaatgttaccctgagcgtcctttgtcttaactacagccgtgcctccgcacttgataacatcgttgagagttatcattccgtttgttgagcatttgagctttttagggttaacatcaatggtataagttatctcacagccggtggacttcggagaagaagttttcttcaagttcttttccttaactgtctgagtctggcttctctccggatattttccagctttatcctgaactgtgtttttgaacgctgcagtaccattcttgtaaacaccattcttaacatcatcgacctttacaagtgtactgtagtaagctgtccaagcgtcctgctgattccatgcagtcttgaaagttactgtattggctgtcttatcatagaaatattcaaactgatttgtttgtgcaaaatcatacttatcagaactatttccaaatgaatacttgagataatccttgttctcgtagaatatcattcccgccggaagcgtgtccacgatctcgacattatcgttacgcttataagtgccgtccttgttgatatcaagccgccaatcaaacctgtaatactcaacaccatttacagtaacaacaggcaggctgctaagatcatgcactgtgtcgcctgctacactgcttgcagcgtcatacttttcataaggcgctttggagctgtcgcctatagtaaacttagtcttatctgcactaggctcgaatgtttcacctttataagtagccttgttatttacatttataatagtaccttcgtcaagacctgttacatctatggtactgctatactttatctgcacaaggtttatattgtcaaattcttcactatcattgaactttatctcaaacgaagtgttgtcgtcattaggtactacagtgtaatttgaactgtcaagcggttcatagcttcctgttccatttctctgaacatacatgataatggaatcagtgtcaagaacgctctttattgacttgccatcatttgacgtagcgttcattatatcgcttatagtcttgcccctaaaggaaccgtttgtctgcttgacctctaccagccacttatatgtaacactgcttccgtcctgagaaatgtcaagaactgtttttgacttctcgtttacaggcttataataaactgtcttgtcagaatggaatccgtcaatacctgcagtatttttcactgcataatttccattgctgtcagggtcgccaagatcatagtcggcaacctttgtttcataggaaataactacctcgttattgtcacctattctgtcaggcaaaacaagctcaccgtcacttgcaactgttgcatcaaaggtatcatttccaacctttatgctgacaatctgtcctgctttaagcatattatcagttattgtcttgcctttaagggtagaatttttgtcattacatttaacagttacttcccatttgagtatacctaacgtgttattatctatccaaccactttttgatatctgatacctattataaacagtttcacttgatgtgatatcagaccatggttggcttttatcaggtctttgcattttaactgtatttgtagtttccgccttgtcaggatcgatagctgtcacatactcgatagtaatttttgacgctgttgttttatcgtcaaacgtaagcgtgtttccattaagtgtgtactttacatctgaaccatcatcagctttaagtgcaaagcttccttgctttgcatcagggaatgcttcatcataaaggtgatagcccttgaggtctgcaccgctagggttgcttacaacaatttcccatgtgacttcgttattgtcgtagtcaacattcttgcctgtttttgagatcttatctttctttgactcagaataaatagttttatctgcttttactccatttccgtccttatcatatgtggtggatttgttttccaccttacctgacataacgaaattcgggtcgcttgtaggatatggggtcgtgtagcttatggtaacattttctttgctgaatccatcgctgaaaacaaactttccgcttgacgcgtcatagcttcctgcaccctcaggtgaaacagtgaagcttccgtcaacagcatccttaaaaagctcgtcctcgattctgtcaagaggcttctttgcaggattgtccactgtgatagtccacctaactccgtcagcagtttcgcttgcgtcctttatggcagacatagtgagcggagtaaaaccgtctatttcaaccgtctgaccgcctatctcaacagtggtcttatcacctgtatctgtatctttacgctttacattgccctcaaagcttgccttaccgcttatagcgtccttctcatttttatgttgatatcgctcgtcaaactcaataaaaagatacttctttccatctatctcgtcgactctgtacttacctgaaattccatgtccttcatcgaagtgagtatcctcgacatcgccccaggttccgtctgacggtataccgccctcgggcaggctaacattatcgtcgatagggaaataaatatacctattggtcattgcgcccttgtcaaaatcaaattccacattgaattcgatctttttagattggtcttttcctgaaccgaccgcatcataggattttatcgtgacgctattcgcatccttataagaataacttccgccgttataggaaacatctccacctgccacggaagtaccctcagtggcacttattgcaggcataacaagactcgccagcactgacactgtcataactacagacagcaccacaccaaacaagcggctgcgttttttcctttcattttcttttagatattgccgaactttaccgttaaaattctgcaaaacggatcactccctccgaaattatacactatttataataaacgctagtccactgtgcctatccttttaaaaggatatatcctcagtgagacctttccaagcactgcttcctcagcaatacagcctatcctctttgtacggctgtcaacagacgtagatctgtggtcgcccataacgaatattctctcgtcaggcacctgataaggcaactcgatatcacattctcccagagctttgccgtcaacatacggctcattcaaggtttttccgttgacgataacagtaccatcctccttgatatccaccacatctcctgctgtagcgataacacgtttcaacagtatcttattattataataaaacgcaactatatcgcccttctgaaagcttccacgctttctgcacaccaccagctcgtcgtcatgcaaagtcggcgtcatacttgtacccgttactctcaaaacaggcaaaaataacattgatataatcactgctgccgctgccacaacaagaagcgacgccacggtgctgcggagtatcctcagatattcccgcctttcatgacgcttttttaccacccgctcaagtgtctggacatcaggaagctcaggtttttttaacacctcgttcttgctatctgctgccatgatcttcctccactaccggctgctcaacaaccagcttgtgacctgtcagtgcagctacctgccgctccagcctgtcaagtcggtcagtgatactttttttatcttcgagcttttgaagaagcttttcattctctgcgttaagcttatcatattcttttcgcagataaagcattaactcgagcaactcatttttcgacaatttttcaagcgccttatccttcaaaagcctcacctccgacgcagtatgcctatatatttacaagtattatatcacttgattttccatttgtcaatcccacaatatatcatatttgtattttattacatataaatatactgatagtttacacaatattgatttatcattttcacagtgccggcagatgataaaacggcatatttattagccttgaacatgaaacaatactaaacctgcgtttttacgctaattgcaactttcccccaaaaaatctttcctattttgattatagcaacctgcatagtcaatattttaacattgtatactaatactgtatttattaatattttgtaaactttgataaataactttctatcattagccaaatattaatttagtcccagatcgatccttatttaacgacaaatgttcactgcaaagcaaataaactttacatgtctacattgacaagctttcaaactttacacgttcgacaaagcaaaaaaatcggcaaatttcatgtattcaccgatctatcatcaattttgctttctcacaacagcatattcatcatcaagcctgtaataagggcagctatattcgctgtcgctcattgatctgtatgcttcgtcctcgtcaagatcgaccatgcagcagtaacattcacaatcctcatcaaaaacgtaattcacacagctttcgcaacggctgactattttcttcgcctttgtcataacagcctcctatttaagcacctttttaagtatactatttataaatacaagtgcgtccttcatttttttcatatcactatctgagacactggaaaatttaccaagtatatcatcaagtatctcgtttttcatcttttccataaagcgcatagcttcgtcagtgagcctgatgttgataactctgcggttatcggggttttgcattctgataacaaagcccttgtcaacaagctgtgccacagcccttgttgcctgctcattagaagtgtttatcttgcttgcaagctgtgacattgtgagcgttccctcaatacatagtgacagcattattatctgctgagttcttgttatatcatactttttcttatcaaacgtatcaaataccaattttctgctgagagggtatatctcatacattgacatgatacattcacgacgtacattgtctaccatttttacttcctccacataaagctaattacaacatattttcgttgatttttccacacacagtaattataacatacgcttatcatttgtcaatagcagaaatatatcaatatttgattttgttaagtcattcttttaggggttttgttgatgaagatagattatatgcgcatgacaagttttaaagttttaccaatttacaaaaagtttagtcgaaatttctgtaaattatagctgccagcttaacacaagacggtaagaatgtggtataatagttagtgaagtaaaaatagattatggaggtttaaagtatatgttgtgtactgagtgtaaaaaagagcaagaaaaacgtattcctaacgaggaaaaagaaaatgcacagcccgccgaaaaattgtgcagcgacgtacatacaacactgaaatcaaagcgttcagccgctttgatacttttgactggtgctacgcttatgctcataatggtgttcattcttttttggcttatcatgttgcccaatctgccacaagacaacagcgtccttgcgaataactgtgcaaatatatgccagaccgctaaggaatatatcgggatctgatcttcaagacgacctgctcctgccttcgggcgggagtttttttgttttatggcgattttacaagctttttacggcacctgcattgacatcatattcgtttggcggtataataatacagtatgatataagatgcctttcttacgataggagttaggagaaataagaatatgaataacaaggtctacgataacagagagttatcatggcttaaatttaacgagagagttcttgaagaagctcaggacagtgctacaccgcttcttgaaagattgctttttcagtcgatatttgcaagcaatcttgacgagttttttagggtgcgtgtgggctcgctctatgattcctcgcttgtggacgacgatcataaagacaacaagtccaaaatgcgtccatctgaacagctttctgcaatatttaagcgtgttcatgagcttataccaataaaagataagacatacaaagctatctgcgaggaactggagctaaaaaatatagtacataaaaacataaaggctctcactgaacaggataagaaatttcttgaagcctattatgcctatgaggtcaagccgtttcttaatgcctttattatcgataaaagacaccctttcccgtttcttgcaaatcaaagtatttatgcggtcgcaaaactcgcttcaaaatctgccgtcacagtgggtatagttagctgtaacgagaaattccagcgtgtgatctttcttcctgctgacgaagggtgcataaactatatccttgtagaagagcttattctccattatgctgacaaggcttttgagggctataaaatagaagaaaaggctcttatgagagtgacacgaaacgctgatatcgacgttgacgagggctttgactcggaacttgatttcagacaaaatatgtctgagcttatcaacaagcgtaaacgcctttgtcctgtaagattgcagctttcaaagcaaatatccgacactgtgctgaacgaactgctttcaaggttggagctttcagaaaagcaagtctttgtggagaaaactccccttgatatgtcctatgtgttcgctgtgtttgacaaggtgtcagacagaaaagagcttttctttccgaagcaggagccgcagccctctgcgatgatagacccgtcaaggtcaatgatagagcagatagacgaaaaggatctttttctgcactatccttatgagtccataaagccttttatcaggcttcttgacgaggcggcaaaggacgatagcgttacgtctgtcaaaatgactttgtatcgtgtggcgaagaactccaaggtaataaaggcgttgtgcaacgccgctgaaaatggcaaggacgtgcttgtgcttgtggagctgagggcacgttttgatgaggaaaacaatatagggtggtcaaagcttctcgaggagtcaggctgtcatgtaatgtatggtccgcagggacttaaagtccattcaaagctttgtcttattacaagaaaagttggcgacagcgttaagtacactgttcaggtgggtacaggaaactacaacgaaaagaccgcagggctttataccgacctttgccttatgacatcaaacaatgacattgctcaggatgcttgcgaggtgttcagaacgctgtcaatgggcgagcttgtggaaagctcaaaggcacttatggtcgctccccactgtctgcaaaataaggtagtggagcttatggataatgagataagcattgcaagagcaggcggtgagggatatgttgccgcaaagctcaattctcttactgataaggtgcttatggacaagataatagaatgttctcaggcaggcgtgaaggtagagcttgttataaggggtatatcctgccttgtggcaggcgtggagggcgttactgacaatgtgcagatacgctcaatagttggcagatatcttgagcacgcaaggatatatattttcggcacaggtgttcgcaaaaaggtatacatatccagcgcagactatatgacaagaaacaccacaaggcgagttgaggtcgccgcacctatcctcagtgaagaagtaaaaaaacgtgtcctcgatatttttgacacccagatgcaggacaacgtaaaagcaaggataatgcagcctgacggaaaatatgtccgtgcagagcgtggagatatcgccattgacgcacaaagcagattttacgctgaagcatacgccaatgcaccaaagcctgctcctgttaatgattcaaaggctgtcgagcctgaaaaggagaaaaagggctttttaggctggctcaaaaggcttttcagaagaaaaaagaaataatatacaatgcggtcatattctatatggctgcatttttttgtacaaaaaaagggacagactctcgcctgtcccttaaattttatttattacttgttgtctgcaaaagcgttgttgatagctgaaacaagtcccttgatagaagatacgatgatatctgagtgtctgccgacgccccaatacatcttatcaccgcaggaaattccaacatacgaaacagcctcagatgttgactttctttcaagagcgtgttctgtgtatgtttcaacggtaaaatcaaagttcaaagcctgcttgatagcatttgccacagcgtcaagacgtccgttgccctctgctgtatgatcgtctgttacgccgtttactgaagctgtgatagcggcgcagatagtgccgttctgcttctgaacatagtgtgcctcaggaatgtcaacaggtgcgcacttgttgaggtactcgtccttgaatatcttgtatacctcatcaggcataagctccttgtgcttgtggtctgaaacagcctttaccttgtagccaaagtcctctctcatcttctttggaagatcgtagccgaactggttctgaagaataaagcctattcctccctttcctgattgcgagtttattctgataacgtcaccgtcatactctctgccaacgtcatgcggatcaataggaagataaggaactgtccacttgtcacagctcttctcttttctccagttcatgccctttgcgatagcgtcctgatgtgagcctgagaatgcagcgaatacaagtgctcctgaatatgggcttctgtcataaaccttcattcttgtaactctctcgtaaagctctaccagtgcaggcatatctgagaagtccagcttagggtcaactccgtgagtgtacatattaagtgcgatagtaacgatgtcggcattgcctgttctctcaccattgccgaaacaagtaccctctattctgtcagcacctgcaagcagacccatttcgcagtctgccactgcacagcctctgtcattatgtgggtgaagtgaaactataacgttctctctgttgtgaagagtgtcgcacatatactctacctgctgagcataaacatgaggcattgacatttcaactgttacaggcaggttgatgatgaccttgttatcaggtgcaggctgccagatgtcgataacagcgttacagatatctcttgcaaactcaggctctgtgcctgtgaagctctcaggagaatactcgaatacgatattgccctttgcgtgcttcttatactcgttacagagctttgcaccgtctgtagctatcttgattatctcttccttagactttcggaaaacctgctctctctgtgcaacagatgttgagttataaaggtggacaacagcgttctttgcgccgtcgatagcttcaaatgttttctttatgatatgctctcttgactgtgtgagcacctgaatagtaacatcatcaggtatcatgttcttctcaataagtgtgcggcagaactcatactctgtttcagaggcggcagggaaacctatctctatctccttaaagcctatctcaacgagctttgtgaaaaactccagcttttcttcaaggctcataggaatgataagagcctgatttccgtctctcaggtcaacagaacaccatgcaggagcgtggtcaacatactctttttcagcccacttcatgcactttacaggaggcatataatagcctctctcatacttttctacgtttttcatgtcagatcctccttataaatataaagccgataattattttgatagtgatgtggaaaagggcataaaaaaatcgccactcctaccaaaaaggagagacgagctttgccgtgttaccactctcattcatatacggctcacaccgcatatctcagccgcatctatcaatgcgtatctctataacgggagaacccgtgagcggctagtaagatttcaccgttcaggctcggggacgagttatcacaaattccgcataccgtcttgcacccaccgacggctctctgtaatgtcagaactttgcttttgttcctgtcaacgcctttgtcatattgtttttattatacccatacttcccgcttttgtcaataggacaattgtcgatttaacaatttgttaatattcggtgctaaatcgttttccctgacgttaaatgtaggggctggcgtcctctgcaaaataatcttaaaatattcttattacgcttttcaaatgcttaaaagtatcttaattagcctgtctgtcggttgacaaagaataagcaatggtctataataatagatgctggctgaggggttacccctcatacttttgtacaaaaggggatctataacatgatatttgaaagcattaaaaagcttgtaacatatggtctggaaagcggacttattgaggagagcgacagagtttataccacaaacaggcttcttgaagcccttgaccttgaggaatatgacgaaccagcggaggagttttctaacgttgatcttgaaagcactctcaaagagcttctcgattacgctgtggaaaagggccttacagaaaattctattgtatacagagatcttttcgacacaaaactcatggggcttcttactccaagaccgtcagaggtagacacaaagttctggggactttacaaccaccagtctgcaaaggtcgcaactgactatttctacaagctttcgcaggacacggactacataagaagatacagagtaaagaaagatatgcgctggatagctccaacagagtacggcgaccttgatataactatcaatctttccaagcctgaaaaagacccgaaagccattgcggcggcaaagcttgcaaagcagtcgggatatcctaagtgcctgctgtgctatgagaacgtgggatatgcaggacgagtgaactcccctgcaagacagaaccaccgtgttatatcccttaaaataaacgacacagactggggacttcagtattccccatatgtttattacaacgagcattgtatccttttcaataagaagcatactcctatggtaatagaccgttcggcatttgagaagctttttgactttgttagacagtttccgcactacttcataggttcaaacgctgacctgcctatcgttggcggatctatcctttcgcacgaacattttcagggcggtcattatacttttgcaatggcgaaagcccctgttgaagaaaaaatagttttcaagggctttgagaacgttgacgctggcatcgtaaaatggcctatgtcagttatcagaataaacagcgaggaaaaaaacgctcttgttgaccttgctgacaagatactcaaagcttggagaggctacactgacgaggcggcattcatttacgctgaaactgaaggcgagccgcacaacactatcacccctatcgcaagaatgagaaacggcagatatgagcttgaccttgtgcttagaaacaacatcaccaccggggaatatcctcttggcgtttatcacccgcatcaggagcttcatcatataaagaaagaaaatatcggtcttatcgaagtaatgggtcttgcagtgcttccgtcaagacttaaaggcgaaatggagaagcttgctcaggttctggtcacagagggaacagagggtgtacgccgtgacaagttgatagaaaagcacgctgactgggctgaggagatatcaaagaaaaacaatataacagccgagaacgttcacgaggtattacagaaagaaataggcatcgtgttcgcaaaggtgcttgaacatgcaggcgtttataagagaaacaaagacggaaaagctgcatttgaaagatttatagactatgtgaacaacaagtaataaagaaagaggtgaacgcccgtatctcgcagaagaaatcctgcaagggtgcgggcatttttatgctcagatttacaagacagcatataaaggaaacagcaataattctggcaatagtcatttttataggcacactgtggtttttaggctacaaaaggcatataagagatacgatcaatcaggcttatgacgttacgcctatatccgctatacagttacagcttgcttcgtcatcaaaggctgataagcttatgatagtggctcaccctgatgacgaagtgctttggggcggaggacatctttatgataaaggctatcttgttgtgtgtgtaacaaacggaagaaataaggtgcgttctcaggagttcaaggacgtggtgactgcctcgggcaacgagtgtataatgcttgaatatcctgataaagtcaggggtaagcgtgacgattgggcgcttgttaaggacggtatcgaatctgaccttgaaaagataatgacctgcaaggattggaagcttatagctgtgcataatcaaaaaggcgaatatggtcatatccaccatgtaaacgtgcataattacgtcactgagatatacgataagaacgatatccagtgcgacctttactgctttggcaagtattacaaggctagccgtctgaaagtggtgggcaacactttgccaaagatatcaaaagagagatacgagttcaagaaaaagcttgcggatatgtatacctctcaggagaaaactgtagacaagctgtggcatatggcttattatgaggattggacactgtataaacgctacagtgaacaccctgaaatgaaaaaacaaactgcaactgcgctgggagtggctgtgaatgaagctcagtaagaaaaatataatacatctgtgtgtgcttacagggatatatcttctgtttgtccttgcgctcacaaggtttaaatacgcctatggctctgagcttgattggggcggacagcactatgctatccctgattatttcagaaagctcttttacaaaacaggtgacttttttccctccttcgccccgaacataggttgtggtgagaacatctataatctgtcatattatggactttattcgcctataatacttttttcttatcttctgccctttgtgaaaatgtccacctatatacagatagtatccataataggcattatagcaagcctgtggatattctatatatggatgcgtcagaaattcacagacaacacagcgtttgcactgagctttgtgtttctcttttcagcgccccttatcttccacagtcacaggcacataatgtttgtgaattatatgccgttcctgcttttaggttttatggctatcgaggattattttgagggcaagagaaaatacatggtgacgctttgggcatttttgatgctcatgacaagctatttctttgcagtgtcgggtcttgcggcaatggcagtgtatggcgtttaccgctggctgaaaataaatgaaaagccaaccttcaagaagttctgcaaagacggaacagcattcgctttcaggcttattctagcagtgataatggcgtgtgtgcttatcctgccgacactgcactgtatgctctcaggcagagaggcaggcaacagccatgttgatctcaagtcgttcataccaggcgtaaacttgaaattcctgctctattatcactactcaatggggctttgccttttcacagtgcttagcataatatcggcggtgttctcaaaacaacgctatagaagatttctcggaatcgttatgatggtaatagccacctgccctataatagtctatatgttaaacggcacactgtatgttgacccgaaagttcttatacctttccttcctcttggtatgctccttttcggacacacctattttgatataataagaggaaagctaaagcttaaaccacttgcagtgataacccttttagttgcattggcaggagttttctggttcaagaccaccaaaaaagtggagttttatattatccttgactttgttgtgcttatgtcgagcctgtttgtatacagacgttgcaaaaaagagttcatacttaatataggaatgtccctttgcctcgtggtatccacagtatatgcaaactttgcagacgagcttgtgcctttaagagagcttgaatatgataacagcagtgatatgaatacacttgcagattatgtcggctcgcaagaggagatatcgagaacttcaaactgcgttgacgaagtgaacacagtgaatatgatatataatgcagattattacaccatgtcaatatattcctcactgcacaataaagattacaacaaattttattacagcgagatatacaacgaaaattcataccgcaacacttccctgaccactcagacacgaagccttattgctgatatgtatttttcaaacaggtatcttatcactgacgacccggtaaaggcagtgtcaggctacaagaagataaaagagagcggaagcctttcactttatgaaaacaatgacgttctgcctttcggatatgctaccaatgctcttatcggcagaaaagaatataattccctgaattatccttactcagtggaagctcttttcaataatataatagttgaggataagacggaaaagtcattttcatctgatatcaaaaaggtacgctccatcaactttacagagtgcgaccagataaagcgtgaatggggaaaatacaccattgacgctaaaaagcctttcactcaggagataacgcttcccgaaacgctcacgaacaatgagataatgtttgtatctttcaatgtgaacaacgatataaagggtggcagaaaggacgcttgggtgtccataaacggcaataaaaacaagctcactgcacctgattggaagtattacaataataacagacgttttgaatatgtcataaccacaggtcaggactatagtgcagacagcgttaaggtgaatttctctgacggcaagtatgagataaccaacgttcgctgttatgtcatcgacaaagacagccttgtgcgtgacgttgacccgttcatgatagacaagaagacctctcacggagatgtgataaacggcactatagacgttaaaaatgacggctatttcactatttccattccgtataccgacggcttcaccgccgagatcgacggcaaagaggtgcagtgtgaaaagaccgacactgcattccttggtttcaagataccaaaaggcagccacagcataaagataacctttaccgcaccattgctccacgagggcatagttctctcaggggcaggattgctgatattcatagtatgcgttattattgacagaagaaaatcaaaagcttcaaagtaggaaaaaaataaaagcgacagaaatctgaatctgtcgctttttttgtcgtatgtttaggtttgtctattcacttattacataaaatatgataaaataacagagtgattgtgtgacttttgtcaaaggttctgtctgaatccctcaccaatggtaacattttcgtatgcaagctcacgcattttcagcattacgtcatgtggagtttctctcattccgcccgttgcccaatctattattattccgcaatagccatgagaataaaaatcggcaaagaacttcgccttatcggaacgctttctggttatagcaacagcgtgatagaaaaatctgatgaacagcttgtgcatacttctgaaaagataatgctcgaatatcttttcgttgctttttagcgtgtttgagtaaaagcgcttgtctttgagcatatttacgagaaatccctcaagacgctcataccagttgtcgtagtttacgcctttggtgatatcagcgaaaagctcgtgaagatagatatagctcaaaagctcatatttatcttgaaaatggtaataaaaagactggcggttaagaccgcactcacctgttatatcggatatggatattttatcaaagggtttttgctcgcagagttttttcagtgaatcacacaaagcacttttggttatcgcagagcttgacatttaactacattcctttcagattcataacgacaaaaagtcttttttgaggaaaaatcagactaagctggattaatgtcaaaaaagtagacaatttgcgctaacttttattatatcataaatttatgaaatttcaataactttttataaatattttgtcattatcatttttttcacagggggaaacggcatgaaaaacaatatcatcacagaatttataaatggtcaaagctgtagagcgtatgaagccctgggggcagtaaaaatagagaacggcataagattttccacctatgcgccccatgcaagaaaggtagagctttgcctgaatggagatattatccctatggaatgcgatgaacgtggggtatggagcgttgaacgccctgcaaaagagggtgacatttatcagtatgttatcacaacgcctactcttgaaaagcactaccgctcagacccttttgcggtgtacagcgaggtaagaccgaaaaatgcgtctgtggtgtatgatatcgacagctatagctggaatgaccaagaatggctcttaaagcgtgacaaatgctatgaaaagcctatgaacatatatgaggtgcatttcggctcgtggcgcataaaagagggaaaagaagaaaccgaccgcttttacacctatgaagaaatgatagacctgctcataccttatgtaaaggaaatgggctatacccatatcgagcttctgccactgacggaatatccttatgacggctcatggggctatcaggtgtcgggatatttctccgcaaccagccgttacggcgaccctagagggcttatgaagtttatagacgcttgtcatgcggaaaatatcggcattattctggactttgtacccgtacattttgtccgtgatttctatgccctgcacatatatgacggaagcttcctctttgaaagcgacaatgagtatgacagatactccgagtggggtactgccctatttgactacacaaagccccatgtgcttagctttgtaaaatcctcagttaatttctggatagaaaaatatcatgttgacggattgagatatgacgcagttgcaaaccttatctatcgtcacggccacactgatgacgctgtgaacgacagcggtatatggttcttgaagaacactaattacgccattcagaaaatgcaccctgacgttatgcttttcgcagaagattccacaaactacacaaaggtaactgcccctgttgagttcggcggtcttggctttgactataaatgggatctgggtttcatgaacgataccatcaattatataaagactccgccttttgaacgcagaaatcatcacaataaaatgactttctccatgagttatttctataatgaccttttcattcttccttactcccacgacgaggtagttcacggcaagaaaaccatggtggataaggtgttcggcagtcagcaggagcagtttgctaccataagagcactgtatactttccagttcactcaccccggcaagaaactcaatttcatgggcaacgagcttggcgaatatcttgaatggcgtgatgaaaaagaactgggctggaatttgctcacatatcctatacatgattcattacacgagtatgtgaaagcactccacaagctttatcttgaacagcctgcactgtataagtccgactataattccacatctttccgctggatagacgcagacaacaaaaatcagtgcatttatgcctaccgcagaagcgacccttccggcaagacgctttatatggtgttcaatttttccggaagctatcagaactatagcctgaaggtcgagcaaaacggagcctacaaagagcttctcaactctgaccgtgatatttatagtggatcaaactgcataaacagcggtctttataccacaaactataagctgccactcagacttgcacctctcagcagcgttataattaccacagaatgagaaaaaaatattaaaaatcataaaatactattgcaaaatggcgaaatatgcgttataatatgagtgtatgtaatatacaacatttacaccaaaatcatttgagaggagttatgtaaataatggtttattctcacgaagttgaaacaatgtgccctatcgctcagggcgttgctcacggtgcagctccaattccagaagaagcaaagtgggtaaaagctaaggaaatcaaggatatctcaggctttacacacggtatcggctggtgtgctccacagcagggctgctgcaagctgacacttaatgtaaaagagggcgttatccaggaatgtctcgttgaaactatcggctgctcaggtatgacacactctgctgctatggcatcagagatccttccaggcagaacagttctcgaggctcttaacacagacctcgtttgcgacgctatcaacacagctatgagagagcttttcctccagatcgtttacggtcgttcacagagtgcattctctgagggcggtcttgtagtaggcgctggtcttgaggaccttggtaagggacttcgttcacaggtaggtactatgtatggtacacttgcaaagggtcctagataccttgaaatgacagacggctatgttacaggtcttgcacttaacgaagatgacgagatcatcggctacaagtttgtaaacttcggcaagatgatggacttcatcaaggctggcgacgatgctaacactgcttttgagaaagcacagggtcagtacggcagagtagctgacgctgttaagatcgttgacccaagaaaagaataaggaggatttgttacaatggctttatttgaatcatatgagagaagagaaaagcagatccttgctgttatcaatcagtacggtatcaacactatcgaagagtgtgctgacgtatgcaaggctaagggtcttgacatttataagctcgttgagggcattcagcctatctgctttgagaacgctaagtgggcttacacagtaggctgcgctatcgctatcaagaagggctgcacaagagctgctgacgctgctgctgctatcggtgagggacttcaggctttctgtatccctggctctgtagctgaccagagaaaggttggtcttggtcacggtaacctcggcaagatgcttcttgaagaggatacagagtgcttcgcattcctcgcaggccacgaatcattcgctgccgctgagggtgctatcggtatcgctgagaaggctaacaaggttagaacaaagcctctgagagttattcttaacggtcttggcaaggacgctgcacagatcatcgctagaatcaacggcttcacatatgttgaaacagaaatggattactacacaggcgaagttaaggaagtattccgcaaggcatactctgacggtctgagagctaaggtaaactgctacggtgctaacgatgtcacagaaggcgttgctatcatgtggaaagagaacgtagacgtttctatcacaggtaactcaacaaacccaacaagattccagcacccagttgcaggtacatacaagaaggaaagacttgagaagggcaagaagtacttctcagttgcttcaggcggaggaacaggtagaactctgcacccagataacatggctgctggtcctgcttcttatggtatgacagatacaatgggaagaatgcacagcgacgctcagtttgctggttcttcttcagttcctgcacacgttgagatgatgggtcttatcggcatgggcaacaacccaatggttggtgctacagttgcttgcgcagttgcagttgaagaggctatgaagtaaggttttaaaccacttcacaagtcttgtaatgtggacaacgataagacttcgtgttcaaaagaatatcagtaaggcgttagattttgttctaacgccttatttttatgcacaaaaagacctccccatgctgtaagaaaggtctgacgaccaaactaaagcgcaggaaggtcaatatcacaaatacaagctaaaaactgcataactcccatattaaaagaactttgcaatatcctcaacagctctccttttaggtctggcaggggcttctgcaggatagccaacggctataactgatactacgatctcgctttcaggtatttcaagcacctcacggagcttttctccgtccctgatgcccattacaagcgagcctaagccaagctcagccgctttgagaagaagtatctcattgtgcagaccaagatcgtaaaaaccccagccattgccgacttcattatcaggatcaccctctttgtcaaaacctgctcttgtatgtacaaaagtcgttacaagaagtgccgcattttcagacctttctctgttaaatccaggcaagcactcctctcttaccctctttgtcatctcgtcgctgagaacgcagtaataccttgcagtttcagagtttttccacgatggtgcttctgttgcggcagctatgagcgtttctatctgctcttttgttacctttttactgccgtcatattttcttatgcttcttctgctttcaataagcttctgaaattccatttatatctctccttgtcaaaatgtgaggctcacgcctatttcagatacaattataacatatcacttccaccatttcaagtagcaaaagcccttgaaatgttcatattattgtgatacaataacgtaaagacaatatgggggtgcagactatgagctttgtaaaattcgagaacgtttataaaagatacaaaatgggcgagataaccataaatgccgcagacggtgtttcatttgagatagaaaagggcgaatttgctgttatagtaggcgcaagcggtgcaggaaaaactactatacttaatatgctcggcggcatggatacctgtgacgagggcaagatccttgttgacggcaaggacattgccacttttaataaaaagcagctcacaacataccgcagatatgacataggctttgtttttcaattctataaccttgtaaataatcttactgctaaggaaaatgtagagcttgccacacagatatgcgcacatgcctcaaagcctgaagaagtgctgaaaaaagtgggacttgaggacagaatgaacaactttccctcccaactttcaggcggcgagcagcagcgtgtttctatcgcacgagcattggcgaaaaatcctaagcttcttctttgcgacgaaccgacgggcgctcttgattacaacacaggtaaaaatatcctcagacttttgcaggatacctgccgaaatgacggtgtaacagttatagtcatcacccacaactctgcaatcgcaccaatggctgacagagttataaccgtcaaaaacagcaaggtggataaggtcgagataaacaaagaccctgttgacgtttctactatcgaatggtaacggagagatatatgaaaattctttcacctatcaaatacgaatatggcaatctgaaaataggcggaggcggctttgtgaccggtatcacgttccaccacaccgacagcaaaacgctttatatacgcaccgacatcggtggcgtttatcgctatgactttgataaacaaacttgggtgtatctggcagagaaagttaccgcagacgaccctgcacagacctatccccttgcaatagcccttgacgaaaacgaccctgacaagctgtttttcacctgcggagataaacgctcaaattatatctgcatatctgatgataagggagaaaatataatacaaaaggcactgccatgcagcgttcacggaaacgaagttggcagagccacaggtgacagacttatttacaaaaacggcaggctgtatttcggctctcagaccgcaggaattatctattctgaggatatgggcgaaagctggcaaagcatagacctgtttggtgagaaaaacatctctcttatatggacagacagtgagggcaaactttttatcgcaggctgttcaggtgaagcaaactcccctgacggtgtaacaagaggtcacactctgtattgctccacagacggcttgaaaagctttgttcccctcaccgcccccgaacctgtgaaatatgaaaactcctcctattatggcttcgtgccacagcgtatcaccagcgacagcagatatatatacatcacttttgcttcaagcggagaagtattctacggtggcatgggtgcttatgcttgcgacacaggctcgctttcaggtggcaaggtctacagataccgcatcgaaaatggagtgactgtttttgacaaagacatcacccccgaggaccatatcccatgcggctacagcggaatatgttccaacggcaaaatgcttttgctatcaactgtctgccggaaaaatggcggagatatgatctatacaagcaccgacagcggtgaaagctggaagataataatgaatggtcttgactacagccgcttcgattggaatatcccatacatgaaaccacaatacaacggcggcggaaactgtgtccactggataagcgacataaagctttcaccttttgacagcgacacagccttgttcaacacaggaacaggtctgttcatgataacaggtcttgcaagcggagatgtgcttgtcaaaccattctgcgagggcatcgaggaaactgttcaccttaatgtatacaccactccccatggcaggaatcgcattatagatatcattggcgaccttggtggctttgcctttgaagattatgacagtgagtgcgaaaattcctttgcaaacgaaaatggcgaccgctacatcacctgccttaatgctgatctcaccctcagcgaccccgaatacatcgtcgcaactccccgtggcaactggacgggcaaaacaaaaggtggtctgatcttatccaaagattgcggttcaacgtgggaaagacttcccatgccccgtgggctttctgagtttacagacaaaaagcttgacaacatcgaaaagcctaatgtagactcaggttggacagcgatatctgccgacggcaaacgcataatgtgggctgttgcaggcggcaaaggcttttctaacaaggctgtctgctataccgacgatgagggcaaaacatggcaaaagtccatttttacggacagcagtggaaactcagcagatgaacacaacgtaaaaattttctcggactattacaacagcgagcttttcttcgccatagcagaaagagaaaatctggggctttacatcagccgtgacaaaggtgcaactttcagagaagtgtccataaaaacggacataaagtgtccacgatacgctcactatcagctttcaagacagcctgataaaagcggagtattctggcttgcaaacggcataaagggactttaccgcttcgagataaagagtgacagcgtgggtataagtgatattctccctaaggacaggataaactgcataggctttggaaaagggcttgaggaaactcctgcaatgtatgtcacaggaaatatcagtggtgaatacggcttttatatttctgatgatctgggcgaaagtttcgcacgtataaataccgatagacagcaatacggtgttatacactcaatatgcggagatatgcgagaacacggcgttttctgccttgccacaggctctcacggacttatgttcggcagacaaaaaagccttgcaaagccgtgaaaaatgtggtataatcaaaataacataattgaaaggaagttcaatatgacctacaaggaagaatttataaaatttatggtagacagcggagtgctcacatttggcgacttcactcttaaaagtggaagaaaagctccgtatttcatcaactgcggaaactataagacaggtgaacagcttgcaaagctgggcggcttttacgctgattgcatagctgacaacaaaatacctgttgaaacacttttcggacctgcatataagggtatccctcttgctgtttcagccgttattgcacttgcaacaaagtatggcattgacgtttcttactgctttgacagaaaggaagctaaggatcacggcgagggcggaatgttcgttggaaagaagcttgcagacggagaaaaggtaataatcatcgacgatgttatgacatctggcaaggctctcagagagtcaatgccaaagctcaaaagtgccgcagacgtaaacgtaacaggcatggtgataacagttgacagaatggaaaaggctcttgacaccgacctttcagctgttgagcaggcttataaagactttggcgtaaaggtatactctatcgtaaacatcaacgatatcatcaaggctattcaggacggtgttgttgagggcaaagagtatcttgacaaaatgctggaataccgtgcaacatacggagttgaccacgaataataagccccctttgagaaaaatttaaggttattttaaagttacaaattgaaataatttgtaacagtattgtagtgaaatgtaacttgtctgttcttgaagttacagtccctaaaggctataatatgtaatgtagaacagagaaagaaaaagaatgtaaacactaagatcaaactcttagctcgtttcatcctctccaaaatttttacacaagcaaagggcagccgatgggttgcctttttgttttgtcgaaatgagcaggataaatgtaaaaaaagtgttaagtgcttgacaagtgacgtatataatggtataataataaagctgatttgttcagcatattgataaatactacatagaactactgtctaaactgaaatgatgggcttctatgagtcataattttagtttggaaggaggaagtcaaatgagagaaggaattcacccaaagtatgaggaaacaacaattacttgcgcttgcggtaatgttatccatactcgttctacaaagaaggatatcaaggttgaaatttgttctaagtgccacccattctacacaggtaagcagaagctcgtagatacaggcggacgtgttgacagattcaagaagagatttaatcttgactaattttcaaagggaacggataattccgttccttttttcttttatatgaggaaaccaaatgggatatacaacaatctatgaggaagctcaggcgagctttacggagaaaaagtccgaatttatcgggcatatcgcacctgtcagcaccgctgatgaggctgtcgcatttataaacaggataaaagccgaaaaccgcaaggctaggcacaacgtctatgcctatgtgttgagagagggtaacgtttcacgatacagcgacgacggcgagccacagggtacaggcggagtgcctgtgcttgatgtaataaacaaatctgggcttacggacgtttgtgtggtggtgacacgatatttcggtggaatacttttgggggcaagcggtcttacaagagcctattctcagggttgttcaatggcagtgaacgctgcaagaaaaatgaaaatgtgtgagtgttcaagaatatccttttcctgcgactatacactttatggcaaggtcagctatgcgttgcctgaatatggcgtgataatggaaaaagaggactttgccgattctgtagatcttgcgtttcttgtgaagtctgaattttcagacaagctgaaagaacagcttacggatatatcctgcggcaagcttgaattgtcagaagaaacaaatcttcttgccgattttgcatgagatttgtgcgattatacaaaaacattcagcctttatgtaaaaataaaggcttttttgaactattatagtatatattatatagagttagtatgttttatatactgtaagggggaatttttgtgctgccgagagaacaaaccgagttgtttgaaaaacaatttctgagcgaaaacgcctgcttgtctgttgattcaaaagggcgtaaaaagccttgcgaaccttgtccgctgaggacgtgtttccagcgtgaccgtgacaggatacttcactgcaactctttcagacggctgaagcataaaactcaggtctatctgtcccctgcaggcgaccattatagaacacgacttactcatacccttgaggtaagtcagatcgcacggactatctcacgggctttgcggctcaacgaagatctcaccgaagctatcgcactgggtcatgaccttggtcatacgccttttggtcatgcaggagaaagggctctcaacgagcttagccctgacggctttcaccactatgagcaaagcctgcgtgtagtggatgttttggaaaaagacggtaagggtcttgacctcacagaagaagtccgtgacggaatattaaagcacactaacatgatagccgacacgaaagagggctatgttgtgcgatttgcagacgttatcgcctatataaatcacgatatcgacgattccgttcgtgcaggcattatgaccgaggaggatatcccgaaaaacatcacaaaggttcttggcggatccaagtctgagaggataaccactcttgtgacctcccttatcaagggcggagctgaaaacctgcatatggacgacgaagtgagtgacgcctacactgcactgcatagatttatgtttgactttgtgtacacaaatccaaagtgcaaatcagaagaagtcaaggctaaagacatgatagcaaagctctatgactactatgttcatcatatagaaaagctgcctgccttttatatgaatctcgcctatcagttcggaattgaccgtgctatctgcgattacatatcaggcatgacagacggctttgccattgagacctttaaaaatctgtttatcccattggggtggacaaagtattagcacatacccaaggaggaagaaatttgccgctgcctatagattttatagaaagacttaaagctgccaaccctatcgcagaggtcatgagcagctatgtcaccctcaaaagaacaggcagagattatgtttgcctctgcccttttcacaacgaaaaaaccccgtcctgccatattcaccctgacaaagagtattttcactgctttggctgcggagcaggcggagatgttatcacttttacaatgaagtacaataatctggactattgggaagctgtcaagctccttgcagaacgtggcggagtgccgcttccggaggataacggctatgacagcaagcgcaccgataccagaaagcgcttctatgaaatgaataaaacagccgcaaggtttttctatcatcagctaaagacaccacagggcaaggaatgtcttgactatcttataaacaaacgtaagctcagtattgaaaccataaagaaatatggaatgggctttgctccaaacagttggtctgccttgaaaagctatatgctctctgagggctttaccgaggaagaattggagcaaggctcgcttatctcacgttcacagaagaatacccgaaatacgttcgattttttcgtaaatcgtgcaatgttcccttttatcgaccttgcaggtcatatagtgggctttggcggaagagcgctcacacctgacgataagagaaaataccttaactcaaaagatacccttgtgtattcaaaaaacagatttcttttctccatgaacttcgccaaaaacgccgcagtgaaagataagaccattcttctgtgcgagggtaaccttgacgttatttcccttaatcaggcaggcttcgagaatgccgtagcttcctgcggaactgcgctcacccctgagcaggcgaagataatatccaactatgcagacaacgttgtcatatgctatgacgcagatggcgcaggtcagaaagccacaacgagagcaataaaaattctaggtgaaactggccttaagaccaccgttataaaaatgaacggtgcaaaagaccctgatgagtacataaacaaattcggagcagaccactttcgccatttgctgaaaaaatcagacggtgcaatagagtttgagctagaaaaatgcaaagacggcattgatatggacactgatataggcaggatagattatctcaaaaaagcctataaagtccttgcggatataagctcccctactgagcgtgagatatacgcaaaaaaggtggcggctgaacagaatgtgagcatcacaactgtcaacgcagaacttaatgctatacttaaaaaccgtcgctatcagtatagcaaaaaggaatggactcgcactataaccttcgctgacaagcgtgacaccataaaccccgaagccaatgaacacagacgagaatccgccgccgaagcgggtatcatatattatctctacaataatcatgacgcctgcggagatgttctcaaaaggcttccgcccgacaaattcgttaccagcttcaataggcgtgtttacgaaagcctgacgagcaagataaccgatttgcaggattgctctgtatcatcttttaatggtgaattttcccccgaggaagtgggtaagataacggagatactggaaaaatacagcgaactgggcattgacgccaaggtcgctgaggattatataaatgtgcttttaaactacaagccgaaggagaaacagaaggatatatccgacgatgacttcttcaaaaagtttgaagaaatgcgcaaaaagaattagcaaagatcaaccgatgtaaaaattgagattggagtgtttgaaatgacagacaagaaacagatacttgataaccttatggaacacggcaagactacaggcaagctcactacaaaagagataactgacgctcttgaaaagctcgactatgacgtcgagcaaatggacagcttctatgatagctgtgccgcaaataatattgagataattgatgatatcatcaccgacgacagccttgacatggtaaacccagaagacgatctggatcaggacggcgttgatatttccctttcaaccgacgggatcgctatcgacgacccggttaagatctaccttaaggaaataggcagagtgccgcttcttacctccgaggaggagatacagcttgcagaaaagatgtctagcggtaatgaaaaggacgctaaaaaagcaagaaaaagacttgcagaagcaaacctcagacttgttgtttctatcgcaaagaaatatgtgggcagaggaatgagcttccttgaccttatccaggaaggcaacatgggtcttatcaaagccgttgaaaaattcgactatacaaagggcttcaaattctccacatatgccacatggtggataagacaggctataacaagagcgatcgccgatcaggcaagaactatcagaatacctgtacacatggtagaaactatcacaaaggtaaagaaagtatcctcacagcttctccacaagaacggtcatgatccgtcacctgaggaaatagcaaaagagcttgatatgagcgttgaaagagtaagagagataatgcgtatcgctcaggaccctgtttctcttgaaacacctatcggtgaggaggaggactcacatcttggcgactttatccctgatgatgacgctccggctccggcagaagccgcttcacttgtgcttcttaaagagcagataaatcaggtgctttccactcttacagagagagaggagaaggtgctcagactgcgtttcggtcttgaggacggacgttcaagaactcttgaagaagtaggtcagcagttcaacgttacccgtgagagaatacgtcagatagaggcaaaggctctcagaaagctccgtcaccctaacaggagcaacaaggtaagagattatcttgactaagtttcggaggaaataaatgtttataacacttgaggcggattacgcagtaagaatagtatccgttctatgccgcgaaagagacaaaatggacgcaaagaccatttccaatgatgcctgcgttacacttcgatttgcgctgaagatactgagaaagcttgttgcggctgatatagtgaagtcatataaaggcacgcagggaggctatatcataaataaagaccctgcacagcttactttgaaagacgttcttgaagccatagagggtacatattatttttcaagatgtctttccccagactgcacctgcaacagaggtgcagacggtatctgctgttatcagaaagcttttaacgagatatctgaaatggtaaggaacaagcttgacacatatacctttgcggagcttatcgcaaattctgaggaatttaaccgagaggatactgctaatgaaacgcagcaagaaattcaagcttgacaaggaagcaataaacaaaatagacagcgagtatgacgatcgtgacctttcaaactacacaaattacgaggtctacgaggaagaaaagccgcgtcacagatttctgaaaaagctcgtaaaacggctgataatactgtgtgcagttgtgcttgtgataaaccttgcggtgcttttgtatacaggcagactgtggttcaatgagccgaaaaagcgtgactatccaataagaggacctgttgtaacagagtcaatgggcgagatacgctggaagagttttgctaagcagaatatccaaaccgcctatattagagccaccaaaggcactacctttgaggacggtgcgttccgtgacaactggaacggctcaaaggacactgatatatcagtgggagcatatcatgtgcttgagcttgatactgacggcactaagcaggcagagcatttcataaatgctgtgggcgaggatctaagcggcaggcttatccctgcagtggaggtaagactgagaggactttacagacttctgccccctgactattacgaagccgcagataaccttgcagacttctgcgacaggatagaaaagcaatacggcataagacctgtcatatactgcacagaacggacgtacaaaaacatcgttgcttcagacagcagatttaacaaggacaagatatggtatgagagcctgttttcaaagcctgacgaggatatggattggacgttttggacttataccaaccgtgtaaaattctcattctatgaaagcggcgaatatctacacatgacggtatttaatggcagcgaagatgatttcaaaaagcttataatataaaaaaagcgtgtatgtcattggcatacacgctttttctatcacataaaataaaaacaggacaaacactttcatgtccgtcctgtctgtttcataatattactacaaatatgtaattacttagcttcacccttgagctctgccatacaagctgcacaaattgtcttgcccttgtattcaacgcactcttcaccgcttccgcagaagatacaagttctctggaacttcttcagaatgatcttgtcatcatctgtatagatctcgatagcgtccttaacagcaaggtcgtaggttcttctgagctcgataggaagaacaattcttccaagctcgtcaacttttcttacaattcctgtagatttcataaaatcaatcccctttaaattaatttgaaacacaaaaatagtatttcatttaacataaatcttatgataaacatattataacaaacataattacatttgtcaagcgttatcaccaaaatttcacacttattgtcaaagttttttatatattaacttgatatgaatactagttgaaaggagtgttaattatattaagcgtaataattgtgatattgtccctatccgccttgttatgcggttttcttaaaggcgacatgacagcagtatcagcggcttctcttgaaggctgtaacaaagcggtggagcttgtcatatacctgagtggctcgatgtgtctttggggcggacttatgaagatatgtgaaaaggctggcataacagcggtcattgcccgtatgctatcccctgtcacaaggctactattcagagatgccgcacactgccccgaggtcatgaatgctgtgacaatgaacctgaccgcaaaccttttaggattaggcaatgccgccacaccctcaggcatagccacagtgaaagccatgcagaagcttccgcccacggcacgaaagaagtgcatttctatgcttgtggtgcttaacacggcttccattcagcttatcccctccaccattgcggcaatgcgccttgaacacggtgcagtatccccctttgacgtaacgcctgctatcattttctcctcccttatctccgtgaccgcaggctgtcttatggtctatgccctcaacctcagaaaggacgaacgccatgaatgtcggtgacatttttgtgcctgcgcttatggtttttatactttgctatgggcttgtgaaaaaggtggatatagtgaatgtgttctgcgagggtgcggctgaaaacctcaaaatcgccgtggggctgataccaatgctcattctgcttatgacagcagtgggaatgttcacatcatcaggtgcggctgatattatagcaaaactgctccgacctgtgaccacttttctaggctttccagaagagtgcataccccttgccatagtcagacccatttcagggagcggcgcactcgcctgccttgaaaccattctttcaagcgtttcccctgacagctacagtggacgtgtagcaagcgttttaatggggtcaacggaaacgacattctacaccatagcagtatatttttcagccataaagcaaaaggcttatccctcagtatttgctgcggcgtgcctttccgatcttatgggatttgtgttctctgcactggcagtaaggctgtttttctcataaaactcaggaataaatttcacatatcggtacataatagacctatcacaaatatacggaggtcttaccagtgaaagatatgttttgtttccagtgtcagcagacagcacacaacacaggctgtgacggaaaagtaggcgtatgcggcaaaaaagccgacacagcagtttatcaagacgagcttatcggtgcacttatcgcccttgcaaacgccgcagaaaatggctcgtcaactgaaaaaacagatatgctcatactcaaagggctttttacgactatcacgaacgtgaacttcaataatgtcaccataaaacagctcacagaggagatacacattgagcgaaaccgcatcaactctcagaagtttgatgactacgacatgaaaaaattgtggaacgatcatgaggatatccgctcgctgaaatcacttatcctcttcggaataaagggtatggcggcgtatgcttatcacgcacaggcacttggcaaaactgacagcgaggtgacaagctttttctacaaggctctgcgtgccataggcagtgagaacgaccctgaaaagctgttgggactggtgcttgaaacaggcaatgtgaacctgaaatgtatggcacttctcgacgccgcaaacactgacgcatacggcgaccctgtccctacagaagttccactgaccattgaaaaagggccttttatcgtcgtgagcggtcatgacctgcacgatatgaaacttctccttgagcagaccaaagataaaggagtgaatatctacactcacagtgaaatgctccctgcccatggttatccaaagctcaaagcctatccgcagctaaagggcaatttcggcacaggctggcaaaatcagcagtcggaatttcacaatatccctgcaccgatacttttcacaacaaactgcataatgcctgtccgtcaaagctactgcgacagagttttcaccacctctatcgtgtcatatcctgagcttgtgcacattggcgacgacaaggattttacgcctgttatagaaaaagccattgagtgcggcggctatgacgaggacaaggaaatgacaggcatgaacggcggtcacacagtaacaacaggctttgcacacaacgcagtgctgtcaaatgccgaaaaaataataagccttgtgaaagagggcaggataaagcacttcttcctcataggcggctgtgacggtgcatcaccgagcagaagttactattccgacttcgcaaggctcacaccgcctgacagccttatcctcactcttgcctgcggaaaataccgcataaacgatatggatcttggcactatcgacggcataccaaggatacttgactgcggacagtgcaatgacgcatactcagccataaagatagcccttgcacttgccgagacgttcgactgcggcgtgaacgatctgccgctgacacttgtgctttcatggtatgagcaaaaggcagtgtgcatacttctcaccctgctttcattgggcataaagaacatctacctcgggccgaccctccctgcattcgtttcaaagggcgtgcttgacgttttggtggataagttccaccttactcctatcagcacacctgaagaagatataaagagaatacttggctaaattttcgcaggagcgtggtaatacgttcctgcttttttgtcgtaaaaaaaaatcttcttcatttcttgtataggagaataaaatatggtataatcatattaaagaaaaaataagaaatcggaggtacataaaatgtctgaaataaaatgtccccactgcggagaggtattcaaagttgatgaacagggctatgcggctatcgtggcacaggtaaaaacggctgagtttgataaagagcttgacaagcgtgtggctgacgaaaaagacaaggctttgaagcttgctaagcttgattttgacagcaagtatacaaaggctgtcaatgataaggatatggagatacaaaagctgaaagcggctgcggctaacggtgagagtgaaaagacacttgctgtcacaaaggctcaggaaagcacaagagccgaatatgaaaaaatgcttgagcagctaaaggagcagataagtcaaaacgaaaagcttatcgcacagcttaccgctcagaccaaatctatgaccacagaaaaagaacttgccatatcaatggctgtggagaaagcaagatcgcaattcaacagcgaaaaggataagctcaggcaggagatatctcaacgtgatatgcagatacaacagctcaattctgagcatactctgcaaatgcaaaagtcagaaaatgaatataaagcggaaataacacgtcttgaaacggatattaaaaataaggatactgaaaaggctttggagcttaccactgcactttcaaaagtggaaagtgagaaaaattccactattgcagagcttaatgcacagataaaaagcaaggacgaagctatcgcatactacaaagacctaaaaagccgtctgtctacaaaaatggtgggcgagagcctcgaacagcactgcatgaacgagttcaacaagataagagctaccgcattcagaaacgcttattttgacaaggataacgacgcaagctcaggaagcaagggcgactttatctaccgtgaatgtgatgaaaacggtgtggagataatatccataatgtttgaaatgaaaaacgagcaggataccacctccaccaagaaaaagaacgagcatttcttcaaagagcttgacaaggacagacgtgagaaaaaatgtgaatacgctgtacttgtttcacttttggaaagcgacagcgagctttataacgcaggcatcacagatgtttcatatgcttatgataaaatgtatgtagtcagacctcagtgctttataccgataatcaccatactgagaaatgccgccatgaataccctttcctataaggaagagcttgaaaaggtacgcaacgagaatatcgacatcacaatgtttgagcaaaacatcaacactttcaaggagggctttgcccgaaactatgaacttgcaagcagacgttttggcgaagctatcacagaaatagacaagtctatagcacatctcacaaagataaaagaaaatcttatttcatcagaaaacaatctgcgccttgcaaacaaaaaggctgacgctctcactatcaagagccttaccaaaaataaccctaccatgcagaaaaaatttgccgagcttaaaggagaataattgctgacatatgaaaggagtggcaaagccatgaaaaaaaatatcagaaaagacattttcacaattatcgccgtgactgtcgccgcctttctaatggcgctaaacacaaagacctttgtaaacacaggcggtctttacccaggcggaatgacaggaatgtccatactcatacagcgtgcagtgaaacagcttgcaggcataatgcttccgttcagcatcataaacataactctgaacataatccccgtgtatatcggtttcagatttatcggcaaaaaattcactgctttttcctgcgtgatgatactgctcaacagctttttcaccgaccttatccccaatcacataatcacccaggacgtgcttctcataagcatcttcggaggaatgataaacggcgttgccattagcctctgccttaatcgtggcgcaacatcaggtggaacggactttatatccatttatctttcagagaaaagcaatatggacaccttcaatgttatacttggcttcaatgcggtcatattgtgcgttgcaggctttatgttcggctgggacaaagcactgtattctatcatctttcaatatgcttcaacaaccgttttgcatatgctctacaaaaaattccagcaaagcaccttgcttatcgtaacaaacaagcccaaagagatagcagacgctatttatgcagtgagccagcatggcgcgaccatacttgacggcgaggggtcttatgaacactgcgaaagacagatcgtctattcagtagtatcagcggcacagaccaaaaaggtcatacacgctgtaaaagaagccgatccgaaagccttcataaacgaagtaaaaacacaaaaactctcaggaagattttatctgccaaaagagagctgatatagaagcggactgaaaaaggtccgctttttattaaaaaaaatcttgttcaacccttgtactttgcgaaaaaatatgatatactattaatatatataaaatcatctgtatttgttttgtttttttcattacatttacagaaattatcgaaagggtgtgaactatgcttgacagtatcgcttatgttataaacgctatttggggcgtttttacatcaataggtcttaatgacattgtcgatattgctatcctctcctttctgatattccacggcataaagcttattcgcgaaacaagggcgcagcagctcacaaaaggtatccttatacttataggttgctatctgcttgcagtattctttaatttgcaaactatcagatttttgctgaggatctgcttccagtggggcttccttgctcttatcataatgtttcagcctgaactcagacgtgttcttgaaaaggttggacgaacaagtctgggtggctttaatttctttagctcaagtgactctgacgacaacaccgaacattggaaaaaagctattgacgctatatgtgattctgccgcaagtctttcttccaccaaaacaggtgcgcttataatctgtgagagaaagacaaagcttggtgaacagatagctacaggaacgatactcaactgcataccgtcaacagcgatattcggaaacatattcttcccgaatacaccgctccatgatggtgctgtaataatcagagacggaataatacttgcggcaggctgtttcttgccaaggccgcagaaagacgaacttataaacaaacaactcggttcaagacaccgtgcagctatcggaatgagcgaaaactctgacgcaatagtcgtcgtggtatctgaggaaacaggcaacatctcagttgccgaaaacggagagcttaccagaggatattcaaaggactctctgaaaagacttctggacaatcgtcttttgcctgaaaaggacgctaattccattagagaaaattcttttgcaggaagggtgatttcaaaatggaaaaagtaaaaaaggctaaaaaagaaaatcgccatggtgcagactttggtctgagaatactttccataatcattgctgtaataatatggtttgccctttctatcactcagtatcctacaataaataagactataacaaacgttcctgttgtgttctcacttgacggaacgcaggcaaaagaaaaaggactttccgcactcaactataaggatatctccgtagacgttgagataaagggcatgaactatgagataggcagctatactgccgcagatcttgtggcaactgtcaatcttgatgacgtaacaaaagagggtacctacgaccttgacatcgacgtcaaatcatcacattccaccgacaaggtaactgtagtttctgtcaaccctgacactgtttctgtggagtttgacagacttaccacaaagactatcccactcaccgcagaagccccgctcataagcgctgaggagggctatatccttaaagaaactaccacatcgccaagcgagataacagttgaaggtccgaaaaatgaccttgacaacataagcaaagcggtggcacagatctcaaaatcaaagaaaatatccgaggacacgactatcaacacacaggatatcgtattctatgacgatgacgacaacgttgttgatccatctaaaatagaggtcaaggatacaaagtctgtcgatgtgaattttgttatctacaagaaaaagacagcaaagctaaaggtagatatctctaattgtacggataattttgatgtcagctcactgccactgaagctttccgaggaagagatatctgtggtatcgccaaatcttgacgactcagatacagaaacgctcactatcggctccataaaactttcagagataaaccttgcaaaggtgttcagcttcaagatccctctcaactcaggtgagatcaatatgaatggcgatgaaaacgttcgtgtatcctttgactcagagggatacacctcgaaggagttcaccataacatcagaccatatcatcgcaacgggcaagccgtcaggcaagtccacagagatagaaacaaaaaagctcacaaacgtcaaggtctacggtcctgaagatgtgataaacaatcttaaagacagcgacttatacgctgaggtcaatctcagcgacataattgactctggttcttatgctcgagaggctataatctattcaccgacctataacaacgtttggggtttcggcaaaaacgagatacagatagttgtttcagactaatagaattttatcgggacgatctattcgtcccgatttttcggtaaaaacgcaggaggatatatgccaataatagtaaatcaaataagtttcccccttaacgcaacagagcaggaagttatctccaccgctctgaaaaagctaggcagtgcctcaaagcacgccatagacggcgagatacacaaaagctctcttgatgcacgaaagcgcaacgacattcactttgtccactcagttttcgtgacacttgacagtgccgaccttgaaaagaagctttgtgagaagaacacttccctgacctatgttgagcgcagtgtttacaagcctgtcatatccacagaaaaagcagagggcaaagttgtcattgcaggttttggaccagcaggaatgttcgcagggcttgcccttgccgagcagggatatagaccgattattttagagcgtggcagctcaatggaaaaacgtactgcatcggtacagaaattctggctcacaggcgagcttaacaccaattgcaacgtgcaattcggtgaaggtggtgcaggcacattttctgatggcaagctcaccacacgaataaaagaccctctttgcagatatgttcttgaacgcttcgtggatttcggtgcgccgaaagagatcctcacaaaagcaaagccgcatatcggcactgacaatctgcgaaatatcgtcacggctatccgaaaaaggataatagagcttgggggcgaggtaagatttgacactgccctcactgatctgtctatcgccaacggcaaagtgcagactatatcagcaggtgacaagaacgaaaaagtgtctgcccttatacttgctattggtcattccgcaagggatacttttgagcttttgcagtgcaaaaacatctttctggagcctaagccgttctctgttggcgcaagaatagaacataagcaggcggctgttgacgaaagcttatacggtgatcatgcaggcaatccactgcttccaaaaggtgaatatcagctttcatggcgtgataaaaacggcagaggtgtttacactttttgtatgtgtccaggcggtacagttgtgccgtcagcttccgaaagcggaggcactgtcacaaatggcatgagcgagtttgcccgtgacggtgagaacgcaaacgctgcagttgtcgtggccgttacccctgacgactttggtcactgcccgcttgacggagtgactttcgcacggtctatagagcaaaaagcttatactctcacaggctcatataaaggcgcaggcacgacagttggcggatttcttgatggcaagcctgaaatagcaggcacagtttcacccacctacgcacttggctgtaaggcgacagagcttcgtgatgtatttcctaaattcgtaactgatatgctggagggcggcttgcagaatttctcacgaaaaatgaaatgcttcggcgataaaggtgcaatgctcaccgcacctgaaacccgtacaagctcccctgttcgcataacacgaaacgcagatatggtatctctctcagtggaaaatctctatccctgcggcgagggtgcaggctatgcaggaggcataatgtccgccgccgttgacggtctaaaagccgcaatgcagataatggcaaaacaagcaccatgcgataaataacaatataaaaatcgtttgttgtacaaaaattcgtacagcaaacgattttctattgtaggggcgaacactgttcgcccgtttacctatattttgtaggggacggcgcccccgacgtcccgtttgcattatttgtcaccctataaaccaaaaagggacggctagaccgtcccttaaatttttggatattaaagctcaactggctcgaatctgatacggatattaggaagcttcttgatctctgtgtagctgttcataagtccgtcctcaatagacagatcattctcaccgcttgcaggaggagcaaaaagtctgagagtcaaatcagcctcaccctccagcggcttctcaaagaaagctgccataaggtcgatcgtctttgcctcaggtgacttatagaaccacttgccgtttatctccatcatgatgtttgaatcatcatcaaatgtaacctcgcagaagtgtggattcttttcaaagtggagagggatctcaagaccctcagcgtcctcagaaccgccccaacgaagcgtgcatggcagtgtcacctcatcgcctcttgtcattgcaggcttgaagaaatcatcgtggattatttccttgtatgtcttcataacaggctgctcgataccgcagtcagcatagttagggtcttgaatctcaagaccaagacgtcctctgtctctgaactgatagaaagtaaatcctgagaaccagctctcgccgtcagccttgagcatatcgcagaattcctttaccattgctgcctgatcgtatggacctgtaacatcaccgtcagcgttgaactcgctcatgaccattggctttgtaacaccgccgtttatctccttgaatctctcaaaagaacgctttgtcatattgtatatgtccttgaccttgcttctgctgtggcttgtgccgcctctttcagcaacgtcataaggccaaccccagtgaagagccatgtacttatcaacagaccagatgtctgtctccttaacagcctgtgaaaactctgcttccttttcgatctccttcttattaggatcctcaactccgccgatacaaagaatagtagaaacgtttggtgcatattccttaagtatcttattgaaacggcagtagaaatcagcaacttcctgataagtgcatctcttgttgaatgagaaccagttgcctgtagcttcatggtttattctaagaagaagtctgccgaaaggtctaaggtcatttgcgatagcgataagctgttcgtctgaaacgtgtgggtcaactgtgagtgtgagtgtaacgtcctgtccatgacgtcttacatctctcatgaaggtaaaaggctcgccctctgtgttgccctcaagaccgcccttgtatgtgaaataatcatcatatggataatcccatgcaaaagaaatatcttcgtctttcattacctcagaaattcttccggggaactccttatccagcggatagtagcagtacataaggcttatgcttctgtgtggtctgcccattttgttaagaatgtaatcctgatttacatactctccacgctcagagccgtcgcccaaatcaacagcacattttgccttacccatatgcaatgagtagatcttgtattcgctcataaaatttcctcctattttaaagacaggactttcctgcctattctgttactaaaaaattcgttaatatcgtccaacacccttgcaagctcaaccctcggctcaacgcacataaaatccaggcactgccggaattttttcacgcatggacttggttttaagtttaccacaataagctcataaagtcaagaactgtggctcggctaacgttattaatgtaatttacaatataagccgtcatgcctaatataataaattcatgtttcatattcttatatcaagtataaaatcttctgattttaagccttaattcatacgaaagcaatgttaaaatctttatgttctaaagagtagtatagcagagcttaatacaaatttatagtgaaataaacaaataaataatgaattttcagtgaatataaaaagcgaacaggcatccacccgttcgctttaattgatatgattaaattaaatctccgagcttgtgtctgcactgtcgaccgcactctcagaaacctcagaactatccgcactgcctgcaaaagcattgctgtttttattctctccgtaggtagacatatacacctttgtgaattgtatatcctcccttggcttcagcgtctcagagtcagccacatcagcaccgcatatctcgtcataaatatccataccgtcatatacctgaccgaaaacagtatactgctgagagaaattcagcacaccgccatatttctcaaaagcatcggtgatatcctcagggatattgttgctgtctgcaagcttgctgtcaagctccgcctgctcctcctcggtaagatcatagttatcaacaaaaagaagatagctgtttgaaaccttcttcttgctgaacaagtgaccttgctcctgcgtgtatgcacaaagcgcaccttttaaaggccacaggttttttgaatactccgcctcgatagtagtagtgtcagtgtcagaagttgtctgaccgtcagcctgctttgttccgcctataaaatacacaccgtcctgcaccatgctcacataagtgccgtcataatagcccttttccacaagtccagtgaaaaacttgcaatagttcggtgcttcatcagggaaaagcacagccttgaaagttcccttatttgtttcaaaaaccaccacagggctgtcatcggcaggttcgtccatctgtatcacctttgcatcagtatagtctatatcgttcttgttgctgccagtgcaggcgtaaaagagaacaaagattataacaaagcaaattgctataagtgaaaactgaaaatacgtctgaaactgttttctgcggtatggacccagatcctgtttatttttgctcatttaacgctcctttactttttctttatctttgtgccctgtcttgtttcctcaacaatatagccaagctcgcctatcttatctctcagctcatcagccttagcaaagtccttagcctttcttgcagctttacgctcctccacaagtgccttgacctcctcagggatatcctcctcgccctcaccgctgttcagctttttagcagcctccataagtcccagtgaaagcaccttgtcgaagtcctcaataagtgcaagctttgtttcgttgtttgtgtcagccttgagaacgtcatacaaaacagtgatagcatttgaagtgtttatatcgtcatcaagtgccgccttgaagctacccttgaacttctcaaaatccacaagctccaccacctcgtcaggcttcttgtcagccataagctgtgctatccttgcagtgagcttgttgtatgctgtctttgcattgtcaaggttttcgtatgtgaaaacaagtgactttctgtagtgtgactgcaagcagaaaaatctgtataccagtgggtcatagccctttgactccagcagtgaaacagtaaggaactcgcccttagactttgacatctttccgctgtttgtgttaaggtgcagtatatggaaccagtagttgcaccacttatgaccaagataagcctcagactgtgctatctcgtttgtgtggtgtgggaaagcgttgtcgataccgccgcagtgaatgtcaagtctttcgccaaggtgcttcatggagatacatgaacactcgatatgccagccagggtagcccacaccccaaggggaatcccacttaagctcctgatcgtcgaacttagactttgtgaaccacagtacaaagtcagccttgttgcgcttgtttgtgtcctcctcaacgccctcacgaacgccgacctcaagatcttcctcattaaagttgtggaaaacataatactccttcagctttgaagtatcaaaatagatgtttccacctgcctcataagcatagcccttgtccataagagcagatatcaccttgataaaatcactaatacagcccgttgcaggctcaacaacgtcaggtcttttgatatttagcttcttgcagtcctcaaagaaagcgtcagtgtagaattttgcgatctccataacagtcttatgctcacgctttgcgcccttgagcattttatcatcgcctgtatcgccgtcagaagtaagatgaccaacgtccgtgatgttcattactctctttacgtcataaccgtcatagcggagatacttttccaaaacgtcctccattatatagcttctcagattgccgatatgggcatagtgataaactgtaggaccgcaggtatacattgacaccttgcccggctcgtttggtacaaatttttcgatcttgtgagtaagcgtgttataaatgttcatttatctttacctctttccttatattttactgctctttctttccgatcttttcaagctcagccactctcttttccagcttagctatctgtattcttgtctggcaaagctcctgagccacagggtcagggatatgcacctgatcgaggtcgcaggtgcgcttgccgttctgcttaactatccttgcaggcacgcccacagccgttgagtttgcaggcacaggctcaagaactaccgcatttgcggctatctttgcattgtcccccacagtgaatggtccaagcacctttgcaccgcaccctaccataacattgtttccaagagtcgggtgtcttttaccgtggtctttacctgttccgccaagggtacagccctgatacagcaggcagtaatcgcctatctcagcggtctcacctataacaacacccgagccgtggtcgataagcagacccttgcctatcttagcacctgggtgtatctcgatacctgtcaacattcttgcaaactgtgagatacatcttgcgatgaccttgtgcttgtgaacatagaaccagtgcgacaccctgtaaaaagccacagcgtgaagccccgaatatgtgaggatctccagcgtgctagttgccgcaggatctctgtcctttatagtttgaatatcatgctttatgttttccaaaatcgtcatatctatctctccctttctaagaaaaaacctccggaatggcgtttcaccactccggaggcagattatgatctacggtcccactccgattttctgtacaaaattttgtacagctcaatatctttaacgcagaccctacggagaggaatactaagctttcgccgttgttcgctccctgctgtcagccgcacttcactgaaagtccttgaagccttgcaccaaacggctcctctctgaaaattacctcacagctactcttgctgatacgcatttatatattaagttatcatatgccgcaacacgtcggcaggccacattatttgcccgaatctatatacttccagtatcccttgagataaactgcgccagaaatgactgtcagcacaacagctatccaaatgagtatctcgtttacaaggaatatcggtgttccccaagtgaaatcagggctgcctttttccgcaggattaacgatctgcaaaaccattatagcgataagcgcaaccatagtgaaagccgttttcagcttaccccatattcctgcagcgaccacaacgccctcgcttgccacaacaagtctaagacccgttaccataaactctctcgcaagtatcagtaccaccgcaacagggtctatccaacgttcaaatgtgaagcagataagcgccgtcataacaagtagcttgtctgcaagtgggtcaagaaactttccgaatgttgtaacaagattgtgctttcttgctatcttgccgtcaaaccagtctgtaattgaagctgcagcgaacacgataagcgcaaacaccatgtgatgcggtatcttgaaaagcagcacgaacaacagaaaaaacggtatcaatattactctaagcactgtaagtttatttggcaggttcatatcaaattcctttcatctacatttttgagccgataaggtcataatccatagtatcgtcaatttttaccttgacatactcgccgaccctaactttatcctcgctcaggaagaatatctttccgtctatctcaggtgcgtccgcctgacttctgccgtagtagcactcagcatatctgtcaaagccctcgcaaaccacctcgacttcgctgtcgagagcagcctcattaaagctgtcggaaataatcatctgttcttccattattatctccgctctgcgctctctgtcctttaaaggcacctgatcttcaaacttctccgcaggcgtaccctcctcaggcgagtaagcgaaacagccgagcctttcaaagcgaatttcctttacaaactcgcaaagctcttcaaactgctcttccgtttcacctgggaaacctgtaataagagttgtcctcagcgtaacgttcggtatcttttctcttatcttctttataagcgccgtaagggtctctctgtccccatggcggttcattcttttaagtatgttcctgttgcagtgctgtataggcatatcaagatactttacaagcttgtcctctttagcgataacgtccagcaattcgtccgttatcctctcaggatagcaataaagcgttcttatccacttgaagccgtctatctcacaaagtgccgtgagcaattcaggaagcatagacttgccgtagatatcctcaccatagcgtgttgtatcctgcgccacaactacaagctccgtaacgccgttctcagccagccagcgagcttccttgacgatatcctccatgcgtctgcttctgtattttcctcttatggacgggatagcgcagtaagtgcaattgttgctgcaaccttcggctatctttatatacgcatagaaaggctcagtagaaataattcttccgccctccatggaaagctcagtttttgcgccataagaacagaccgcctgcttatccagcagtatctctcttataatatcgcaaatttttccgttagagcctattcccacaacagcgtcaagctcagggatctcctttttcatttcgtcacggtatctttcagcaagacagcccgtagctattaccgcctttatcctaccctcctgcttgagagtacagaactcaagtatagtgtctatagcctcctgtttagccgactcgataaatccacaggtatttataatgaccacatcagaaagggctgcgtcagaaactatctgaaaaccctctttgcgcagatcatagagcatatgctcagcgtccacctgatttttaggacatccgagagaaaccattcccactctagttgccatgaaaaaatctccaatcctacaccgccaacggacggcataaagtatcacaataatctatcttattatctcacttttacacagttttgtcaagcccttttagtcactattgtatgacaaaaatcaaaatatttatgaaatttccacaaagtcaaaagcatacagaaagtaagtccgacatgatcccaaaagaaatccccgaaagctgcaactttcggggatttcgtttgtgtgtcactgtgaacacaatcaatctcgtggttacctatatcatacaccacgccatatattttgtcaagcacttttgcgccgtcagtctttcttctcaggatatgtgaccgttatctcagcccctgcttcctgcgaccaaacaacataatcaagctttccttcatcaataaaaacagtgaaatatgtatccttaagctcatcaggaagctgttcctttatcttttctatgaacttgtccgtctccgtggaaatgtagttcatgtactcaaacttgtagctcttgtcttttgaaagctccgtgaccgccttttctgccgcctcatataccgcctgagcgttagcctctgccttttccgagttttcgtcagttataattccgtctgcatatgcctgtgcctttgagcctgcaaagcaaactttccaatcattgtccttgtcaagcaccataagaatatactgcgatgacgtgacctctccctcagagctgtcataagctatggtcacataaagctccgccgcctttgaatactcctccgagatgttcaccttgtcgataaagccgcacttatccttgtcaaagctatatcttactccgcttatctgctcgtcctcaccgtattcattgtcgccgcccatgttctttttcatatattcatagtcagcggcataatcgtctgtcataagcttaaccattgattggtcaaactcagcgtttgcggctttaagatacattgccgcaacgtcctttgcttcttcaagcgggtcagcggcttcttcgctttccgtatcagttccctgcgttgtcacagcgttctcactgccctgaacattttccgcaggctgagagctgtctgtgccgtcaaagctcagcgaacagcctgtcatgatccccgcactcagtatagccgccgcaaaaatgatctttttcattctttgctcctttattcgtcgccgtactcctgttttatgtcagcaagcacctcttttattatgtcgtatgaatatcccaaacgcacaagggcgttttttacctttatgtcacccttttctccgtcaagatatctgagatactttcgctccacaagctcatacagccgctcgtatgtaccctcgctgtattcctccagagcttcctctattataggcttcgtaagccctttctgtctcatctgctgataagcacggtaatatccgtatttacgcacttccacataagtcctcgcaagcccttgagcataacgtctgtcattgactgtcccaagctccagcatcttatccattacagcgtcgcatatctcctcactgtaattcttttcaagcttcttgtaaagctccacataggaatagtccctgtaatcaaggagatacaaagccctttccttagcctttctgaactcgttgtcaaaaactatcttctcccaagcagactcaggcatatcaagccctgctctcagaccataggcagacactacctcgtagttgagaaaagccgtttcgccctcctcaaactctatcatgtatgtgctgcccttgtattttgaaacgcccgttattttaagcatttatcagtcaccaagctcgcttatgtccacaggagcgaactcctcgaagtcctcctcaggctttgccacaacagacttgtcgcttgccgccttgcgtatcttcttctcagacttgtcagccgacggttcttcatttgcactctgagccgccgcacctgcgttagccttttcttcaagcttcttggcctttttatctttctgcgccgcaagcacaagctccgcctgatgttcctttatcttggcttctatctcgcccatgatgtcaggattgttcagcaggaactccttagcgttgtcacgtccctgaccaagcttcatatcgttgtagctgaaccaagctccgcccttcttaacgatatcaaggtctaccgccatgtcaagcacctcgccaacacgggagatacccttgccgtacatgatatcgaactcgcactccttgaacggcggtgctaccttattctttaccaccttgcactttgttctgttgccaatgacctcagagccgttctttatctgctctccacgtctgacctctattcttactgaagcgtagaacttcaaagcacgtccgcctggagtagtttcagggtttccgtacataacacctatcttctcacggacctgattgataaatatagccgttgtattggactttgcgataacagatgtgagctttctcatagcctgagacataagtcttgcaagctgaccaacgtgagtgtcgcccatttcaccgtctatctcagactttgttaccatagccgcaaccgagtcgataacgatacagtcgatagcacctgaacgtgccagagcctcggctatctccaaagcctgctcaccactgtcaggctgagaaacaagcatattgtcgatatcaacgccaagctgacctgcataaacagggtcaagagcatgctcaacgtcgataaaagctacctctccgcccattttctgcgtttctgcgataacatgaagtgcgaccgttgtcttacctgatgactcaggtccgtatatctcaataattcttcctctcggcacgccgccaataccaagcgccatatcaagggtcattgagcctgtcggtatagcctcgatatccatagccttagcctcgccaagcttcatgatcgcacccttgccgaactgcttttcaatatatgctatcgctgtgtcaagagcctttttcttttcctctgcgtctgttatttttactaccgtcttaacggcttcttttttcttcttgtctatcgccattttatatgacctccctatcttatcggtgttttatccgtatctatatcatatcacactaactgtccgtttgtctgtacagtaaccgcaatttatctatctgtacaaattttcgtactatttctcataaatgcccgaaacacagcggtaaacaccgcacaagtctttcctgcatctcacgttcttaaagccgtgctgtatcatcaaccgcattacttcgtcctcctgaccgataccgatctcaaagagcataacgccgccgcttttaagctttttcttccacttgcgaactatctcacgatagaagtccaagccgtcctcaccgccgaaaagagcttccgcaggctcaaaagtgacctcacgctgcaaagcgtccatgtcctctgttgtgagataagggggattgcacactataaggtcagcctcaggcattttctccacaagcttttcgtctgtaacgtcgcccatgactatctcagtccccgagccgttcagacttatattctcacggagatactctgccgccttttcagacttttccacacacactgcccgaccgcagtcaagtttcctttcaagggtgataccaatacaccccgagcctgaacaaaggtctataacagtgatatccttcttgcctgcaaacatcttcaaagccgtgtcaacaatagtttccgtgtcctgacgtggtatcagcacgccctcgcccaccttgaaaggcagaccataaaactcccactgtccaaggagatactgcaaaggatagccatcacagcgacgtgtgacaatgtcgcttatacgcttttcctgctcaggagtgatatcatccccctcagccacatcttcaaacacccatgtgacctcgcagacagcgttctcaccaagaccgctttcttcaagcagtcccacacatttatcaaacagtttcttttttaccatttgtcatcttccttattttcaggtatacaagctttcagtgctgcgatcgcacattctatctgactttcatcaggctcgcttgtagttatcctctgtatccacagacccggtgcagagattatcttagtgaaaatattgtcatattttcccgcaagccttataagctcgtaagcaatacccgtaacaataggcagaagcgctatctttataacaactctcagcaaaatgcttgcccatgatactctgaatattgtgtttacaaaaatgcttatgaacagcacaaggaaaataaagctcgttccgcagcgagggtgaaaacgtgtgtatttcttcacattctcaaccgtcagctcttcttcatgctcatagcaagcgatagtcttgtgctcagcaccgtgatattcatacgtccgccttatatccttagtaagagcagtcaaagccgtgtagcctatgaaaatagctatcttcaaaataccctcaataaggtttttgccaaatgccgacagatgaacaaacttgcttatgaatttagacaccaccgacggcagatacataaacagcaatatcgccagacccacacccagcaccatagatatcgccgtgatgataggaccgagcttgtccccaagcttatcgtccagccactgttcaaacttggtctgctcctcctcatcgtcctccgtcatctgcttctcagccgaccttgtaaggcacttgtagccgtctataagagaagtaaggaagctgaaaatgcccctcacaaaaggcgttttcctgtaccaaggcgtatcttttccgccttttatcgcccactcctccaggtctatggtgccgtcaggcagacggcaagccatagccgccttatcgatgccacgcatcataacgccctcgataacagcctgtccgccgatctttgacttgaatttttccttgctttgtgctttactgctcattttctttcctttcaaggcggtgtgtgcgtctactgcacgttgtcgttgttttcgataggctcagaagaaataagctccacgtctacagttgcctgattgtcaggctttttcttctgctcgatacaagggagcgttatcatcactgttgtacctactccctgctcactgtttatctccagcgtaccgccatgccgctgaatgatctcgtctgccaccgcaagacctattcccgaaccacgtcttgtgtggtttgccttaaagaatttcgtcttgacctttggcaggtcatcctttgatattcccatacccgtgtcggaaatggaaatacatacctcattgtcctcctcataagcctccaccgatacagtgtcgcccttgttggagtatttgatagcgttgtccacaatatttatgaacacctgacgaagcctgttcttgtcaccgtaaacaaacggcagcattttcggctcgtagtaattgagtgttataccaagcgccttggccctctcctgatagataagcacagtttccccaagctccgcaagaatatctatagtatccataataagcgtgagtctgttgtcctgtatcctcgaaaagtcaagaagctcctcaaccatttgcgaaagcctctccgtctcacttgtgatgaccctcatacccttcttgaaggtttccttgtcctcatacatactggtaacagtttccgtccagccccttatagcggtaagcggagttctcagctcatgagatacagaggatatgaactcgttcttcatctgttctgtattagaaagctcctgcgccatgtagttgatagagtcgcaaagctcgccaagctcgtcatttcgtttcttttcaagacgttcgctgaaatctcccgtagcataccgccttgttatgctgtttatgcttcttataggcaaaacaatagatttgataaaaaacattcccgagaaaaacatgagcattatgacagccacaacgatagccgtgattatcatagacataataaaaatctgatggtcgatatttttcatggaagacaacattctcagtgcctcatattcgcttcccttcggagatatgaccgacgttatcgccatgaccttttcccctgttgacagctcatatatctgtgtgcctattcccgtgtcggacttctttgcgtcctcataatcggtcatgttgtcattctccgagggagagaagcctgatgacgtaacatcgacctcaccgtcggtcttgatagccataagctctatcttgtctttctcgtcatagctttccacaagagagcgtatctgagaattatagttagtctgctcgtcacctgaagcgttcactaccgccgtggtgactatcttcattttagatgtaagatactgccttgtggagctgtagtaataattcctcaccaccacgataagcagtatttcaagcaccacaagtattcccacgaccaccccgagattgttcctcagccagtgctgtgtgatactgagtctgccgctttttcttttttttccgctcaactgataaaaactccgttcatcatgttttcacagctcagttagagccgcctgcccacttgtagccaaagccccatatagtaaggatatacttaggattagaaggctcgtcctctatcttcattcttattcttctgatattcacgtccactatcttatcgtcgccgtaatagctctcgccccatatgtgattgagtatacttgaacggtcaagtgcagtattctgatttttgaagaaatactccattatctgatactccacctgtgtaaggtctatctgctcaccgttcttgaaaacagttctgctcttaagattaagggtaaatggacctgaaactatctgtgaagcctcctcaggcttagagcctgaacgatttacacgcctgcaaacagcgtcaactcttgcaataagctcagaaatagagaacggctttgtgatataatcgtcagcaccgctcataaggcatgatatcttatccatttcctgtgattttgccgaaagcatgataatgccgatagtgttgcttttctctcttatcttcttgcacacctgcattccgtcgatgccgggcatcataatatcaagcagagcaacgtcaaaaccgccgtccttttcgtcataggctttgagagcgtcctcaccgcagtttacgtcaactacctcgtaaccgcttcttacaaggtttatgaccacaaattctctaattgaatcttcgtcctcgcaaaccaaaactcttttcattacatttactcctctccaagatcagtttattatgtaaaaattattctgaatttcgtcaatagtcggtatgagcttttcacgcctgtcaagaggaagcttcacaaaataatcaagctgacccttgctgtcgataagctcatatccgtcagagatataatcctccgaatcattctttgaagacactgcgatacgcattatctcctcgttgctctcgtttatatctcccgtgtatttatagaaaacaagctcgtttgtgtcgctgtactttttcaccgtaacagaactgttccagcgttttgggaacgttacaaaatatccgtcagatatggcataatagcctgtgtattttgttttcagatcataaaaatcctcgtaaacgctccatgtagtcatatagagcatttcgtctgccacagcgttttcataacccaccataggcgaagttgacggtatctccacatcaccgtcgccgtccatgtcctcactgtagtagcccgctggtcttgtgcataaaggcagcagcttttcgcttctaagctgcataggattttgaagtcccgaatatctgtagtatattatctccgtctgcaattttccgtcagcagtcagtccgtcaataaaaatagcacgcctgccgctgtcaagcattcccgtctttgatgatacataagaagtcacattatcgcacatatcaacgttctcgccacgggttatctcattgtttttcatgttgagcatagaagcctttgccgtcaccgcacctgtatcattattggtgcttctctgaatggtgataagctctatataaccatcattgtttatatccaaaggctccagcaccgaataagtatcaagcgccacacgcttgaaatctccgtcggtatagctgtatatctccatagtcttttcatcattagtaagattttgatatcccacaaaaacgtccgtctggttattgcttcccataggcgagataatgacctgatctatgtccgtacctgcgcccgcaagctctttcacagaataccacttgccgtcctcgtccttgtcgagaatgttcaccctcaagccgtcctcctcagatccgtttgaagtgtactcatagaagaccatagcctcgtccgtaggctcatcgtcgatatttgcgataacataagccgagcggtattcaccgtttttaggatatttcagagttatattgctgcccacgctctcgataagcgcctgatgtatctcgctttgctcagaggtaagcttcggggcgtttataagtccctcaacagaaaaattcagtgccgaacagcctgtcatagtaagacaagaaagacaaacagcagccaatttaagatttttcaagcgatccctcctgatacaccaaacaaaaaaatagaaccgggcatatacccgattctattatatcatatacacaaaaatatttcaagcctttttccgcccattaggaacaggtaaaaattattttgcttatctttcgtccaatgggatatacttcttctcacctgagatagccttatatgcaggacggattatcctcttgcctgttacaagctcttcaaatctgtgtgcgcaccagcctgccattcttgaaacagcgaacataggcgtgtaaagatcctcaggaatacccagcatgctgtaaacaaagcccgagtacatatcaacgttagcgcacatcgccttgtcactgcccttgatcttcttgaacagctcaggagtaagtctttccaccgcttcaagaagcttgtattctctctcaaactcagtgttctcagccattttcttggcattctctctgagtattacagctctagggtcagacaatgtgtaaacagcgtgacccatgccataaacaagacctgtgtggtcaaaagcttccttgttgagtatctttgtaaggaaatcagcgatctcgccctcgtcctcccagttctgaacgttgtcctttatgcactggtgcattgccgccaccttaaggttagcgccaccgtgacgtggacctttcagtgaaccgatagccgcagagtatgcagaataaggatccgttccggaagatgtaagcacacggcaggcaaaagtcgagttatttcctccgccatgctcagcgtggagcataagtaacagatcaagtatcttagcctcttcctcagtgaactgtctgtccggacgcagtgccgacagtatcatctccgcagtagaatgtgtaggtatcagagggtgcatgaacaagctttcaccgtcataacagcgtttctttacctgataagccgaaaccatgatgttaggcaatttagagattatagagatagccgtagccatttcatactcaggagaacgattctcagggttatcgtcataagagtaaagagccagaattgctcttgccatcttattcatgatgttctttgacggagctttaagtatcatgtcctcaaagaagttgtcagggaaaggtctgttttcagccatcattcccttgaacgcagtaagctcctccctgttaggcagatcgcccatgagcagcagatacactatctcctcataaccaaaacggttctccttctgagcgttggacaccagatcattgatgttgtatccacggaagataagctgaccttgaataggagatttctcaccctcgtttaccacatatccgtgtacgttacagatattagtaagaccagccataacacctgtaccgtcagagtttctcaagcctctttttaccacatatctgtcataaagcttagggtcaatagtattgtttgctataaactgttcgcataaaagcgaccttgctgcattatttatcattgaatagatcatctcgctttcaagtatattataaatataagttatattatacacctttttcagatttttgtcaagtattaagataacctgtcaaatcaaaaccgcatatctccgccatttaaaaatttgcagtacaaaaattcgccctgtatgaatatttgctccactgcatgaatataatatagtaccccaaaaaaagaaaggacaaaccatatgaaagacctgatacagataatggcagtatttgctgttatccttacaataataccgaccatagtatttcttcgcccaaacgagtccgcattgaaacccgcattttcagaaaaagaaaaaatagccgtatatttcaccgaaagcggcaagaccgaagacttcacccttgaagaatatatgataggctcagtgcttgcacaaatgcctgcggactttgacgaagaagccctgaaagcgcaagccgtactcgcccatacctacatatgccgccgacagctctccgaagcccagtcgcctactcctgccttaaaaggcgcactcatcagcgatgacagcaccctctaccaaagctatttcaccgaaaaggcagccaaagaatattacggcagcgactatgaaaaggcatacaaaaaggtaaagtcagccgtgcagtcagtggaaaacgaaatactcacatatgacggcgaacccataatcgtcgcctttcacgccgcttcaaacggtcatacccaatccgccaaaaacgcatggggagaggatatcccatatcttctgtcagtagacagctccgctgacaaagaccttgtcaccacagaatgtacccagacactcaccgccaaggattttcaagacaagcttcttgaccgcttcccagatattaatttcactcccctcgccaatgctgatagttggctcaaaacaaaaacagacggcataggctatgtaacgaacctgaccgtctgtggctatgatatacagcccaacacattctgcgatatccttgatatctcctcgccatgtttcgagttcacctttgccaatacaaaattcactttcacctctcacggcttcggacacctcgtaggaatgagccagtatggtgcaaatgccatggcagaaaaaggctcagactaccaagccattttgacccactatttcacagatacaaaactgcaaaaatctactgagctggcacaactgcaataaacacaaggtcgctgtcgccgtcattgataaagctatgctcatgaccctcaggacagtaatggaaatctcctgccgacagtctttcctcaccgccgtcataaagcattttgccactgccctcaagaacatatatcatctcgcagttgccctcatgtctgtgcagaccgatagacgcccccggcacgagcctgcctttcatcatcttgttctttccgtcagaataggccctgcttgcaaagcttttttcgccgcccttgaaattcggtgcaaggctctctttaatatcatcaaaaactatacgcataaaaaaacacctccgcagtttataaatcaattataccactacctcgataaaaaagcaataaaaaaagacccgtcccgaaagacaggtctttaattattctaagtaagaattatctgaattacagattactttctcttcttagtagcaactacagcagcaccagcaagtgcaacacctacagcagcaagagcagcagcgcctgtgcttgggtttgtgttagatgcgttgttagcagccttagaagatgtagcagcagagttagtcttagagtccgaagaatctgtgagaataacctttgactcgtcagaatctgttgactctgtagaatcagctgttgactcagaaggagctggagcgtccttaagtgtaagagcctttacgcttgtaaccttagctgcaaaaggaatatcgtcatctgttgcagcctcgaatgcagactgaagatcaaggaaaagatcgccgtctactgtgagtggctcgtcaaacttgagcaggaatgtgtatgagccgtcagcgttaactgttacagcctctgttgagcaacccttgttagctgcgttgccctcgccccagtactgaggaccattgtctgagaagatagcgaagttgatagcgaaatcaacaggatctgtgatagcatcaaattcagctgttacagcaatagcgtcaacaccctcgaaatcagcaggtgtgatgagcttgtcaacgtcttcgccccaaggattgttaacgttaactcttaccttaccagtgtcaaccttagccttaccattgcctgcgagtgtaacttctgtagcatcatatgcgctgaggtcaacagagtttccacctgggtttacgtcagtgccctcgatctccttgccgtccttgtcgagaagaacgatcttagagaagtcgatgtctccgccccaccactcgctgaaagcgatccgagcgtactcaccctctgtatctgaaacgtcaacgtctgtccagaaaggagtcttctcaagtcttgtgatagactttgtatttgcatcatactgaatgtcgtgtgtctcactttcaccgcaaccattgcaccactgcttctgattccagttgttgctcttagagctgaaaataaatccgccacctgcgccctgctcaacaacacctgctgctgaatcagagaagtaagctctaacgccataaacgtcgctgatcttgatattgtttgcctcagtaagagtcttaacatcatagatcatatttccgtccttatcagcacctgtgatagctgcggaagcacccatagtcatcattgaagctgcgagagccatagctgacataccagccaaaatcttagagattttcatttgtttttcctccatttttgttaataattttttagatacatattgagcgatatctcctcaacatacatcttgcctatattgtaacacacatttacaagtatttcaataaacgtttttcacaaattaaccacaaatctttagccacttttcacaaatttgcatattatttttgctacatacagccaaatatattatcaaatcatgtacaagcattctatataacgttaatatttttatatttattcagattttgttgtaatcgtattcagcctttcacgctctctttttgaaaagatacaaccgcagtaatcctgtctgtaaagcccgtattccgctgaaagctgaatggaacgtttgtagccctcacgcttcttgaaatccgcaggaagtgcctttacatcatatatctccccaagctcctccgatatctcgttgagcttctgagcattcttgtagggtgaaatagacagagttgtggtaaaataatccgcaccaagctccttggcaagctgagccgtacgttcaagcctgagcctgtaacagcgaaagcaccgctctccgccctcaggtatatcctcaaagcccttaacagcctgaaaaaactcaccctcgtcatacccacgctccacgaacgtaacaggatttttcataggcatttgtgcaataagcctttgaagctccgccacacgcttatcgtactcctcacggggataaatgttcggattgtagtaaaacacagttatcttaaaatactgcgacagatattcaagcacataagaagaacacggcgcacaacagctatgcaaaagcaaagtcggcacttcgcgcttttcttcgtgtttttttataatgccctccagcattttctgataatttaccttctgcattcctgccgctcccttttcgcaaaaaaatcgtacctgacacactcccgtaggggctggcgtcctagacagcccattcccattgtccttgcgtccctacagtatcatactatattatatagtatagcacatttccgcaaattccgcaacaggtcagatcttcaccttgaacttatttgcacagttagggcatttcacagtatgttcaccctttacctttggaagccttaacgtctttttgcatacaccgcactttatataaacatgggtctttctgtcagcgaactttctcttccagaatgaaaatttcctgccaattcccccgaaagccctctcaaacttcatgttctcctcgtatcgcttctggcagtttcttgacatcgccctcactaccgccagcaccagcacagcgtataccataagctgtaaaacaagcgaccttacaaacaaattcaccgcactaagcaccacagccacaccgcaaatgccgtaaaaaagcttgtctataccatatctgccctgaaaaaatctcgctaccttatacataaatccgttcataagcttttacctcttttcttttttatattataaatagtacacccgaaatttaaactgactattaacttttatcaaatttcacctacctttcacaaaactttcagcgttcaccctcaaacagtgaacggcatatactgaagtgtattcgtaaaagcgtatacggacaagtacagcataaaggagcaacaaaaatgaaaaagagtcttatagccatgacttccataacctatgcaatgaaagcaaaaaacttgctgaacagtttaaaatactactgcgaaatacagcgcactccgaaggaccttggcacaggctgcggctactccatagccgtcaccgcacccccggaagaaataatagccatacttgaaaaagagcgcataccattcagaaacgtgatattcgagcaaaagaggtgagaaaaataaacacccgaagcataataaactttgataactccgccaccacctatcccaagccccctgccgtagcaaaagccgttgctcaggcagtagaacgctatggcggcaacccgggcagaagcggtcacaagctttccatgcgagtgtctgaaaagatattcaccgtcagacagcaggcggcagaaatgtttggggcacagaccgagaacgtggctttcaccgccaactgtacccatgcccttaacatggcgataaaaggtgtcatgcagtacggtggtcatatgataatctcagaccacgagcataacgcagtagcaagacccgtctatgccctttcaaaaacaagaggcgtgaaatattcttttgcccgaacaggggaaacagacagcgaaacagtagaaaatttccgccgccttataacccccgaaactaagtgtatctgctgtacagtggcttcaaacgtcacaggcaggctcatgccataccgtgaattagccgccctctgcaaagcccacggcatatgctttatagccgacggcgcacaagcctgcgggcttttgaagctttctctctcagacggcttcaactttctctgcactgcaggtcacaaagccctctatggcccaacaggcacaggactgctcatctccgacggcgagtattctctgtctaccataatcgaaggtggcacaggtgcgacctccgccctgcttgaacagacccctttcctccccgaaaagcttgaaagcggcacaattaacacagtgggcataatcggtcttggcgaggggctaacgtttgtccgccaaaagactcctgccgtaataaaagcccacgaagaaaaactctgcaaacagctctacgaacagctttcagacatagacaaaataaagttctatgaagcagaccaaaagaaagtccccatactttcatttaacatcggtgatatcccttccgctgagatcgcctcctatctcagcgaaaaaggcttcgccctccgtggaggacttcagtgtgccgccgtcacccataccaccctcggcacgatagaacaaggcacagtgcgtttctcaccctctgcattcagtacccctcagcaggtaacagcactttcacgaacaataaaaatatttgccgcaaataactaagcataagtggcaggtctgatgtaaaatatcacgtcctgccgctcattctattgcaaaaagcacctttaggtgctataataaggcatgagcaaacaatttttcacgaaagaaagtggtattatgtggttcgtgtttgcgcttctctccgctgttttcgcagcgctcacctctgtccttgcaaaggtcggcattgaaggagtaaactcaaatcttgccactgcactgcgtacctgcgttgtgcttgctatggcatggctcatggtgttcatcacccacacacaaagcggcataggctctataggcagaaaaagctgggtattccttatcctttcaggacttgcaacaggtgcttcgtggctatgctattataaggctatccaaatgggcagcgtttcaaaggtcgcccccatagacaagctcagcgttgtcatcacacttatccttgcagtgatatttctccacgaggacttcacagtaagatcagccataggtgcggtgctaatcactgcgggcacagtattaatggtactataaggagaacgccatgataataagaacagttaccgagaaggacgctcacgaacttcttgaaatataccgtccctacgttgaagacaccgccataacattcgagtatgacgtcccctctgtggaggagttttccgactggatccgccgcatatccgcaaattatccatacatagccgcagtagaaaacggcaaaatagcaggctacgcctatgcaggtgttttcaaaaacagagccgcctatgattggtcggtcgaagtcacagtttatgtaaaaaaaggacttcaccgcaaaggcataggtgcaaaactctactccgcccttgaaaagctccttgcggcacagcatataacaaacctctatgcctgcgtcgcctatcccgaaaaagaagacgagtatctcacctttgacagcgtaaagttccatgaaaaaatgggctatactataataggtacgttccatagatgtgcctttaagttcaacaagtgctatcatatggtttggctcgaaaaaatactcacccagaccgatatcacccctctgcccgttatcccattttccaaactcgataaagccttaattaacaaaatagttcttgaataaaggcagagaatatggtaaaataatatcattctgtttgttaaggagcgcaaaaatggatcttcaggaattaagaaatgaaataaacgatatagacagccaaatgcaggagcttttcaataagcgtatgcagataagcttcaaggtggctgagtataagatagcaaacaatatgcctgtttttcagagcaagcgtgaaaacgagatacttgaccatgtagcagaaagctcaccaaagggcttggaaagtgcgtcaagagtgttcttccaaaacatcatggatatttcaaagtgccgtcagtaccaggagttttttgcagactcagataagatagagtacaaaaagttggacttgacaggtcataaaaaagtcgctgtacctggtaccacaggctcatattcacatatagcctgcaagcagatattcagcgactttgagccaatgttctttgaagattttgaggacgttttttcatcagttgaaaacggctcagcggatttcggcatacttcccatagcaaattccactgcaggctcagttggtcagacctacgagcttatgaaaaagcatgacttcaagatatgcgcagcaactaaggtaaagatctcccactgccttgccgtaaaaaaaggcacacgctttgaggatatcaaaatagtctattcccacgagcaggcgctcagccagtgttctgagtttctttctcagaacggacttaaaagccataaatacgcaaatactgcccttgcggcgtgctacataaaagaaagcaatgaaccgtatgccgctatctgctcagaagcctgcgcacagcagaacgatcttgagatactcaggcataatatagccaacgccgccgagaattacacaaaatttattctcatttcaaaggagactctctgctcggaaaatgctgacatcgtgtcagtgtccttggcactgccacatacctcatctgcactttacagacttctcaccaaattctccgtggcaggtcttaacctttccatgatagagagccgccctatcgcaaacaccgattttgacgttgttttctatcttgattttgagggagcaataacctctcctgacgtggcaaagctcatgagcgagcttaattcagagctttcatatttcaaatttttaggcaactacgaggaaatataacagtacgatttttaggacaggaggaacaaaaatgcgtataggacacggctatgacgtccacagactgaccgagggcagaaagctcattctcggtggcgtggatataccatatgaaaaaggacttttaggacattccgatgcagacgtccttgcccacgccataatggattccatacttggtgcattggcactgggcgatatcggcaagcttttccccgataatgaccccgactatgagggtgcagacagtatgaagctcatggaaaaagtcataagcgttatgaccgaaaaaggctggaaaataggcaatatagactccactatctgcgcacagaagccgaagcttgccccatatatcacctccatgcgggagcgtatagcagaaacctgcggctgcgatatttcacaaatatcagttaaagccaccaccgaagaaaaactaggcttcacaggtgaggaactaggcatatccgccacagcggtctgcctgcttaaaaaaatttgatacaaaaccaaaaggactgctgtcttaaaccacagcagtcctttttattgctactttgccttatgcgcaactccgtcattgttaatgttatatccgtcaacagaagtgtttatgagcatcattccataatcattgaaataatatcgctttccgcctatctttttccaacctgtcacaacagtgccgttcttgttgttgtagaacttctgcccacgccagcttacccagccggactttagatatccgtcctcaccgaagttgtaatacttgtcgtcaatgtacacaggacctctcaacgcaacaccattctgcaggaaatatttctttcctgcaatagtcgtccattcattctgcaaaacatgatcgctgtcaaaataaaactccgttccgtctatttctctccagcctgaaacagccttgccatcgccgtcaaaataataggtcttgtcaccggctgttacccacttgtctttctgagcgccgttcttgtcaatgtagtaaagccctgaatcatcactgaacagcccctttgaaagcttgccgtcattgtcaaaatgatacagcttgtcttcaatagtgtgccaacctgtaagtgcagcctcgtcctcaccaatgtagtaaatttttccctttgaagtaacaaactccgacttagcccaagagccgtcctctttcttgaacttccattcagcgtctattttaacgatcccgtctgcaagcacgccctcgtttgagaaggtgtatttcttgtccccgtcctcctcaaattcgccaacagccgccgcacctgtcagaccaaaataatatctctttccgtcaatggtcttccagcccgtagccttcttgccggtttcctcatcaaagtagaagtaatagccgtttattttatgaaatccagtgcaaagagtgtgatcagagtagaaataatactgatagaacaccgcccctccgaacttttcataaacctttctgtcataagcattgaatgtcttttcgccgaatttgtccgcaagctcctcaagcttttgggtctctttttcgtcaggcttctcgtcctttttgtaatcgtccttctcaaacttcacaagctttgatacattggatttgaactcttttattttctttttctcatcatcagtgtactgatccgtattcgtccaacctgttgccgccacatgagtcgttttgtcaaaatagtaagtatcttcgtcaatatcctcccagccgtcagcaacaacgccgcctctgccgaagtaataaacatttccgcctatctcgttccagccggagaggaggcgatttttcttatcaaagtaataatacttgtccttgatcttggtaaagcccttgcctgccgagccgtcgcccttgaaataatacttctcaggcggttcttcataccagcccttagtcattttaccgtcatcagcaaaatgatatctgttcttgtcaattgttatccagcccttgaccatttcacagctatcattgaaataatagctctcaccgtctatctccgcaaagccctgagcgcaagcccctgtagcttcatcagaataataatacttcttttcaagctccatccaacccttgtgaacagcaccgctctcagaaaaataatacttctttccgtcaatgtcctgccagcctgtggccatgtgaccgtcgtcatcattaaaatagtatatcttgccctctatctcaacaaagcccttagccatctcaccgctcttgagaaaataatactgaacattgtttatctttgcccagcctgtcacacgcttgccactctcgtcatagtaataaccgccgtcgctgtcaaaacccgtgtcagggaagccgtgatcgtcaaagtagtattcaccgccgtttatctcgcaaaggcccgtcctgaaaatgccagactcctcagagaaatagtattcctctccctttattttcatttttccacgctgaacaacgccatccttgacataataagtgtccccacgatacttgtgccagccgtcagccatagcgtttcccttgtcgtcaaaaagatagcaggtgttgtctattatctgatagccaagcgccttttcgcccgtctccttgacaatataataagtcgagccgtcatgggtgtgccagcccgaagcataataagcgccgtagtataaatatccgccaaagcctgctcccataacgatagtgcaagctgcagccgcagcgatcatttttttcttatcgcttttcagcacctcattatatctgttgcaaaaatcattgccctcattgctgtttatactcataaagatccttcctgaatttacacagttctagttagtacaattatatcacaacaaaataataatttcaataccgccgccccaattttcacacccctcacacataaaaagctgcacagtccaaataactgtacagctcatagaataaatacccaagataaatgtgccgtcgaggactccagcccctacaatctctcatgaccgcaatttatctgtagtggcgaacaacattcgcctgtccacccccacaacatctcagatataccacgacccccacgcccaaagctttctcgccctctcctttgtctattctgacagataaattactcatttcttacatcacaatacttgcgttcatacagataatatgttataatatataatgtatatttataaacctaaaggaggcttatttatggatcagcttataaaattactgaagaacaacgcacgtatcacaaacagcgagcttgccgttcttcttgataaaacagaagagcaggttgcagcggatatcgccaagcttgaagcagacggcgtaataaagggctattccgcgatcgttgacgaaagtgcctatgaccctaattcagttttcgctcttatagaacttaaagtcaccccacagtcacagtcaggctttgacgagatagcaaaccagatcgcaagctatgagcaggtggaatccgtccgccttatgtcaggtgcttatgatataatcgttgccgtgaacggtgcaaacatcagggatatctcacagtttgtttcccaaagacttgcaactatcgacgctgtccagtccaccgccacacacttcgtgctaaaggtctataaagacaacggcatcatgataagctcagatgataaagacgaaagaggtttgatctccccatgatagattataataaagtgctttgccctgccataaaggaaatgaagccctcaggtatcagaaaatttttcgatatcgcacagcagctggagggcgttatctcccttggcgttggcgagcctgacttcaaaactccgtggctaatacgtcaggaggctatctctacccttgaaaaaggcaagacctgctataccgcaaacgcaggtctgatcgctctccgtgaagagatagccaagtattttcagcgtactatccacacaagctatgaccctaataaggaaataatcgtcactgttggcggttctgaagctatcgaccttaccataagatgccttatccaacccggtgatgaagtccttatagtcgaaccgtcctttgtctgttatcgtcctatcgtctccttatgcggcggtgttccggtggtcatagaaacaaaggaagaaaacgagttccgacttacagcagacgagcttcgtgaaaaaataaccgacaaaaccaagctccttgtcctgccttatcctaataacccaacgggggcgataatgcgccgtgaagatcttgaagctatcgcaaaggtgcttaaagataccaatatcatgatagcctcagacgagatatattccgagcttacatattcaggcaagcattgctctatcgcagaaatagagggtatgcgtgagcgtactatcgtcataaacggcttttccaaaagctttgcaatgacaggctggcggcttggcttccttggcggaccaaaagagatagtgtcccaaatgctcaagcttcatcagtatgctatcatgtcctcccctactgtcagccagtatgccgctatcgttgccatgcacagttgtcagaaggatatagatgccatgcgtaacgagtataatatccgccgtcgctttgtggtggattctttcaataagcttggtcttaaatgctttgcaccgcaaggcgcattctatgttttcccttgtatcaaaagcacaggcatgacaagcaccgacttctgtgaaaagcttgtgtacaccaaaaaggtagccgtcgtgccgggagatgctttcggcgagtgcggagagggctatgtgcgtgtctcctacgcctattcccttaaccacctgagagaggctatcaaacgtatcggagaatttttagaggatatcaaaaatggtaacgtgcagtaatttaaaaataaaagcctacggaaaaataaatcttgcattggatatcgttggtaaacgtgatgacggctaccatatgctaaatactgtcatgcagtcagtgtcctgcttcgacctcctggactttaccctctcagagggcgagggcatagagcttacctgcaaacttgacagctttccaaagggcgaggataatatcatcacaaaagcctaccatgcctttgccgacttcacccatgttgacttcggctgtaaaataacagtgaatgtggagaaaaacctcccctcacaagccggcatgggcggaggaagtgcagacgccgccgctacccttagagccttggacttcatgtttgatacaaggctcaccgatgaacagctctgctccataggcgtggctctgggtgcagacgtgcctttctgtattacaggcggcacaaggctctgtcagggcgttggcgaaataatgagcaacctgccctcacccgactgcgctttcgtcataataaaaccagacgtgggtatctccacccccgaagctttcaaaaaatatgacagcatttcaaacccaaaacgctgtaatatggacgtcctgctgagatatatcggcggcggaaagcttttcggcatatgctcaaaccttttcaatgtgctggaatatgccgccgaccgtgaggagataactcatgcagtgcaggagcttaaaaacagcggagctctctccgcccttatgacaggaagcggctcagccgtttttggaattttccccgatatcgcttccgcacaaacagccgcagaaaagctgtcaggctggagctataagtgcgtttgtcagcctgtaaaacagggctgggaatttgtatattaatgaggtgaaataattgagcagaaataaatgcagaatttgcggataccactttaaaagcgatgatgagataatttgtcctgagtgcttcacagcccgtgacgaggatataagctgtaacagcctttcagatgacctgcactctcatgatctccgtgccgataacgagcaggacggctggttcggtcagtctgaaaatgacaccttcaaagaagaaaagaacgatttcgtttccgaggaacgtaaagaggaagcaagggacgagaatttccaaagcacctataccccacctaaaaacccgacccctcccccaagctattcaaattcaagagccgaaaagcttgccgccctcaataactacagccaacagcgtacaagctataaccgcccaaacaacagctcctatagcttcaacgccactaacataaaccactctaacaaaaagaatggcggcaaaggctgtgccaccgccgttgtggtcataataatccttatggctatcctcccaactatcataggctttgtctcatcaaaaataatttcaagcaaatatgacgactataactatgactacgattatgacgatacctatagtgaagccgaagatgactacaccgaccattccaacctctatgtagcgcaagacgctgaggacggtacctacagcgttcagtatcaaggctataccctcaccgaacgcaaagtaagcgacctgaccgatgaggaaagaaactccctttcaggcggtattataagcggtgacacagtatgggaaatagacctcgaccttgatgttaatatcagcgatagcaacagacaggtaaaattcacctttgcctacaacaccgcctatgacgagaacgataattcgtttttctcaaacaacttcttccccggtgaaagcgactacgaagacgataagacctatacgatcaagtttcttgtcccagccgattcaaagcgcaccacgttcacagcctgcttccagaacgacgattttataacagattcattccagttcaatatcccccttgacgaaaacacagactcatcaggcgacctatcctctgactcctacaccaaaataagcggagttgacacagcggcatgaacgatatccttaaaagctgtaccctctgcccaagagagtgcaaagtgaacagatacgagcataaaggcttctgcggtgaaactgccaaagtaaggatagcccgagccgagcttcatatgtgggaagaaccttgtatcagtggcacagaaggctcaggaacagtatttctctcaggctgctgcctgaaatgctgtttctgccaaaactacgagatatccgctgagggcaaaggctttgagcttaccgagcaagaacttgcagacacttttctgcggcttcaatcaatgggcgcaaacaacataaacctcgtcaatcccacccatttcgttccgcaaataatcaaagcgctcgacctctgtaaagataagctcactatccccgtggtctataacagcggcggttatgaaaagccccaaacgctggagcttcttcgtggctatgtgcagatatttctacccgaccttaaatattttgatcctacactttcggataaatattccaaagccgcagactattttgaaaacgccgctgcttcaatacataaaatggcggagctttcaggcaagccaacctttgacgaaaaaggcataatgcagagcggcacaatagtccgccaccttgtcctccctactcaccgtaaagactccataaagcttatggagtggctaggcaaaaattttgccaaaaacgaaataatgataagtcttatgagccagttcacccccgtgtataaagcctttgactacaaagagctttgccgtaagacatcaactttcgagtataacaccgtcattgacgccgtgaataaatacggttttgagggttttgtccaaagccgcacatccgccgccaaagattttatccccaaattttatgacgaaaaatactactgatatcccattttttatcggactgccatgctaacacagacagcccgatatttttgtaataaaattgttatacattccctattgacattttgaacaaaaaagtttataatgttaatgtaagtttggtaaaacaaacttgaatggggtaacttatggggtaaacattagtcaccaaccgtaaaaagggcagcaaaattgccgcctgcgtataagttatcgaaaagaggtcatgcaaatgtcaaaggctttcggttcaagatattccattgaaaattccgaggaagcaaaggagtattttgagtttgtaaaggacctgcttgacagcgatgttgtaaacgaaatgaaaaattttcgtcatcactatagtacgacttgctatcagcattgcatcaatgtatcctactataactatctcgtttgcagaaaattgggactaaattcaagatccgcagcaagagcaggtctgcttcacgatctgtttctttatgattggcgggatcgtgagaagaaaaaaggcgaaatgcctcacggaatgacccacccaaaggtcgcactcaacaatgcgaaacagcattttgagataggcaagcgtgaggaggatatgatagtcaagcatatgtggccgctgaccctgaaatttcctaaatacgctgaatcttacgttatcgtgtgtatcgacaaatacaccgcaatgttggaaataggctcttatttgggtcagaaaatgaaagaaaaagcgaaagcaatgcgaacaaaacagcattaaaccaaagcggacaggcacacacctgtccgctttcagtttgttgacaaatccctaaataaatgtacaattgatcgtacacttatataaatgcaaaaagaccgcccctaagataagggacggcctttcccgtttatcaggcaaaataaacggatattggtgtttagtgaatgtcgttgtaaagtgcaatgtaatccttggcggactttgtccaactgaaattctgcttgagcgcagtgttcacaagtctgccccacttcatcttgtcatcatagtatgccctggctcttacaacagcgtcaagcatatcatgtgcgttgtaggacttgaaagtaaagccgtttccattcttgtcgcctgcatcatggatactatctctcaaaccgcctgtctctcttacgataggtatagtaccatatctcagagcgatcatctgagccaaaccgcaaggctcgctctgcgacggcataaggaacatatccgcaccagcgtatatcttcttggacagctcaggcacaaaaccgatggtcagacccactctgtcaggataacgataatgcatttcgctgaaaaagtcctcgtatatcttctcgcccgaaccaagaatagcaaacttgcagccaagcctgattatgtcctcaaacacatacttgataaggtcaagacccttgtgtgaaacaaatctcgttacgataccgataacaggctcttttccatgtgccatgccaagctcgctgagcaaagcgtgcttgcaaacagccttgcccgtcttgtcattcaaactataattcttagcaataacaggatcagttgcaggatcgtagatcttctgatctattccgttgagtattccgcaaagcttgtattgcttgttaacaagctccctgtcaagaccatgtgaataccatggatcaagtatctcccaagcatagcttggcgaaactgtcgtcaccttgtcagccgtttcaatagcagccttcataaagttcacatcaccgtcatatgaaagcagatccgtatgataaagcggaatgcccataatatcgttgataagttctaagccatattgtccctgatactgaatattgtgtatggtaaataccgtcttgatatcctcataaccctgctgatagcggtagaaaatatcataataaacaggaacaagtgccgtctgccagtcattggcgtttataacatttggcttaaagtcgatgtatctcagcagctcgagaactgcccttgagaagaatataaatctctcagcatcatcataaaagccatacagaccgtttctctggaagtaatactcattatccaaaagataataagtcactccgttcacaacgcctgtaaaaacgccgcagtattgatttctccatgccaccggcacagtgaaattcgtaacatatgtcagcttgtccttaagctcctgcctgatagagctgtaataaggtatcacgactctgcaatcgtgaccctcggcattgatagccgcaggcagtgagcctgcaacatcagccaatccacctgaagcaataaaaggcaaagcctcacttgcagtataaagtatgttcatatccgaaccctctttcctaagtcattgcgacctttttatacagaagctccctttcctacatacataggatactgtggcgaacttgtaaggatatggttttcacagatagaaacgttcttgtctgtgataagatagttaagctcagcattgtcaccaacaacagtgccctgcataaggatacagttcttgacctttgcacccttgcctaccttaacgcctctgaacagtacagagttctctacctcgccctctatgatacagccgtcagcaacaagagaatttgataccttgctgtccagatcgtacttaacaggagcgttgtcgcttacctttgtgtagatagaacgctttggaacgaacagcttgcgtgcattctcaggttcaagcagagccatgtttgacttaaagtagctttcagggctgttgagcttgctgaaatagttatcgtactcgtagatctttatcttaagctctctgcacttctcctgaagaatatttctctcaaagcttacatttcctctagccattgcgtcattaacagtttcaataaggaaatccattgacataacgaacacattaaggctcgttgtgcaagtgccgctgatgtcaggattgataagaacagaagttacattcttgtcagcgtcaacgttgaatacagttgaagtctttatatcatcagagctgtaaacgccagtgtgtgcaacagcagtaatatcagcaccgctctcgatgtgagccgcaacgataggcttgtagtcaatgtttgtgacaacgtcacagtctgaaaggataacatatttagctcttgaatgcttgataaagctcatcgcaccataaagagcctcgatcctgcctctgtaaagagtgctttcaacgttgccgaatggaggcagaatgtaaagtccgcccttttttctggccagatcccactctcttgcagagccgaggtgatccagaagtgactgatagttagattttgttataacaccgacctcgcttatgccgctgtttaccatgttagacagtgggaagtcgataaggcggtatcttccgccgaacattacagaacccatagttctgttctttgtcatgtcgccaagagtcgtgtcgtgcatattagcgaaaacaagacccagtacgttacccatatttacatccatgtttactcggtcctttcttagatattctcgtaaattattgcctttggtgcaacaacactgccgtcagaaacagtcagattattgcccactacagcaacgccccatgagtccttgtcctcgatagtttcaggtcttgcaccgatctgagcgttctcaccgataacagtgttctcgccaacgatagcatactcgacctttgcacccttcttgacaactgcgccaggcataaggatagaatccagtatctcagcgccttcctcaacagtaacgccgtcagagatcattgagaactcgactgaaccgtcgataacgcagccctctgttaccatagagttctgtacctgagcgttcttgcctatgctctgaggtggcataacagggtttcttgagtatatcttccagcttgtatcataaagatcgataggaatgttaggattgataaggtccatattagcttcccaaagagaatctatagttccaacgtccttccagtagccgtcaaaacgataagccacaagcttctcgcctgcttctctcatgtcagggataatgttcttgccgaagtcctttgaagcttccttgtcgttctcattagcgataagataagctttcagcttcttccaagtgaatatgtaaatacccattgaagcaagagttgaacgagggttctttggcttctcctcgaagtctatgatattgtcgtcctcgtcggttatcatgatgccgaaacgtgaagcctcttcctttggaacgtccagaacagcgatagtagcgtcagcgttcttagccttgtgatattccagcatcttgttgtaatccattttgtagatatggtcgcctgaaagtacaacaacatactcagggtcatatctgtctacaaaagcgatattctgataaatagcgtttgcagtacccgaataccagtcagcgcctgaagctgtctgataaggaggaagcacatgaacgcctccatgtattctgtcaagatcccaaggctgaccgtttccaatgtactcattgagtaccaatggctgatactgtgtcagcacgcccactgtgtcgatacctgaattgatacagttcgagagagggaaatcaatgatacgatacttagcaccaaaaggtactgccggttttgcaacgctctgtgtcagggcatacaatctgcttccctgaccgcctgccagcagcattgcaacacattcttttttgttgaacataattaattcacccaccaatttttattaagtctatattactcagcctttttagctgtggacttcttagttgttttcgccttagcggctttcttgacagcagttttcttagccgctgtctttgcttttttctttccctctgcctttttctcaggcacaggtctttcctctttcttcaccgtgaaatacatacaggagaacgcaggaatgtcgatacaaacagactgatcgaagccgtgcatcttctcatcaacagcctttacagtgccgttagtgcaaggggatccgtcaacagaagacgagttgaacacctctgtatagctgccccagtaaggaacgccaaagcagtatgactttctttccacaggaacgaagttgcacacaacgatgacctctccgccgtttttgtcaaaacgtctgaagatgatgatactctgcttgaaatcgtcatttgatatccagctgaagccctcccaagagaaatctctctcccagaactgagggtggtcaagatagaaatgattgaggttcttggagtagttcagataattgcggtggttctcatattcgtccaccatgaaccattccagaccattctcgtaatcccactctctgaactgagcaaaatcagcacccatgaacagaagcttcttacctgggtgagccatcatataagccatgaacagcttgcactgcttgaacttattgtcgatatctccaccatacattttatttaccaatgaagccttaccatgcaccacctcgtcatgagagataggcaaaataaagttttcagagaaagcatagaagaatgagaacgtgagcatatcatgatgaaaagctctgtcaatagggtcaagagccatatatttgagcatatcgttcatccagcccatgttccacttgaagttgaagccaagaccgccgtcgctcgcaggctttgttaccataggccatgaagttgactcttcggctatcataagggtattagggtttcttccgaacacagcagtattgagatccttgaagaactgaacagcttcaagattttccttgccaccgaacttgttaggcgtccactctccgtcacgtctgtcatagtcaagataaagcatagacgcaacagcgtcaactctcagaccgtcaacgtgatatttttctatccagtaaagagcgtttgagataaggaatgactttacctcgccctttgaataatcgaaaactctcgttccccaagtgaggtgatctgcctttttcgggtcagagtattcatatgacggacctccgtcaaactcgaacaatcctgcttcatctctaggaaaatgcgcaggcacccaatcaaggataacgcctattcccgcaaggtggaaaaggtctatcattttcatgaagtcataaggcgtgccgaaacgtgaagtcggcgcaaaatagcctattccctgatagccccaagagccgtcaaaaggatattccgccagcggcataagctcgatatgagtatagcccatttcctttatataagggattattgaatctgcaaatctaacgtatgagaaatattttccgtcaggacaagccttccatgaattgaggtgtacctcgtagatattcataggacaattgtagatatccttagacttcttctcggtcatccactttttatcgctccaaagataatcgtcgatatcgaaaacctttgtgccagtgctcggagcgacctccatgtgtgtgccgtacggatcagccttataatgggtcttgccgtcacagccgtgtatacagtatttatatgtatcataagtctgaagccctgtaacaaaagcctcccacacctctgagtcgtctatcttctccattggagtggcattttcgtcccagtcattgaaatctcccacaacagaaatgccctcagcgtgtgccgcccagactctgaaatagtatccttctatgccgtctttctctcccttatggcagccaagaaacttatatgtttcgcagtttgtgccattgtggaaaagatagagcggcagttcataatcctttggaataatatctatcacaattcagcctcccttgtctttttgtgaaaaccgctgaataatttcggtgtttcatacttatattttaatcttttttgaacaaatttgcaatagttttagtagttattctcgtattcgcacatatttcaacagatagttttatatattttgcacaatagattttatataataacatagaaaaagtaaagtcaaagtatacaaaagtaaaaaattgcaggcaaaagtcggcaaagtcatttacattcatttttcattctcgtcacgaaggaaaatttttgcggcaataatagttatatcgtcacgcctgcctcctgttcgctgagcaagcgcctttgcgccaagcgccgtgactatctcctgagcgttcattccgttacagcggagtatctctcgtgctgtagcgtcctcgacaccgtctgaggtcataagcagaacgtccccgtcaaagagcttaagctcgctcacgtcaggagtacactccgcaagtatcccagcaggaaaagcctgtccgccgatagctttaagaccgccgtcacggaaaagaaagctttgcgccgcaccagatttcagaaactgcaccgttccgccattaagctccagccgcattatatcaagggtcgcaaaagattcctcccagcccttaactctgagcatggaatttataagcctatgggctgtctgcatagacattcccgatcgtatgagccttgtaacaagacttacggaaaacaatgaatccagtcttgctctttttcctgttcccatgccgtctgaaaggacgatatacttttcgttgacgcttgaatcgaagacttcaaagctgtcccccgaatattctccgcttgacgaagctgaaaagctttttatatcaactgtgaatttcggtatttccgcaaaggacattctggttatattatccaccttgactatcacaggcatatcaaggtcataatctatcatttctgaaagcgttgctgtgagccttacaagatcacccctgaactgagccgttataaaaacgtccacacgctgacaaaggttttcgtctatgtaaacgcaggctttcacatttggatagccaaggtttgagaaatgctcccttactcttgctgaaagctgaggatcaacgcttctcacctgacctgccctgaaagaaaggtcggataagatatcctccatggaggaaagctgttcgcttaaaaactcacgcatttcacgaactctcatgctgtcggcacgttctgtcacaaagtcggtatacaactcattgaagcttttgcaaagaagcgactttctcacacagccacccaaatgcttttcaacgtcgtcaaggctgaggttattatatgtacaaactatgctttcaagctttgaaaagctgtcatcaagctgtacacaacgcttactgcacactgagtacatatcgcaatcggtacaaacaacagatcgtacacgctttgacagagtagcttcctttgagcgtttatctatcgcagcagtgaccattgtaagctgacctctgataccgcccagagttctcgaagccatactgagctttgaagaagtggtctgccctacaaggtcaacggaatttttcactccaaccactttttttgccaccctttttatcacaggaacaggcagggcgataaaaagcacagagcctataagcaaatcagcaaacattgaaaatgtatcaccgttcacgcccattgccacaaggctcacaagtgaaactgcaaggaaaacaagcactatcacaagagagccgaattgcagaaaagctccgcagataagtcctgacgtggcaagcaaaagtgtatttctcgcaagtgacggagtacaaaggagtacaccgcaggtggtcaatgcgccaacaactgcaccgcctatatttctatactttcgcactgccataagcataaacaaagtgcctgctatcctgcccagattcaccacatggagcggtgcggcagtgatggtcgagataaacataatataaagtatagctgtgaaaactccgtttattcctgtgaggtcaaaaacaccgcttcggtttctttgacgttttacggtcagtgcaataaaaacaacacagccacacatgagcgagcttatcattcgcagtgaagccgtatatgtatccgatggcattgccaccgacattacacagctgaaaagaagcattgctcctgttgtgaggagcgacacaaaaacggggtcatccttatggtcggcagagggcatcacaagccttaccgcccctataacaagtatcgcacaaagctgaacgataccctctgagaatgttccgcttacaaaatatgcaagtgcagagcctaaaaaagcaggtatcacattagttcccgaaagcactgccaccgccacgttcattgacgaggggaagcctaagatctttccgaagcttgctgtaaacgctgctgccgccgataaaacagccataagtacattcgttttgcctgaggtatgaaattttgccgtatgccgtattttttccattgcttatcacgtcctatgtttccaaaatgtaataattacattttagcaggactatcaagcgaaaggtgtcgcaatatgggcttgaaattgaaatactgaccaaatttacggacagatctcgtaactttcaacgtcatgaaaatctgctgttgaaattcgggatagttgccgagcaacgggcgaacgaaatgggacgtcgcatttctgcttgcagaaactgagacgctcctctacaagtaatgaagtataactatacgaaaatatgtacaattagataagctttctaagggtttcggaaaaggttatgaattgttccatggaaagagcttcaggacggacggaggcaggcagattgctttgctctatcgcctgatttactatagatttatctatgcccattgatgatgatacggaatttgagagggtctttcttcgctgtgaaaatgctcctctagcgactttaaaaaagaacttttcgtccgtcacgccctcgggggtcttatcacggatatcaaacctcaccacgcaactgtcaacgttaggcgatggcatgaagcttcctcgtgatacgttgaaaagcagtttcggtacagaaaaataatttattgccactgtgactgctcccatatctcttgtacccataggggcacaaagacgtgtgcctgcttctttctgcaccatgacagtaacagactttatgggcagacgttcttcaaggagcatcattaatattggcgaggttatatagtaaggcagatttgcacaaacggcaacgtccataccctgaaattcctcggcaataagcttatggaggtcagtttccatgacgtcggcgtttattatcttcacattgtcatattctgcaagagtttctgcaaggaccggcataagcctgtcgtcaatttcgatagccaccaccttgtcggcacgcttggcaagctcgtttgtgagaacgcctatgcctgtgcctatctcgattatgccgaagcctttttttgcattgcccatttcggctatcttggggcaaacggagggattcactaagaaattctgaccgagagccttggagaaagtgaaattatgtcttgcgagaacatcttttatcacacttatattagaaagattatccatttattaatacacctcagattaactgataaatcgacaaaaaattaacaaaataattatatcatattaacaaaagattgtcaactgatttggaaaagaataatattcctatgaagtaatgaaagaccgtgcgaagcgattttgcggtggtagaacttgcacgaatatctgtaggggcttggcgaaatttctgttcgcaagctcacagaaatgcgacagcccgttttgggggagttgcgaggtttggatttttcatgaagttgagtggggggaacgaaacgggcgaacgctgttcgcccctaccatgcgttgtgtggttgtcatggtttgtgggataaacaataatgcgaaacgttgagggggcgggacgtcgagggcgccgtcccctacatggtttgtgaaatgcagtaaattgtgcggataacgcagggtttgacgggcgaccaagacgggcgaacagtgttcgcccctacagatttgttgccgtggggtcgtgtttcagtcgtttttttattcaattttcaagcttcaaacaaggtgcagaaagtgcttttctgtgcgatcagaacctctcatcgtgttcacctaactcacgttgacagaatgtgtcctcatacactgctaccttgcaggatattcgatttgggataacatccttatacttatcccgaaaatcaccacttttgttgcataaaaaatgcaacaattgcagaaatgttgccaaattaaaagataaatcatttgtttgtacaaattacgatgcgataaattgtgcagtatcacatataagatcgtaagggtttaattttttattgcccgggaaataatatatgcggaggtgataaaaatgaaaaacaactcttttgctcacggtcaggaattaccgctggggctgtctatggctcttgctcaggtgcctgcggcatatgcttactttgctaagctggatccgcttcaaaggcagcagataatcgactcggcacactgtattcgctccaaagaggaaatgcatgatcttgtcaacagcttatcaaacggtcagatcactgatacaagtattttctgaacgaaaagttaatgtagacaaatttcacaataaatcaaagattaattgatataaattttatataaatatgtgttgaaatttatctataaatattgtacaatattattgtaaggctttgtatgctgttatggagaaaatcagtaaaaaaaaagctttcgcagacagttttgctccgctttactgtctggtaatattgtgcagtattttttgtatgtattcaggagagatgtatgactgaaatgtgctgtttttcatcaattacatattcttttatgggtaggtctttaagtataattgcgtcctgccttgattttttgcactctaacaatctaattatgcactgactaaaactgcaacgccattgttgcagttttttatttgtaattttttgttttacttggaggtataaatttatgaaaaaagttgcggtaataatgggttctgacagcgattttcctgttgtcagcaaggctgttgctgaacttaaagcttacggtgttccttacgaatgtcacgttatgtctgctcacagaacgactgcacttgcaagcgattttgctgacaaggctaaggaaaacggctttggagttataatctgcgctgccggaatggcggctcatcttgcgggagttattgcaggtcacacaacgcttcctgttatcggtatcccttgcaagggtgctaacttcgacggcatggacgctctgcttgctaccgttcagatgcctagcggtatccctgttgccactgtcgcagttgacggcgctaagaacgctgctatacttgctattcagatgctggctctttctgatgagggactggctgaaaagcttgaaaaggctaagcaggatatgatagacggcgttgtggctaaggacaaggctttacaggacaagcttgctgcgctttgattttttgatacagacatatagctcggctgtatgttatatttgatatatcgtggaagttctgctgtcggcgggcgaacgatgttcgcccctacatattaaaacggcagtggatatgttttcggtgtatcatataaataatgtaaataattttatggaggaataaatctatggaaaacattgtaaagacagaacagctctatgagggcaaggctaagaaagtattcgctactaacgaccctgatcttgttatcgttgattacaaggacgacgctactgctttcaacggtgagaagaaaggcactatcgttggcaagggtgctatcaataacaaaatgacaaactatatgttcaagcttcttgaaaaagagggtatccctactcatcttgttgaggagatctctgacagagagactatcgttaagaaggtcgagatcgttccgctggaagttatcgtaagaaacgttgcagcaggaagcttctcaaagaagctcggtatcgaggaaggcacaaagctcaagcagcctacacttgagttcagctacaagtgcgacgagcttggcgacccattcatcaacaagtattatgctcttggtcttggtcttgctactgaggaagagatcgaggatatcacaaagtatgctttcaaggtaaatgagttcatgcttggcttcttcaagaacatcggcattgaccttatcgacttcaagatcgagttcggcagattccacggaaagatacttcttgctgacgagatctcacctgatacttgccgtttctgggattctaagacacacgagaagctcgacaaggacagattcagaagagacatgggcggcgttgaagaggcttaccatgagatgataaagagagtaatgggagaataatatctatgggcggttttttcggagctgtttcagctaatgactgtattcaggacgttttcttcgggaccgactatcattcacacttaggcacaaggcggggcggaatgacttcattctcccctgagcttggctttcagagaaatattcacagcattgaaaactcaccatttcgtactaaatttgaaaaagacgttgacaaaatgagaggaaacatctgtatcggctgcataagcgacacagatcctcagccgataatggtacgctccaagttaggactttacgcagtgtgctctatcggtgtaatacaaaatgccgctaaactggctgacgaactgcttgaaaagggctgcgcaaactttgaaacaatgagcagcggcgctatcaattccgcaggacttatcggtgcgctgatcgcacagaaggacagctttgttgacggcataagatacgcacaggacaagatagaaggcacgatgtcacttgcaataatgacagacaagtcgatgatcgttgccagagataaggacggacggcttcctattataataggacagcgttctgacggatattgcttttcttttgaatcatttgcatatcagaagcttggatactccacctgtcacgaactaaaggcgggagagataactgagataaccaaggacggctacaatatcctcagcgagggtacagacaagaaaaagatctgcactttcctttggacttattacggctaccctaccgcttgctatgagggcgtgaacgtggagcttatgcgaacacgcaacggcgagataatggcggagaacgatatgaaaaacggcaggctccctgacgttgatttcgtttgcggaatacctgattcgggcgttcctcacgctataggatatgcaaacaaaagcggcataccttttgcaagaccgttcatcaagtacactcctacatggcctagaagctttatgccgacaagccagtctatgagaaacagagttgcgaagatgaagcttatacctgttcacgaacttatcgagggcaagaagctactgttcgttgacgacagtatcgtcagaggcactcaaatgagagagactgttgagtttctttatgagaacggtgcaaaggaagtccacatgagatcagcctgtcctcctatcatgtatggctgcaagtatctaaacttttcacgcagcacctcggagcttgaacttatcgcaagacagatcattgatgagaacgagggtatcgagggagttaaatacattgaagaatacagcgattcaagcactgagcgtggcaagctcctcagggacgagatatgcaggagacttaagcttacctctgttgaattccagtcgcttgaaggcactgtaaaggctgtgggtctgccaagctgtgagctttgcacctactgctggaacggaagggaatgatttaattggtaacaggtatccatgaagaatgcggcgttttcggcatttatactaacaagacaagcgatgttgcggctcagacttatgtatctctttacgcattacagcacagaggtcaggaaagctgcggtatcgttgtaaacgacgacggcgtgttcagctatcacaaggacgtgggtcttgtcaatcaggtttttgacaaggaaactctcgaacggctcggcaagggcaatattgctataggtcatgtgagatattcgaccacaggcaactgcaatgcttcaaacgctcagccgcttgttgttcgtcacataaagggtcctatggctatcgctcacaacggaaatcttactaacgcaagagaacttagagagcaatatgaaaacaagggcatgatattccacagcacaaatgatactgaggtcatatcatacgctataaccgaggaacgtcttagagcaccgtctatacaggcggcgcttgaaaaagctatgtacaggataaagggtgcgtattcgctgctcgttatgtcgccgacaaagcttattgcggcgagagatcctgacggcttcagacccctttgcctcggaaagatagacgacggctatgtggtagcgtcggagacctgtgcttttgacagcatcggcgctgaatacataagagatcttaaaccaggtgaaatgatagttattgacaaaaacggtgtgaactctatcacaactcactgcggtaaaaagggtactatatgcgtatttgaatatgtatattttgccagacctgactctgttatagaggggtcgagcgttcacatggcaaggctcagggcaggaaaatatctttggagagaacaccctgttgacgctgatatcgtcataggcgtgcctgactcgggacttgacgctgcgctgggattttctcaggaaagcggcataccatacggcattggatttatcaagaacagatacataggcaggacgttcattcagcctagccagacagagaggacaaactccgtcaagataaagctcaacgctatttcaagcactgttaagggcaagagggtcgttatgatagacgacagtatcgtcagaggaacgacttcgggacgtatagtcaagctgctgagggacgcaggtgcaaaggaagttcacgttcgtatctcctcccctgcattcatcgcaccatgctatttcggaacggatatagacagcaaggaaaatcttatcgcctgcaagatgaccaatgaagaaatatgcgaatatatcggtgcagacagcttgggatatctcagtgttgaaagcgttaaaaagcttgcgggaaattcaaagtgtgatttctgcgtaggctgctttacagagaaataccctatcgaagttcctaaggatatgcctaaggacaaatttgaatcgaagatatcggaaaagaagtaaataactgaaaggatattttatcatgaatacaaacagtttttcaaacagctacaaggaagcaggcgttgacgtaacggcaggctacaaggcagttgagcttatgaagcagcacgttgcaaggactatgacgagcggtgttctcagcggcatcggcggcttcggcggtctgtttgagcttgacatgacaggtatcacaaagcctgttctcgtttcaggcacagacggcgttggcacaaagctcaagatagcttttcttatggacaagcatgacacagttggtatcgactgcgtggcaatgtgcgtaaacgacattatctgctgcggtgcaaagccacagtttttccttgactacatcgctgttggcaagaactatcctgagaaaatagctcagatagtttctggtgtagcagagggctgtgtacagtcaggctgtgcgcttatcggcggcgaaacggctgagatgcctggtttctaccctgttgacgaatatgaccttgcaggcttctctgttggcgttgttgacaaggacaagatacttgacccaagcactcagaaggccggggacgttatgatagctataaagtcaagcggtgttcactcaaacggcttctcactggtaagaaaggtattcagcgttgacgaaaagactctttctgttcactatgacgagcttggcaagacacttggcgagacacttctcacacctacaaagatatatgtaaaggctgttatgagcctgcttgattctgttaaggtaaaggctatatcacacatcacaggcggcggattctatgagaacattccacgttcacttccaagcggtctttctgttaagatagcaagaagcgacgttcaggtgcttcctattttcgacgttatcgcaaagacaggaaacattcctgagagagatatgttcaacacattcaacatgggcgttggtatgacagttgttgttgacaaggctgacgctgacaaggctatcgaagctatcaaggcggcaggcgaagaagcttacgttctgggcgagcttgttgactctgacatgggcgttatcatctgctaagggtaaagagatatgaagaagatatgcgttcttgtttcgggcggcggaacaaacctacaggcgcttattgacgctgaaaaaagcggcattataaaaaacggcaagataacctgcgttatatcctcgaaggagggtgcttatgctcttgagagggcgaaaaatgcaggtatcggcactgtcgttattccgagaaaggaatatgctgacagcaagagttacagcgaggctattctggcggagcttaacagacaaggtgctgaccttattgtgctggctggatttatgataattcttgacgaatgcgtcacaaaggcttatccttacagaataataaacgttcaccctgcactgataccgtcattctgtggcgagggcttttatgggcttaaagttcatgaaaaggctcttgaatacggtgtaaaggtatcgggtgcgactatacattttgtaaacgaaaaggctgacgccggagcgataattttgcagggcgctgtagatgttgcaaatgacgagacgcctgaaagcttacagaagaagataatggaaaacgttgaatggaagcttttgcctaaggcggtttcgctgttctgcgaggacaggataagcattaaggacggcaaggcttacgttgaccttaaagactgagaaaaattatggaggataagatatgaagacccttaatatttatgacgagcttaaaagcaactcatatccgggcagagggatagttataggcaagtctgctgacggaaagagtgctgtgactgcttattttatcatgggcagaagtgttaattccagaaacagagttttcacggaaactgaggacggcatcaagacagaagctgctgaccctagcaagctttctgacccacaccttattatatactcccctgttcgtgtgcttggaaacaagactatcgttacaaacggcgatcagacggacactatctacgagcttatggacaagcagcagacttttgagcagtcactgaggacgagagagtatgaggacgacgctccaaactacactcctcgtatttcaggtatcatgcacgttgagaacggcgcatataattatgctatgagcatactcaagtccgctgacggcaaccctgactgctgcgagagatttacttacacatacaccaaccctcttaacggcgtgggtcattttatccacacttacatgggtgacggcaatcctctgccaagctttgagggcgagcctaagaaggtggagatacctaacgatattgaggagttcaccggcaagctttgggaagcgctcaacgaggacaacaaggtatcgctgtttgtaagatacattgacattgcaagcggcaaggctgtttctaagatagttaataagtacagcaagtaatatctgcggagtgaataggttaaataaacggaggtaaaaattatggcaaatgaaatgcttttgaaatacggctgcaaccctaatcagaagccgtcaagagtatttatggaggatggcaaggatctccctatcgaggtactcaacggcaagcccggttacatcaatctgcttgacgcattcaacggctggcagttggtaagagagcttaaaaaggcaacaggtatgtgtgcggcaacttctttcaagcacgtttcacctgcgggcgctgctattggcaagcctttgagcgaggtggaaaagaagatatattttgttgacgatctgggcgagcttactccacttgcaagcgcttatgcgagagcaagaggtgctgacagaatgtcatcatacggcgattttatcgcactttctgacgagtgcgacgcttgcactgcaaagatgatccagagagaggtttctgacggtatcattgcaccgggctacactgacgaggctcttgagatactcaagtcaaagagaaagggtacatacaacatcatcaagatagatgagaactatgttcctgcacctattgagagaaagcaggttttcggcgtaacttttgaacagggtcgaaacgagctgaaaatagacaacgatatgctcacaaatatcgtgacagacaacaaggagatccctgaggacaagaaaactgatcttgttatctcacttatcacacttaaatacacacagtctaacagtgtttgctatgtaaaggacggtcaggctatcggtatcggtgcaggtcagcagtcaagaatacactgcacaagacttgcaggaaacaaggctgacatctggtggctcagacagcacccaaaggttctgggacttcagtttattgacaacataagacgtcctgacagagataacgctatcgacgtttacatttctgacgagcatgatgatgtactggctgagggcgtatggcagaacacattcaaggtaaagcctgaggtgctcactgaggctgaaaagaaggaatggcttgcaaagaacacaggcgtttgccttggttctgacgctttcttcccattcggcgacaacatcgagagagctaaaaagagcggtgtggcttacattgccgagccgggcggatctatcagggacgatcatgttatcatgacttgcaacaagtacaacatggcaatggcattcactggaattagattattccatcactaatttttgtgcattaatgcaaaacaataaaggtcaagaagaaaaggagaaatttattatgaaaaagttacttgcatcactcatggcactgtcaatggtatttgcagttacaggctgctcagagtcaaatgattctgagaacgagtcaaaggctgaggctaaaacaactactacaactacagccgcacctgctgccgagtctaaggctgacacaacaactacaactgcagcacctgaggagtcagttgctgacacaacaacttctgctgacgacacaacaagcactggcgacgaggctaaaggcacatatgagaatgacgtttacacaagcgatctgtatactttcaagatcgactcaaagaagtgggcaatgcaggaatccgctggtgttgacgtaatgttcacatacgctgacgcaggcgatgatgctgagcttgagtctgcttctatcaacgttatctcaatgtcaaacgatctgctcaatggtcttacagcaagtgattatgctgaccagatcaagcaaacatataattccatggacggctacactgttacaaacgacaaggaagataagtttgcaggcaaggacgcttacattgttgacgtaacaggcgaggtcggttctcagaaggtactgctcaatcagataatcacttctgacaacggcaaccttgttgttatcacatatggtgcaagcgagaacgcttacagcaagctttctgacgagttcaagacagttcttgacagctttgagcttaagtaataatatacgaagtaaataaatgacgataccgcacagcataggtgtgcggtattgttataattggaaaaacacactgaggaggtctgaaaatggacatattagttgttggcggaggcggacgtgaacacgctatcgttatgaagcttgcggagtcccctaaggtaggaaagctttactgcacacccggaaacggtggcatttcacgctatgcagaatgttttgatgttgcggcaacggatattgagggcgttgtggctctggcaaagaagcttaaagtagacatggtggctgttgcacctgacgatccgcttgtacttggaatggtagacgctttgcaggctgagggtttcaagacctttggtcctaagaaaaatgcggctataatcgagggttcaaaggtcttttctaaggatcttatgaagaaatacaatattcctacagccaaatacgaggtgttcacaaacagtgaggacgctataaaatatgtcaaggaacagaacacataccctgctgttataaaggctgacggacttgcacttggcaagggcgttattctggctgagagtgagaaagaggctgtggaggctatacactcaatgatagacgacaagcagttcggtgagagcagttccactatcgttgtggaggaatatctcacaggtccggaggtttctgtgctttcattcactgacggcaagactgttgttcctatgatctcttcaatggatcacaagagagcgttggacggcgacaagggtctgaacacaggcggaatgggtactgttgcacctaacccttactacactgaggacattgccaaagagtgcatggaaaagatcttcctgccgactatcaatgcaatgaacgctgagggcaggacttttgagggctgtttgtatttcggacttatgctcacccctaatggtccaaaggtaattgaatacaactgccgtttcggcgaccctgaaacgcaggtagttcttcctatgctggagggtgatctttgcgagatatttgaggctatttatgaacacaggctggctgatgtcaagatcggctggaagtcgggttactgcacttgtgttgttatggcgagcggaggatatcctgttaagtacaaaaagggtatcgagatgttcggtatggacgacaagggtcaggtagacggagcgttcatttatcacgcaggcactaagtacgaggacggcaagttttacacaaacggcggccgtgttctgggtgttacctgcaatgcttacacgcttcagggcgcactggacaagtcttacgaggctgtttccaagatagagttcgagggagagcatttcagaaaagacattggtcagaaagcactcaaggcacttcctaaagattctcttgatcttgaatacaagcaggacatggaggactacatcgaagaaaacggcgtttatctaagacagtaggatatataaaacgggcggagagattccgtccgttttttttacagataatacgtttataaatacaaagatccccttggacatttctgtccaagggggtctttgctatgtgtgggaagtaaaaattactcgtctgctttttcaatagccgcagtttcgtaaatatacttaactgagctttcaacgccatcggctgcgcctgagaatgttgttgaatcctcggctgctttcttgagagcgtcaagtctgtcgataagtcccttgaggtcgttgttgtagatgtcaaggagcttgccgatgccctcgtccttatacttagccatgccgtctttaagggtctttgcaccgctttcaagcttcttaacaccagatgaaagctgtgagctgccgtctttgagctgaccgataccgctgaacagctctgcactgccgcttgaaagtgttgttgtaccctgtgcaagctctacaagtgatgaatagagtgttgcagtaccgtcttttagctgcttgctgccgttgtcaagctgaccaagaccgctgtcaagagtttttgcaccgtttgaaagctttgatacgcctgtgttcaggctatcaacgcccttatcaagcttgcttgcgcctgcctgtgctgagcttacgcctgcggagaggttctttgtgcctgcggagagtgtagctgcaccattgttaagatccttgctggacttagcaagtgtgccgataccggttttaagtgcagaagcaccctcgtttaccgttttaagtcctgtattcaaattatcaacgcctgcgacaagacctttcttcttatcgttaagaccattgtatatctgagttacgccgtcaacaagctgtttgccctcggttgccattgtaccgacacctgttgaaacatcgccaaggccgctctgtgcgccctgctgatactggatagagccatttacggctgctatcatattgcttatgctcgtatactctgctgagccttcttcgtaattgccgagaagctgctcaagtcctgcgagtacctgctggtcgtatgcgatagactgtgtaagtgcgttatctacctttgttatgccatttgaaagaagttcaacgcttgcagggagtgactgcaccttttcatagagtgtggaaacgcctgcattaagtgttgcaacgccttttttcagtgcagttgaaccgtcataggtctgctttgtgcctgcggcaagctttttagaacctgcttggaggtcgcctacgcctgtaacaagcttatttgtgcctgcggcaaggcttgcagcaccgttatttacctgctgtgcgcctgaggatacctgtgaaagtccgcttgaaagtgatgatgagccgttcttcaaggttgacataccactgtttacctgatcaaaaccaccgaggagggctgttgaaccgctatgagctgtggagatacctctcataagctcacctgttgaagaatcaagggtctttgctccgtcacgaagctttgttgcaccgctgttaagtgtctttgcaccatcgtcaagtgacttagaacctgaataaagcttgtcgatacctgtgataagtgttcctgaggaatcggacagcttctttatgcctgcgtaaagctctgctgtgccgtctacaagctcgtctgtagcatcagaaagctcatcaagcttatcctgaagatcgtcagcatcacctatatcgctaaggtcaagttttgagaagatgtcagatgttgcgactgtgagagcagttgttgactcgaagttctttacgtctgctgtgaactcaacgtactccggtatctcgatatcttcgttatcctgaaggtcaaggctctttgtaaggccaggcattgcaacgcctataagtatctgtctgcttccgtctgaaatgagcttgccatttgttacttcaacgtttgaataaacgttagtatcaaggatagctgttgttgccataaggtatggaacatagatatctgttttcttgccgtttatcttgacagttttcttatcgttgtttgtatagtcatatcttactgtaagcttaccgctcttgcctgcgaggtcctcaggctttatctccttgccgtcaagggtatatgttacctttacatcaaccgggagtgccttatcggtatagcccttatagtagatatctccgccctcggtatcccatgtgagcttatcaccattggctgtaaagccctcgtctgttttaacattctcgatatctgtcaggtcagaaacgtcctccagcttctttacgccctgtgggtttttcagccagttggaaacgactgtttttgtcttgttgccggaagcgtcagtgataacataaactgtttcttccttagcctgcttttctgtatcactgtcagacttatcagctttctttgtatcttttgtatcttttttatctgattcgttctttgttgttgaggcagtgctgtcggcagcggaagagctgtctgactgagctgctgcataaagacctgtgcagcctgcggaaagaagtacggcaagtatgcctgcaagaactcttgaatactttttcataactatatctcctttacgaattagtttatttcaggaagcttataaagcttattttcttttttcttcatgcccattgttgtattgattattaccttatcgaacagcataagcattgaaggaagtatgcagataacagttatcatactgattattgcacctcttgacatgagcgtacaaagctgtgagatcatatctacgcttgaatatacgccaacaccgaatgttgaagcgaagaagccaagtgcgctgaccatgatagacttcattgaagtggtaagtgcgatagtgacagcttcgtgtttatctttgcctgcgttacgctcggtcttatatcttgttgtcataaggatagcgtagtcaactgttgcaccaagctggatagtaccgattactaccgacgctatgaacggtatggtggtatttgtaaagcacggaacacccatgtttactgtgatagcaaattcgataacggctaccagaatgatcggcagtgaaactgaacgcagtgcaataagaataatgataaagatagcggcaatagaaactatatttactaccttgaagtcatgatctgttatgtcgataaggtcttttgttgccgccgcctcaccgataagcattccgtccttatcgtaggatttaagtatcttgctaagctcatctatctgggcattctcttcatcagaagctaccttatattcagagcctattagcatgagctgccatttgtcgctcttgagtatctttgttactgaatcaggaactatctcacgagggatagacggaccgataagagtatccagtgacattgagaagcttacaccatcaaccttgcccatttcgtcgagcatagagtttacttcctttggctgcatatcagcgtcaaccaggagcatatgggtcgttgccatgtggtattcctcatctagctttgtgtttgcgataacactgttgagatcctttggaagagtatctgtcaggttatagtagacattggtgtttatctgaccatatacggcagggataagtacaactataaagagtacgataaatgctgcatggtgcttgataatgaactttgaaggcttttcaaggcttggaacaaggtctttgtgcattgttttttcaagtgccttatcgaagacaagtatcattgacgggagaactgttatgcagcagataacgccaataacaacgccctttgccattacgatacccatgtccatgccaagctcgtagctcatgaagcaaagtgcaaggaagcctgcaactgttgttatggagcttgaaacaactgaggtgatagttttgccgatggcgactgccatagcctctttgttgtcaccagggtgcttttctttctcctctttgtagctgtgccacaagaagatcgagtagtctatcgttaccgcaagctgaagcacggctgcaagagcttcggtgatgaacgatatctcgccttgtatgaagttcgttcccatgttatagactatcgccatgcccacgctgagcataaagaacagtgggataaggaacgaatccattgtaagtgcaagtatgatacttgtaagtattactgcgataacaacatacatcggagcttcctgcattgtcaggtccttgatatcctcaacgactgacgacataccgcttacgaaacactgctcgcctgcgatgcttcttatctccttgacagcttcaagtgagccgtcagcggaggtcgcttcgtcaaaaaagacagccatcattgtggagttatctgtattgaagaaatcgtaaatatcatcaggaagaacttcctttggaagtgaaacgtctgccaaggtgtcataccagagaacatcgcaaacgtggtctaccttttcgatcttctccttgaccttttcaacgtccttatcatccatgccgtcaagcattaccagcgaaaagccacccttgccgaactcgtcaagcattatgtcctgacctttcatggtttcaatgtctgacgggaggtatgaaagaatatcatagtttattcttgtgctgacaaatccgaatattgacggtatcagcagcagaacgctgactatgagtatcggtactcggagctttacaactcctctgccaaatttctgcatcaaatgtcattcccttcacatagtttttgacctttcggtctcttacaattcatagtatacaacgaaaatgaccaacagtcaatagtaaaatgaccattagtcattctttttgtagagttgcacaaaatgaccaacggtcacaagtgactattggtcattttgctccgttgactttaacaagaatttgtattataataaatacagtgtcaaccacagtaaacctgtgtatgtgtggcatacaaactgtatatattatagtaaggaaggacgtgttaaaatgggcaagcttgataccaataaaaaggtaaaggaggactctctgcttaacacggcttttagtctttttaccaccaagggagtgagcaagacctccatttcagacatcgtgaacaacgctggtgtggcgaaaggaacgttttatctttatttcaaggacaaatatgacataagaaacaagcttgtttctcacaagtcgtcacagcttttcagaaacgctatcgaggcattaaatgcgagcggcaagaagcttacctttaacgaacgaattatttttattgttgacaacatcatcaaccagctaaacgagaacaagtcgcttttgacttttattgcaaagaatcttagctggggcgttttcaagcacgctcttacgtcgcctataaaggacgatgacatcgacttccgcaacatttatgacgctatgcttgctgacgctccatatgatattgttcagcctgaggtcatgatattcatgatagttgagcttgtaagctcaacctgctactcgtccatactttacaacgagcctgtggacattggcgagcttaagccttatctttacatatgtataaacaacattatcgacactcatgcaggcactgtaaaagcataagaaaagacacgtttacgagatcataagcgtgtctttttttgtgtacaaaaaaacggacggaagatatccgtccgtttggtgtttttttactttgccttaacagcatctcttgcctttgcaacgatattgtctgcgcagaggccatattctttaagaagatcaactgccgggcctgagtgaccgaactcgtcattaacgccaatcttaacaagctttgcagggtgtcttgctgcaagaacgtcagcaacggctgagccaagtccgccgataacgctatgctcctcaactgtaagaagaagtcctgtgttctttgcggcttcaacgatgatatcctcatcgattggcttgatagtgtggatattgataactgttgcttcgataccctcagctgcgagagcttttgcggcttcaatagcttcataaaccataaggcctgttgcaacgatagctatatccttgccgtcacggagcttaacgcccttgccaagctcgaacttatatgtttcaggatcattgaaaacaggtgtggcaagtctgccgaaacggagataaaccggaccttcatggaggatagcggcttcaacggcagcctttgcttcaacgtcgtcggcagggtttattactaccatgccagggatagttctcataagagcgatatcctcgttgcactgatgtgttgcaccgtcttcgcctacagagatacctgcgtgtgttgcacctatcttcacgttgaggtgaggataaccgatagagtttcttacctgctcgaatgctctgcctgcggcgaacattgcaaatgtagaagcaaatggtatcttgcctgttgcagccatacctgctgcaacgcccatcatatttgactcagcgataccgcagtcaaaaaatctgtcagggaatttcttcttgaatatacctgtttttgttgcagcagcaaggtctgcgtcaaaaacatagaggttatcgtacttatcgccaagctctgcaagagcctcgccgtagctttctcttgtagctttcttcttcaattctgccattgcttaaccctccagacttttaagctgttcgtttatttctgccacagcctgctcatactgctccttgttaggtgctgaaccatgccatgaaacgttgttttccataaatgaaacgcccttgcccttgatactcttcattacgataacgcaaggctgaccgcatactgtttctgcctcgttgaatgctttttcaagtgagtcaaaatcgtgagcgtcggctgtgataacgtgccagccaaatgctgcaaacttgtcaacgataggatatggcgacattacgtcctctatctttccgtcgatctgaagtccgttattatccacaacagcaacgaggttatcaagcttataatgagcagcaaacattgcagcctcccatacctgaccctcttcaatctcaccatcgccaaggatagtatacaccttataggtatcgcttgtgagctttcctgaaagcgccataccacaggcaacagaaatgccctgtccaagggatccagaggacatatctacgccagggatagagatacaagggtgaccctgaagcattgcaccgatatgtctgagggacttcagctcctcctttggaaaaaagcctttttctgcaagagtagcatagagtgcaggtgctgtgtgaccctttgaaagcacgagtctatctctctcaggctcttccggcttatcaggatatacgttcatcttggcaaaatagagataagtgagcagatctgcgatagagagcgatccgcccggatgacccgactttgcgttgaatactccctcgagtattccaagacgaaccttgcaggctgtgatctcaagctgtttctttaatgtttcgtccatacttttgacctccaaaaaaatattatttcttcagtttttcaaaaatttcatctatgactgcggaaataaaatcctcctcgcaggactgctcaaagaccttatccgcaacctttttgacctcctctgccgcatttgacgggcaatatgccacgtcagccgcttgaagaagttcaatatcattgttatagtcgcctgcagccacgaaagtaaaatcctccatgccacaagcttttctcagctcctcaagagccgtaccttttgatatattctgtggaagtatctcgtaatactcgatacttgaacgcacaaaatctactcctttgtagcctttttttgccacatagtttataagctcgtccatacgctcaggttcaactgcaaaaagcaccttataccagttcttgtcaggtatctcgtcaacggcacactgaacgggaatgagcttacagatctcgttatggcgcttttccataggggtcatgcttggcacatagacctcgttgacagtaagcacttcacagccaacataaggattatcggcaagtatctccttgacgatatccgccgcaaagcttggcagaaagacgttatatatctgctctttcgtatggatatcgtagaccattccgccgtttgacattatgataggacaattcacattcaccatgtcaaaatactgtctagccgcctgaatggctctgcccgtagcgatagaaaatctgcccccagcctcttcaaaacgcttgacagcggcgagagttttcggggtaggtatcttgcttgcggggagaaaagttccgtccatatccgttataagcaggacttttgatatatcttcaaacataaaatcacttccgtgagtcaattccctgctctgagttttttcagcaccgcctgaaaataatcgggcaattcgctgtcaaactccatatattccttggtcgcagggtgtataaaaccaattttctttgcgtgcaggcactgtccctcgattccctttacagctttgccgtaaacatcgtcgccgtagacagggtgaccgatataggcggaatgtactcttatctggtgggttcggcctgtttcaaggcggaatttcaccagcgaatactgacctaactcctccagcacctcataatgggtaactgcgtgcttggagttttgctctgtcacgcacattttctttctgtcatatttgcttctgccgataggtgcgtccacagttccgataggggcctttaggcgaccgcctgtgagtacagcttcatactctcttgtaaagctatgctcttttatctgagccgcaagaaagttatgtgcgctgtcggtcttggcaacaatcagcagaccgcttgtatttttgtctatcctatggactatcccagggcgaatgacgccgtttattgaagaaagcctgccctgacaaagataaagcaatgcgttcaccaaagtgccatcgggattgcctgcggcagggtgcaccaccatgcctttaggtttattcaccacaagcagctcgctgtcctcatagactatttccacggggatatcctgtggcttgacgtcaagctccacagggtcgggaataattatctcaacgctgtcaccgttatgcagcttataatttttcgatacttttttgcctccaactgtgacgccaccgtcctcgataagcttctgcacagcggaacgtgtaagacctgtatcctgcgctgacaaaaatctgtcgatacgctcgcctgtttcctcggcagttgcaataaaatcaagctttgtcattttcgtctttgacctttatatcgtcacgaatgagctttttcttttcgtcaagaaagcaaaaacagataacgaacaaaattccgccgataacgatacagatatccgcaaagttgaagatagggaaattgataggctcgaacttgatatagtccacaacttcttttacccttattctgtcgataaggttgccgataccgcctgcaagcaccatagccagcgacacaagctccagctttgagcctttgcgtatcttatacatatagatcaccgccacgatcaatacgacaacaggcagaccgataagaaaccaggtctttcctgacatcatgctccatgctgcacctgagtttcttatatgggtcaggctgaacaccttaaagctaccgaactttatgacctccacaggctgaccattcaacggcaggttatttgtcacggcaagctttatgagctggtcggcggcaacgagaactgccatgataacaagcgaaattacaaacatctattccctactccatttatgaacagtaaggctctgcgaaaaacagagcctttgaattaattatttttaccaaatttaagctcagcaggagctgtctttggtataacagggtcgaaagaaccagtgttaagtatcttctcaacgtgctcactatcagtaacaggtgcagattcagcctcaacagtttcctccggctcagctgtttcctctgcctgctcctctgcagcttcctgagtttcctcgactgtttcttcttcctcatactcctctgctgtatcctcggcaggctcggacgcaggaatttccataataagtcttatctgcttattataaagctgagtaaggtcagccttgaactgagttacctcagccttgaggttttcaaacttagcaagctcctcgtcataagcggctcttacttcatttatcttcttttctgttatctcggtattagttctgataagctcagcgcacttttccttatgctccttaactattctctcacactcagaggcactctgctctgcgagtcttacctgctctgttttagcagattcgatcatatcgtgagcctgagttttggcctcagtaagaatcttatttgactctttctgagccacgacaagagcctgctggatagcttcctcgtcctctctgtactcgtttatcttctcaacgagcttgattatcttagcttcggtatcctgatttgcctttacgacttcggcataatcctcggctacctgctcaagaaattcttttacatcttcttttgaataaccgtttttctcggtatcaaaagtttttcctttaatattatttggatttaacatactaggacctccgtgatctttacacaaatttatttaaagttatatgtattctgtcttttttagttgtgccgtcaactgaaagcagcttgaattttccgtatcctctcactgaaaatgtacagccatcttcaagaagtattttcggtgaatttttcggcatatggtctatttcgatgcccacgttttttataagctgtgctgacttttctcgtgatatccttgcggcaagacttaagatacaatctgcacgcatggaagccacagtaccgcttatttcctgagttttctgctcaatatgtatactgccgtcatagccctcccggagcttcactcctgctctgccgaccttcgtcagggcgcttgtaacctcgcctgccacagaagaacgcaggaacaccgctgactttccctctcccacaagaatgtcgccaacgctgtctctttttattcttagacccataagcgagcctaggatatctctgtgagttattttatcctctttgcgatacagcagtgtaattgcagtgataggaaaatcctcactttctgcctcgccatattcaggatagacgcacagcatacgccttgcggcgttttcatatccgccccaaagcctataattctcatatttcacagacgccatgagtttttcgcacagcaggcactgcctttcatcgagaaacgcagaaaattttgttatatacttttcatcagccgccattatccaatcggacactctgtctaacagacggatatcgtcctcagacaggtcgggcaaaaactgatatttagcacgagccatttttagaagctatagccgttattttcaagctcgctcataaggtcaactcctgagaagccaacgtttctaggcatgatagcgaaagttttctgagccatcatcttgatgtctgcaccatttgcatacgcaacgcctgagataaagtcaagtattctctttgcgtcctcgctctttacagtttccaggttaagaagaactgtctttccctcatttatatcgccgccgatagacttgacctctgaaaaatcgtttggtcttgcaagaactatctgcaaagtcgtggtttgctccattcttaccggacgtgcgttattgccatatgcacctgtgttctttggtgcttcgttgtattctgttttattctcatacatcggctgctgatacattgcgtcctcctgctcaagttcatcttcgcctacaaagagattttttaatttctgcattgcacccatttttaatcctccaaatattttctagctccgaaaagctttgttccgatcctcaccaaatttgagccatgctttatggcaagctcatagtccccagacattcccattgagagaatatccatagacacgttcggtatatccttttcctttacactaagaaagataccgtgcattttttcaaaaacgtcctcccctgagccaacaggagggatagccataagtccctttacggaaacgttaggcagctgcgctgtctgtcttacaagctcctcagccatttcagcggaaacgccgcttttagtagcctcgtcgcctatatttatttccacaaggacgttcatagttttattattcttcactgcaagcctgcttatctcatgagcaagcttcaggttatcgacagactgtatcagagtaacgtcattgattatatatttcaccttattggtctgcaaatgtccgataaactgcacttctgcacttttatcgtaagcttccttcttggaaagaaactcctgcaccctgttttcgcccagcagcttaaagccctgagccacagcgaaattcaccttttcaggcggcactgtctttgtgacagccattatcctgacttcttcgtcaggcttacgccattttgctttggcgttctctacattataacatatttccttacagttttcaagaacctccggaaaataattatcctgaggtgacagcgttgctgtctgatctactttgctgcacatcttcatctgataccacctctaacaaaatttgatcgtaaagcagcagataatcctcgtttgaggtattttcagagagcacataatcatcgccctcataaataacattgatcttcttaaaggtaacgtccttgccgagtatcacataaacgcccttctgatcgccctgaaaacgtatcgcacttcttggaactttaagaccctgatactcgtcgaagataagctccgcagactgcactcttgactcaacaagagcttcgtcaagtctgtcacaggaaagcacgacgaccactttgttctcatcgtcctcacaaggcttaacagactccaccttaacgtcatagatgttttttgtggtactgagcgtcattctaagccatgcgccctctgttatccttttatcgttttccatgatccctgctatcctgcatgaatagtcggaaaacattttgccaatggcgttcggtgcgtccttactaggctggccgatgaccttttggatatccttgtcagtgagctgggaagcgttctccatagtaagctcgctctcatagccgtctgcataggaaacaaaatagcctgtttcgtcagcagtgatcgtttttcctgagcctgaggtctgttcctccagctccttgactttcgcctgaagctggcttatcctttcgtcatagctctgctcggtctttgtgacgatattataaatattcatcacaagggacatatcctctcttgtttttgcaaactcagagaaattatcctgagaagaatatgagagaagctccttatattccttatctatcttgcttttgagcgtttcaggctgaacataattagttgtacccggattttgtgctctttcaagggcggctatctcgctttcaagtatctttatcttgtttttcgctgtaacagcgtcctcagaagaataaactgacgctatggtattgccaacagatattttactgccgtcggaataggtatagtccaaaactccgccgccgtcatagttgaccaccttttcatctctgattataacgcccttaaaagcaatatcctcattgattgtaacaagcacagcttcctcggtgtcatgacgctctgtaagtgcactgtatatctgactgccgatagttgtgattatcagcacagaaagcagaccggtaagtattttaacggtcagagaattcattttttactgccctcttaaatatctgaattgcctgcggcgtcaagaacgttgatatatcttgacggaacgatagttgagatagcatgcttataaactatgttctgcttgccctcgcaatcgagaactacaacatagctgtcaaagccctttacaacgcctttaaactggtagccgttcataaggataaaagttgacgctatcttgtcttttctgatctggttgagtataacgtcctgaagattaagattcttattcataaataacactcctaaaaatttttacagcaatgtattgcttttttactataaaatctttcaaattatattatatcacataatttccgatttggctataatatttttgatattttctataattttttgaaaactatcaaatttatctgtttccacccactgaattccgtcaactcgtctaaaccaagtaagctgtcttttggcataatgacggctttcctgtttgattttgtcgagacattcacaaagctcagctttgccttcaaaatacggcacgagctccttatatcctatagcctgataagctgtagcaggggtaaagctgtcataaaaaactctgcactcctctataagcccgttttccaccattacatcaacacggtggtttatacggtcatagagatactgtctgtcggaagctgtaagaccgataatgcaggcgttatatggcgacttctcacgacggctgttcaccttatgctgtgaaagcggtatacctgtagtttcaaagacttcaagtcctcgtatgactcttggcaggttgttctcatggactttctccgcagtttcgggatcgacctctctgagcctttcccacaaagcgtgaccgcccagcgtcttggcttccttctcaagacgttttctgaccgagccgtccgtttcggtatcgtcaaagattacgttattcacaagtgagcttatatatagtcctgttcccccgcagagaataggaactttgccacggctgtgtatctctctgatacgctcacctgcgagcttcacataatctgccacggaaaaagcctgctcaggctcgagaaaatctataagataatgtggcacgccctgcatttcctctttggtaggcttggcagtagcgatgctcagacccttatatatctgcatagagtctgcggaaactatctcaccgtcatatatctttgcaagctccactgcgcaggcggtctttccactggcggtaggccctgcaatgacaaggagaggtattttattttccatagctttcgcctcctgcattttttatagaactcgtctgaactgcttttcgatatctcttttggtgagggttatcataacaggtctgccatgagggcaatatctgatattttcctgaccataaacggcgttcactagcgcctgcaattctattccgctgttggtatcgttcgcctttattgccgctttgcaggcgatagaatggtagaggtcgtcaaaaagctctatttgcggattgagtttattctcgataaaattctttgcaagttcgctgattatatccgcagggttatcgtcaccaagaatgataggcacgccctttactgcaacagttggcgcaacgtccggctctatctcaaagccaagctgtgacaccttatcgaggtttgcggtgagagcgtcatactcgtcataggaaagcaataccatgataggctctaggaacatttgcgtttcaagctgttcggcatcgctttttatcctctcgaaaatatatctctcatgggcggcatgcttatccataagtatcatttcgtcccccacctgtgccacaacataggtcttgaaaagctcgcccaccacaacaggcttcggcttttcaggctctttctcctccacgataacagaaacaggctttttctttgtgaagctttgagcgtcgataaacttgaaagcttctccgctctgctcctccggctcttcggggagaggtatctcgcttatcgccttgtttatctcctccactgtcaccttatggggtttcggctcgggacctgaaagttctgtaacggctgtttctctctttgcaggctgttcaaggcttgcaaggaacatatcgtcactgccgctgagcttttctttttcctcctcagttatgctcctgctctcgactgttttaagcgttggtgcaggcttttgataactgtacgaattttcgtactgcttttctgtctgtggctttgggacagatatatcagcctttgaggcaacaggcttttgactattatcctccatggcgaatttaagctgaacgctgttatcttttttaggtatatcaaaaagctctctgtcggtgaaattacgcttgttttcaaggtgcatctcattgggtctgtcgttcttcataagggaatttttcaccgcaaagaacacagcctcgtgcataagcttttcgtctgaaaaacgcacttctattttagtagggtggacgttcacatctatggtattcggtgggatatcaatatagagcacgcacgccggaaattttcccgtcataagaagatttctgtaggcttcttcaagtgccgccgcacaagcccttgatttcacatatcttttgttcacaaagaaattctgaaaacgtctgttaggctttgcagacagtggcttgacggtgaaacctgttatgtgcataccctgccatgtatagtcaacttcaagcatggagtttgcaaaatctctgccataaactgaataaactgcggaatatatcttgccgtcccctgctgtcaatatctcaactttattatccctgatgaacttgaatgatatctcagggtgtgaaagggtaagctttgtaacaaggtctgcggcaaaattgccctctgaaacgtcctttttcagaaactttagtcttgcaggaacattatagaaaatatccctcacaacgaatgttgtgccgtcaggacagccgcactcctcgcaggtcttttccactgcgccctcgataacataatgcgtgccgtaatcctcctcaggacgtttcgtgagcacgtccacttttgatacggcacagatagaagcaagtgcttcacctctgaagccgagggtcataatactgtcaaggtcattttttactgatatcttacttgttgcatgacgaagaaaggctataggcagatcatcttttgagatacccttgccgttatccgtcactcttatataggtgcggccgccgttttttatctcaactgttatgacgttcgcacctgcgtctattgcgttttcaagaagctcctttattattgaagcaggtctgtctattacctcgcctgccgcaataagctcggaaacttccttgctcagaacttttatttctgacatttttctatccttttctatggctctttccaaaagccgcctgtatgaaaattctccttgcctgtcggctttgctgtcaagcggaacatgacacagccgtcaggacagacgatagtttttgtatatttgctgtcgccgcctatctttgtcatatcgccgccgctgcggacagcttccataatgggataaagcatcatcattgttttactgcaaatgccatagccgttcttattcacaggacagccataggtgcagaaatatttatcccctatctcctcgccgtttcggcaatatctttcagtatggtcgccacggagaaagtccgtgacctctatttcaaactcgtactcctcgtcataccactttttcatgacgctcacctaaacatatctcagcaagtctttcacaaaatctctaagctcgctgtcggtcatttcgtctatgttagtctttctaagcctatcggtaacgatgctgtcgcttattttgtcaaaggatatctggtcgctttctatctgctgagcggcaattcttgcctttttgttttccgcttcaagctgttcgagaagctctttggctctatttattatcttgttcggcagtcccgcaagctttgcaacttctatgccgtagctttcgtcaactccgcccggaactatctttctaaggaacttgatactatccccctgacgctttactgcgacggagaaatttctcacgccctcgagctctttttcaaggcttataagctcatgatagtgtgttgcaaacagggtcttgcagcccattgatctgttggtggagatatactccgacactgcccttgcaatggagattccgtcaaaggttgaagtacctctgcccacctcatcgaggataacaaggctgttttttgtggcgtgctttacgatatctgcaacctcgctcatttccaccatgaaggtagactgacctgcggtaaggtcatcagaagcgcctattcttgtgaaaatctggtcgaccacagatatttttgcatagtccgcaggtacaaagcaacctatctgcgccataagggtgataagagcaacctgacgcatataagttgatttacctgacatattcggacctgttatgactgccattctgttgcttgtaagatcaagatatgtgtcgttaggcacgaaaacctcatctttctgcataagctcaacaacggggtgtctgccgtttttgatatcaataatgccgtcaatggctatctcaggctttgtatagttattgttcaccgccgcagttgcaaacgagcaaagcacgtctatctgcgccactgctgtggcagtttcctgcacaagtctaagctgtgtggctgcaaaatctcttatctccgcaaatatctcctgctcaagagttgctatcttatcgcttgcaccgagaatagtgttctctgcgactttaagctcgtccgtgataaaacgctcgcagttggcaagggtctgttttcttatatagttgtcaggcacaaggtcatagtaagactttgttacctcgatataatatccgaaaactcggttatagcctattttcagatttttgatacccgttttttctctttcacgctctgcaatatcatcaattatacccttgcctcctgagattatatttctcagtccgtcaagctgttcgttgaagccgtctttgataacgttgccgtccttgacattaacaggcggttcgtcaacaatggcgttctcaacaaggtttgagatagcttcaagggtggatattttattgttgcagtttgcaagaagctttgaatcaaaacctttgagaagttcctttatctcagggagtttaagtgctgtcagcgacagtgatttaagatctctaggggtagcggtcttatacattacccttgtcatgagtctttcaaggtcatagactcctcccagtatctcttttagctctccaagttcaacaggcttcattgtgagctgttcaacagcgtcaagtctgtcgattatctttgcaggattgacaaggggctgttccaggaaggattttagcatacgcttgcccatggaagttttggtatggtcgagcacccacaggagcgagccttttttctctttatttctgagagtttctgtaagttccagatttcttcttgcagtgaagccgatagtcatgatagggtcggcgtcatgctttattatctcggaaaatctgcccaccagtgctttctgtgtatcgtgtatgtatgcaaaaagtccgcacaccgcaaaggctgcaactgtgtcaggctttacgccgatagattcaaggctgtttgtggaaaactgtttcagcacctcttctgtatgtatctcaggggaaaaatcgttctcctccaaaagttgaacgctggtcttgagcttttctcttatgaagcttgaaagctctttatttgaaagaaaagcgtcatttataagaatctccgcaggtgaaaatctcgacagctcatttatagccgagcttgtcatttccttgccctcaaactcaaacagatgcacctcgcctgtggaaatatccgcaaggcacaatgcgctttccttggctctcatataaaatgcacagatatagttgttggacgtttcatcaagcatactgctttcgatgagcgtaccaggggtgactactcttatgacctctctcggcactatacccttgcacatggcagggtccatggtctgctcgcagatagccacattgtagcctttttcaataagctttttcagataaacgtcgcaggcgtggtgaggcacaccgcacataggcgctctttcctctagtccgcagtcacgacctgtcaaagtaagttcaagctctcttgacgcaatgatagcgtcatcaaagaacatttcataaaaatctcccagtctgtagaacagtatatggtttttatatttattctttacttcaaaatactgcttcatcattggtgacagctttgaaaaatctatatctttggtttccactcaaactcactccgtttcatatatttatccacgcacatatcccattatgatattcgttcaacacacattgttgcgccatatccctatagaaattatccgccccagtctgaagtggtcttcagattcgggcagacgggggataagctccccctgactgttattcgttttttgataccgtcttagtgacagccgccgcatgatgcgcagcttcctgaacagctatgaggagcttcctccgggcaagtcattgggtcttcgccgtttgcagccattgagatgatatagtttactgagccgagaagcttatccataacttctttagcttcgttaaatgcgatcatcttaggcatagccatgatctcgtcataaagctctctgatctgagtgtcaagtgctgtcatcttctcgccgtccttatcaggcttctgcatctcaacgctgagctgtgaacggagctgattgaactcgcctattttgttctgtatctctacatctgtatcattgatagaacaagcctccatataagccttgtatctctcgtcttcctgaatagcctgtccaagctttcttgtcatttcaattacatccatggtaattctcctttaaatattattcagctttcgctgttatttatcttcaacaagctcgcctttcaaagcccagttcattgcttttgttatgcgaacctgaatgaatttaccgatatattttttatccgctttcacctcgacgatcatatcctcgtcgctcttgcctgtgagataatcagcgccagttctgccttcgcctgttggcagcacggttacagttcttcccacaaatcttgaaagccacgctgttgacacctctctctgctccaaaagcagttctctcagccacagacccttctgcttatctgagatgtgatcctccatttcggcagcctttgtgccgcttcgtcttgaatacacaaaagaatagatattatcgtactttacctttttgataagctccttagtttcgcagaactcctcgtatgtttcacttgggaagcctacgataaggtctgttgtgaatgaaaactcagggtctttgcttctggcatagtcgattattttcagataatccgccgtggtatagcggcgattcataagctttagtatcctgtctgagcctgcctgcacaggaagatgcaaatgcttgcacacctttttgcactcaagtatagcgtcaataagctcatggcttgcgtcctttgggtggcttgacataaatcttatgcggaaatcgccctctatcttgtcaagctctcttaaaagctcaggaaaaccatagctgtatgaattaacgttctgaccaagtaatgttatttccttatagccgtttttcacaagtgcttttacctctgcgataacggactcaggctttctgctgcgttctctgcccctgacgtaaggcactatgcaataggtgcagaaattgttgcagccatacatgataggcacgaaggctcttatcttatcgtcacggagttgcaagaaatcctcgtttatgtcaacatgattttctgacagattgaaaatcctgtcatgctttgatattatctcccacagcatattgtacatatcgttgtatgcaaaagttccgaaaacaagatccacctgacggtaggtcttttttatcttctctgcaacgtgcttctgctgagccatacagccgcagatacctataataagctcgggattgttttctttgagatgtttaaggtcgccaagcttgccgaacaccttgtcctcggcattttctcttacagcgcaggtgttatacaatataagctgagcctcgttcacatcggacgtgaactcatagcccacctttgagagcataccttttatcttctcaccgtcactgacgttttgctgacagccgtatgaatggataagggcaagtggcttgtgaccgcaagttctttcgtattcaccagaccattggagcagcttctgcggagcggtttcctcatttattatttccgaaaaattctcagtcattgatatcctcatttcatttcgtacattccctttaattataaatcttttcaggcttcttgtcaagcgttttgggagcgaagagccaaacaggttgctttgcaaaacaaaaaggggcagaaaactccgcccccatagatcacatattatccctgagcttcgccctgaccctctgtatcattttcttccttgcagtggggttcttcaagtcctcttgggaaaaattctactgtcgggaatgctatcttttcaaacatctcgcatgggctgtcactgtttgtggaacactccttgccaggtacgcagtaatcatatacaggcaccattataggcacaggtcttgacaactgaatgatagcgaaaagtccgatagtgataagaacgttcttttcctcgcttggtgcaggctctgcgacaagctttgcgtcaagacacattggcgctgctacgctcacagaagcgcaaggcgttgccgctgtgcagcaacagcatgagcagccgcttgtaggcgaggtagtgacgatctggttcggctcgcaggtcgaaaatctctgtgtgccgccgtcgctgccgaaaagaataactttttttgtgaatgatgaggtgccgtaaactactgttggagctgcgcctgccgcttcatatgcttctatctgcgccctgaatgtgtaagtaacgtcaactgcgtaaaagccgtggttgaatgccaccggagatattgcaaagcttacgtctgtcacgtcgatacaagtgcttttgatatacgccgcagcgtttatcacggtctggtctgcctggctgaatgtaaacgcaagatcctccagacaatcctgtgacgagcatgaatcaaacacacgcattgcctcgatacacattgcttccttgaaaggtttgccgttaaaatcgctcatagtaagtcctcctataaatcaaatcatggaagtttttttacttcgctatattctattcggcaaaaggcttttgtgtgcttaaatttctgaaaatcctctcataaagcaaaaaaaagccctgcgcatgaacgcagagcctttggatacatataatcaggtgttcttgtctacctgatgaaatttcttcagattgcctattttttcgtttctctcgtcaaggaccttttccacgtcagaccactcaagtccctgatttgccgcaagcaccataacgtgatagagaaggtcgtttatttcgtttttcagctcgtcattgtcaccatttttagcagcgataactgtttctgtagcctcttcgcccacctttttgcaaatcttgtctacgcccttgtcgaagagataagctgtgtagctgttctcctgagccttgcctgcttcatagtcagctttgcgctgttttattacctcgaaaatctcctgataaactgtcattttattcttcctccgtattatatatctcattgaaaaagcagctatatgagcctgtatggcaggctgcacctgtctgctttacgttaaggagcagggtatcgttatcgcagtccgcatagatagaaactaccttttgcagatgaccgcttgttgcacccttgttccaatattcctgtcttgatctgctccaataccatgtatagcctgtttcaagtgtttttttcaggctctccttattcatataagcaagcatgagcacagtttttgtatccacatcaaatgcgatagcaggtgtaagctcgctttttacgaagtatttatccagatcgtttatatcaacttttattgggttcattatttgtcctttctgttgccgtcttggtcgaaattatctttgagtgctcgttctgttggtactatcgtccagcacaaaactaccacctgtatcacttcagctatgcacattatcacagtcgcattgccgctgctcataaagaaatatggaacacagaccaatgccgaaattatcgtcatgaccactccgacctttacccacagacgtccgcaataattgttggcaaaatcccacgtttcctgatttttcattgacatagcagtgcgatagcccaccaagccgttgatatctttcggtgtatgcttatacatcagatagccgcacaatatcataagcactggtataaacaaagtaaatacgatattgaaaacaagcattatgctcacctcacgataattcccttgctcctgcaatcgtcctttacctgtccaactgtcagctctttgaagtggaaaaggcttgcggcaagagccgctgagcaatcagtttcaaggaaagcttccgcaaagtctgaaagctttcctgctccgccgcttgcgataacaggtatctttacagcactgcacacagctttcagcattggcagatcaaagccgccccttacgccgtctgtgtcgatagagttaaggcatatctcacctgcaccgagctgttcgcactttttaacccagtcgataagatcaattcgcatatccactctgccgccattgatgtagaccgtccacttgttgtcgccgaccttctttgcgtcaacgccaacgcagatgcactgacagccgaaaatatccgctccgtcctttataagctgaggattctgcactgcctgagagttcacagacaccttgtctgcgcctgcacggagagtatctctgatatcgtcaacagtctttattccgcctccaacagtgagcggtacaaataccttttttgctgtttcacgaacaacgtcaagcataactcctctgccctcgtgggaggcagttatgtcatagaaaactatctcgtccgcaccctgcaaattgtattcatatgcacattcaacagggtcaccgacttcttttatgccctcgaaatttacgccctttactacctttccgtcacgcacatcaaggcatggtataattctttttgcaagcatattattttacctcctgtgacagtttcgcaaagttttcaagtattttaagaccggtctttccgctcttctcagggtggaactgacagccgaatatatatcttccgtctgataccaccgcagggacttttgagccgtattcgcagtaggcatacagatttttgttgtcgcagaaagctttatatgagtgtacgaaataaacatactcgtcatcgcccagaccgtcaaaaagaggacaatcatgattatacacaagcttgttccagcccatgtgtgggataacaaggtcaggctcgtttatcttgtcaacatagccgccaataagaccaagacccttgcattcctcgaactcatagcttttctcgaaaagaagctgcattccaaggcatatgccaagaaaaggctttattttagcctgctccttgatagtgtcgataagaccgctaagaccgagcatattcattgcccatgggaacgctcccacgccggggaggataattgcgtcggctttttcgatatcttcttttttgtctgtgagcttgttctcaaagccaagatagtccagagcgttttttacagagaatatattgcctgcaccgtagtcgattattgctatcatttaaagcactcctttggtggataaaactcctgttcctgttatttttacagcgtccttcaaagcgtgagccactgccttgtacattgcttctgcaatatggtggtcgttcttgccgtactcctcacggatatgcagtgttatgcctgagttgaaagcaaaggctctgaaaaattcctccgtcaggcaggtgtcatactgacctatcctgtcgtcatggaactcagcattgaacgcaaggaaaggtctgccgcttatatccagtgagcagaatgccagcgcttcgtccattggcacgaaagccgagccatatcttgcaatgcctgctttgtcgcccaatgcttccgcaaaggctttgccaaggcatatgccaacgtcctcaactgtgtggtgtccgtcaacataaaggtcgcctgtgcactcaacgtccatgtctattccgctgtgaacgccaagggctgttagcatatggtcaaagaagcctatgcctgtgtttacacttaccttgccctcaccgtcaagcttcacgaacacctctatatcagtttccttagtttttctttttatctccgctgtacgcattttcatcacctttaccgcttaaaatcttacctttatcgcatttgcgtgagccgtcagaccctctttttctgcaataagaacgatatcgtcctttgcttctctgagagcgtcctcagtgtaatatgtaaagcttgaacgcttctcaaagctgtttactgacagaggtgagaagaatctagctgtaccgcttgttggaagaacgtggttagggcctgcatagtagtcgccaagcggctctgaagcatactgaccaaggaatattgaacctgcattatcaagtctgccaagatactccatagggttttcaaaaagcacttcaagatgctcaggagcaaatctgtttgcaaggtcgcaagcttcgtcctttgtattgcagataaggatagcaccgtaattttcaagagagctttcgattatctcttttcttgaaaggctctgcacctgtctgtttatctcttcgatagttctgtctgcaatgctctcacttgttgtaacaaggatagcggaagcaagcttgtcatgctcagcctgtgacataaggtctgcggcaatgaacttagggttagccttttcgtcagccataacaagtatctcgctcggacctgccaccatgtctatatcaacaacaccataaagaagcttctttgctgttgcaacatagatatttccagggcctactatcttatcgacctttggtatctcctctgtgccgtaggcaagggcagcgatagcctgtgcgcctccgctcatgaacactctgtcaactccgcagagagcagctgcaacaagaatatccttatttggtgtgccgtctttgagaggaggggtcaccatgattatctccttaacgcctgctatctttgcaggaactgcattcataagcacgcttgacggataagctgctgtgccgcccggaacataaagaccaactctgttaagtcctcttaccttctgaccgagaatacagccgttatccttagcgtttataaagctctgtgacttctgtctttggtgaaaatctgtgatgttcgcaactgcgttgagcattgcgtcaacaaagtcctgatcggcttcagtgagagcgtcgtttataacatctcttggaacttcataatactccgggagcttgccgtcaaacttttctgtataagcctttacagcgttgtcgccgccctctctgacagtttcgattatttcattaacaacggctgtgaccttcttatttgtttcgccacttctcttttcaagctgcttgaaaaactctacctcgtctttgccgttgacaaaaatcttctttatttcagccatttcaatactgtcctttccgtttatataaactacttgtcgatattttcttcaacaagctttacaaaattctcgatctcctgctggcgcattttcatgcttaccatatttacgataagccttgcagagatagggcaaacgtcctcgatgacttcaagaccgttttctttaagtgtcgtgcctgtttcaacgatatcaacgataccgtctgcaagctcaaggagcggtgcaagctcaactgagccttctatcttgatgatgtcaacgtccattccctttgcttcaaaaaatcttcttgtgatgttagggtattttgttgcaactgtcttgacatcaaatccgccgtagaactttgagcctttctttgtggcaagtgcaaatttacatctgccgaagccgatatcaacaagctcaaagaacttgccctgcatttccatgatagtgtccttgccaacaacgcccatatcgcacacgccatgctcaacgtatgtgataacgtcgttcgcctttgcaagcacaacttcaaggtttccgtcaggtacaggaagaataagctttcttcccttttctcttattgcggtacagtcatagcctatcttctctaaaagaccgactgtatccttttcaagtctgccctttgtaagagctatcctaaggggtctgttcattttaacttatcctccaaacttatatatcaagctctgttatctcgctgccaacgaccacaagcttctttattccctttgactttgcgtaagcctttgtttcatcgagagtgttgaaaagcgagttttcaactgtcagaccctctcttacgagcgtctgagcatattccatggcttccaccacgtagcccttttcgccaaacacaactgcgtcaggagttctgagctttggtgctccgcctagcttttcgatatgtcttgcaacagagtcaacgcttatgccgaaacctaccgcaggacaatcgttgccgaactctgccagaagtctgtcatatcttccgcctttaagcaccgactgaccgacctctgaaagatagcccttgaacacaatgcctgtgtagtaatccgcatgactcacgatgccaaggtcaacagatatcttgccctcataaccaaggcttgaaagtctggtgtagacctctttaaggttataaagtatgcctgttatcttatcgtcagtataaatatcagcagccttgtcgaacacctcaacacctccgaacagtcttgggagctgtctgagcgcgttagtcacctgattgtcgcccacctcgtcaaggatatcattaagtgcaggatagttctttgcagagataagaagtcttatctcctctcttactgcgtcgtcaacgtcaagctgagccacaagctccttgaaatatccgatatgacctatctcaagtctgaagttctccttatcaaagcttgaaagagcctccacagcagtgcatagcacctcgtaatctgctctcttggaattttctccaccaataagctcgatacctgcctgaactacctcgtctgaacgtcctttgagcagggagttattttcaaaaatgctctgattgtagtatagtctaaggggaagctttgctccctttagtcttgtggaagcaagtcttgctatgggtatcgtggaatcaggacgcatgacgataagtctgccctttgagtctgtaagtttataaaggctctcctgctggaagtttctcgagcttcccataaacagatcgtaaaactctattcccggtgttaccacctcgctgtagccaaagccctcaaacagctttgacagcctgtcctccaccattcttcgtgccagacagccctcaaacagcagatctctcgtaccctcaggggttataagatcatatcttttcatacacttttccttcctgtatataaattatagattgtactttttatgttgttatgtaatgcctttactttatcgtagtaaagtgatagcatagtatcaacacaaataattttatcacacccgcccttgtttgtcaatagtgttacaagggcaaagtatgaaattgtgcatagtaactatcagaacaacgatatctggttagatttaggcatatcgccgaaagctccgtttttctccagagtttcgataacagatttggacactccgctctgctgctggaactcctcgatagagataaactcgccgttctgcgccttttcgtaaatgcttatcgccgcagactcgcccactccgttaagtgaacagaacggaagccttatcttgccgtcctctatctgatagatagttgcgtgagattttttgatgtttacaggcaaaaagtcatatccacggctgagcatttcattcacaagcatgagaatttcaagcacaccgctgtccttgcccgacacctcgtcttttggtttattctttatttcttctatcttgcttctgacgatatattttcccttgagagcgatctctgcgtcaaaatcctcgcccttgaccgtaaaataagttgcatagaacgcaagcggctcatgcaccttgaaccaacaaagtcttatagctgccgtaacatatgccgccgcatgggctttcgggaacatatattttatcttcaaacaactgtcgatataccactccggaacgtcatgctgacgcatattctctttcatttcctctgtgagcagtttcggagcttttcccttacgggttatctccattatcttaaatgacagctttggctcaacgccatgataaagcagatatgtcatgatactgtcacgagtaccgataacatttgagatatcgcaggttccgtttttgataagctcctgtgcgttgccgagccatacgtcagtgccgtgtgaaagtcctgatatctgcaaaaggtcagagaagtttttcggctgacagtcaagaagcatttgtcttacgaacggcgtacccatttcaggtataccgagcgttcccgtctgacacattatatcctcctccgtcactccaagtgactcaggggaagtgaacagcgaatagaccgcagggtcagacatggggcaatcgaggatatctcgacctgtgaacatttccagatacttatacattgtcgggttatcgtgaccaagctcgtcaagcttcaagatagtatcgtggagagaatggaagtcgaagtgggtagttaccatgtcagagtccactttttccgcagggtgctgaacaggtgtgaagtcatagacctcatagtcgctagggataacgaccattccgcccgggtgctgagaagtcgttctctttatgccacagcaaccaagcttaagacgctctatctcagcctttggcactgtttttccacgctcgtcaagatatttcataacatagccgaaagcggtcttttcctgaatcatgccgatagtaccggctttgaacacatggtcctcaccgaaaagaacttccgtatatttatgcgcctttgcctgatagtcacctgagaagttaaggtcgatatcaggggctttatcgccgtcaaagccaaggaacgtttcaaatgggatatcgtgtccgtcacggtgcatattctctccgcacacaggacagtttttcggtggcaggtcaaagcctgagcctaccgagccgtctgtaatgaactcgctgtggtggcagttaagacagacatagtgtggcacaagagggtttacctcagagatacctgacatggaggcaacgaaggacgaacctaccgagcctcttgaacctacctgatagccattctcgttggagttggcaacaagcttctgagatatcatgtaaagaactgcaaatccgtgcttgataatagagtcaagctctcttttaagtcttttgaaaacaaggtctggaatgtgtccctcaaaatattttgatacgtcaacgtcctcgccctccggaacttctatagtttcagggtcacagtcgccgtaaatggaacagcatttcttccagcatatatactgaagctgataaaccgagccttcgataaaaggcgtataagtaccgttcggaaacgctttcaggtcagggtctaccatatcagccacgttgtttgtattcgttacaacgacctcaaacgccttttcctcgccaagatagctcagctcgtcaagcatttggtttgtggtcttaagatacaaaggaggctgagtatcggcgtcagggaagcccattgaagcctgtatcaccgacctgaactgtgcgtcggtcttgtccatgaaatgcacgtcgcctgttgcgcagacgggtatgcccaagtcctcaccaagttttacaataaagcggtttatatcctttatatcctccgctgtgtgtatcctgtcataaggaggcttttcggtggtgagcataaatttgttgtttccgtcaggctgtatctccagatagtcataaaagcttgctatctgcttgatctcctcatagtttctgccctcgagataagcctgaatgacctcgccacgctcgcaggcactaccgagtataagaccctcacggtgtcttacaagctcagattttggtattctcggacgtcttttgaaatatttaaggttcgagtctgatataagcctatacagatttttcagaccagtgttatttcttacgataataatttggtgataagtcggctttgcaagcacctgattttcatttgcaagcaagctgtttatcatatccactgttataagaagcagaggatactgctccatgagcattttcgacagccttatgaatatccctgcaagcacctctgcgtcatcacagccacggtggtgctgaaaatcccccagtccgaaatgctccgccacatagttgagtttatgcttttcaagctccggaagcattatctgcgacattggcacagtgtctatagaagaatattttatctcgatgccctgtctttttgcgcaggcggatataaagcccgtatcgaactgagaattgtgcgccacaagaacagggtcgtcgccgataaactccttgaatttaaggagagcttccctttcgcttgcaccgtcctttaccatatcgtcagtgatgtgggtgaggtttgagataaactcagggataggtctttcagggttcacgaaaatatcgagcttgtccacaacttcaagatctctcagcttgacagcgcctatctcgatgatcctatcttcattaggatttgtacccgtagtttcaaggtcaaagcagattatctcgtctgtaagctcacgcttgtccgttccacggaatatcttttcgtcattattgacctcgtatgactctatgccgtaaagcaccttgaagtcaccgccgcccttgcgtatgccgatacaggtatttcctgcgtcaggatagccctgaacgacaccgtggtctgttatggcaagtgctttgtgtccccatgaataggctctttccacaagcttgcccgcaggagtgagagcgtccatcatagacatattggtatggcaatgaagctccacacgcttatactcgcaggtatccttttccttttcacgctttacgaccataatgctgtcaggcttgatgtttatagagtggtcaaaatcgtcctcctctatctcacctgccacaagtatggtcttgcctgccttaaggtgttcaagcattgcctcaagcactgcccttttcaagcctttcatgtttctgaaattcttgtttgagcctatgaactttatagagtttgaggaagtatagtcggtaaaattcaggtgtgctataagcatacccgactttgtttcctttgtttccacaggtccgaaaatatcgccccagactaccacacgtccacggtaatccgcagggatatctttcatctgcatcacctgctcgtttcctgatattggcgcacccataagcacaagagagtcatcgcacagaagcgagaaccttgtgaagtccacatttgcagttcggaaatccacagaagcaccgcttgcagtattagtggtaacagccgcctttttctcaggctgtgcagggtctattttcggcacagggagggagttcaaaaactcctcctgctcacgctgatgctcttccatatcagtttcaagcacacctgtgagccttatatccgcccttacggaaaaaagctccatggtgagcgcaggaaaagccgtttctatgcccgcctttttcagcaacgcttcgcccccgtgttttatatccacggtgaaaatgccgttttcataaacagcctcagcgttgtcaaaaaagccgttcacaagaggaaatctgcttttaagaaacttgcaaagctcaggaaaatactccgcacaaagcatatcaggggtatatttgagctgcaaaataaactttcctgctccgagagccgccctcattttcatttcaaattccactgtgctgtcaaaaggcaccagcttgtcaaaagccgcctgacaggtaaaagtgccgttttcttcgttatagcccagccttaatatcctgcccttttctatcacagagggtataagctccttatagttctcaaagaagctttcaatggtgtatgtattcatttatggtatatccttttaaagtttttctatttccgccagaagcgcaggcaaagcctcctcctctgatacctttctgagcttttcaccgtggctgaatatcaccgcacagccgtcaccgcctgcaatgcctatatcagcgttgcccgactcgcctatgccgttcacaacacagcccataacggctatcttgatatccttgtctatatccttggtggcttcctcaaccttttttgcaagacctataaggtctatcctggttcttccgcaggtagggcaggaaactatccttactccgccgcccttgccgatagctttaaggatatcctttgcggcatatatctccttgacaggctcgtcagtgagagatactctgatagtttcgccaatgccgtcgcagagcagcgaacctattcccactgctgattttataagacccattctctcagtacctgcctcagtgacgcccaagtgcagaggataattacaggtctgtgcacacagtctgtatgcctttatcatggtcggcacgtctgatgactttatagagataactatatcctcaaagtcgcactgctccaatatcctcacatgacccattgcactttccacaagagcctccgcggttggcgaaccgtatttcgcaagcagttccttttcaagagaaccgccgtttactcctatccttataggtatatttctttcacgacatgctttaaccaccgctttcaccctatccatagagccgatatttccgggatttatccttatcttgtcgataccagcttccgccgccgcaatggcaaggcgatagtcaaagtggatatccgccacaagagggatagagatcttctctttgatagcagggataagcttaacagcctccatgtttggtatagccgctctgactatctcgcagccagccttttcaagctccacagcctgcttaacagagccttctatgtccgtagacggcacattgagcattgattggatatatatctttttgccgtcaaggacaagtccccccaccttgacaggtcttacgtttctcttattttcacctgacataaacagttcctcctttaaacaagcttgatgatatcgctcactgtcaccactaccataagaagcaacagagccgccataccgatagcgtgtaccattccctcatgctcaggcttgacaggcttacggcgtaccgcttcgataataagaaacaaaagtcttccgccgtcaagtgcaggcaatggcaagagattgaaaatgccgatatttatggtcatgaacgcacccagcgacatcattgtgtcaataagtgacgaccagtctatcttgcccgactcgccgtccctttcgctgtcgataacattgtcgatagtgtcaacgatacccacaggaccgctgaggtcttttatggaatactttcctcttataaggtctgcaaaggagatatagataagtctgccgtcagtacagccctgcttaaaagactgagttatcacagagccgacggtcacagcttttggtgcgaccttgaaatcaatgtgcatggtattatcgtccgttgcaaaggtgacatctttaagctccaccttttttccgtcacgcttcaccaccatatcgaacttgccgtcctcatcgttgccaaactgataggacatatccatagtagtgaaaatcctcatgccgttgacctcgattatctcgtcacccacctgcaagccggtcgattgggacatagcgttatcctcaaaccacgatatagtggtggttgcgatgccgtcagaccttgcggtgctgatacaaaggataatatatccaagcacaagattcattataacgcctgccaccacgataagcattctttttggcaggcttttattacaaaacgcaccgccgtcctcgcttccgttatcctcgccctccatggcacaatagccgcctatgggaaacacacgccaagcgtaaagggtatcgccctttttctttttgataatggcaggacccatgccaatagcgaactcgttgacctttactccgctggctttcgccgcaataaagtgaccaagctcgtgtattattatgatagcttcaaagatcaatattccaaataatatactcatttttttacctcgcatgattactttgtgcgtttggtttactgatgttgtggtaatttatctactgtaggggagcggcgcaatttctgctttgcataaatccgacgtcccgacccctccgacatttcgtctacaatctcatttgtgttatccacataatgttttctacataagctctggataattcaaacctcgctcctccgagcggactgtcgagggcgccagcccctacaaatattcgggatagtttatcttgccgcaaaatcgctttgctctttgctcggtatggctttgccattcctcactcctcacttaaaagccgctcctcactaagctccgataagctccttcgctctctccctagcctttctatccgcttccagcacatcttccacgcactttatctcttcccgtggtgtattctcgcagacattcattactatcctaccaatgtcaagaaaatctatcctgccgtcaagaaaagccgcaacggcttcctcattcgctccattcactgccgcaggaagatttccaccgatagtgacagcctttatacaagccctcagacaatcgaacgtatcatagtcaggcttctcgaaagtgagttttccatagtctgtaagggacagctttttcacatcgcattccactctctcaggataaagcagagcatactgtataggtattttcatatcaggcacgccaagctgtgcgataacagaattatcctcatactccaccgctgaatgtacaacactctgtctatggacaactatctctatctgctcaggtctgagcttgaaaagccacattgcttcgataaattcaagacccttgttcataagcgtagcagagtcaatggttatctttctgcccattgaccaattagggtggttaagagcctgctcaactgtcacgccctctaggtcagactttgttttgccaaagaatggtccgcccgaagcagtaaggattatccctttgagcttattgccctcgtttccctgcaggcactgaaagatagcagaatgttcgctgtcaacaggatatatcttcacgcacttttcagccgcagcctttatgacaagctcaccgcctgccacaagtgtttccttatttgcaagggcaatgtcagtgcctttttcaatagccgtaagggttggcacaagacccaccatgccaacgactgagttgagcatgatatcgacaccgtccattcttgctatctctttaagtccatccatgcctgtggatatttttatgccagtgtcactgagaagcttttcaagctctgcctttttgtcctcacggtagatacacacacgctcaggcaaaagctccttagcctgagccgcaagcttttcaacgtcagaatttgccgcaagcgcctttactttaatattatgctttgcagccacttctaatgcctgcgtgcctatagaacccgttgaaccgagtatggtcattgttttcatttattgtccctcatcatataaaataaattcaggcaattccgcataaagatggtttgcaagcggtgttgccttaataacgcttaaaaggggtaagcctaagcctgcccctaaaagtcataattttctatttaagtataagcccctgtgtgaacatatagtacataaaaggtgcaacgagcagaacgctgtcaaatcgatccattattccaccgtgacccggcattatgttgccatagtcctttatacctgtctgtctttttatcaccgaagctgtaaggtcgcccacaagtccgataagagccgcaagcatacctgcaattaaaacgcccagatagtggataggctcgcctttaagtacgaactgatagaacaggcttattataagcataagaataccatttgagataacgccgcctataagaccctccacagttttcttagggcttatctcagggcaaagctttgttttgccgaagaaagttcctgcaaaataagcaccgctgtcagccagccaagccgctgcaagagtaagaactatcataaacacgcccttgccgcccaagcctgccattgtaaccaaagttgagaatgaatacggcagaagtatgcccacgcccagcatgaagaaaaactctgtatactggaattttgtatgctctttaagataaagcagacacattgctataacgaaaagccccatgtaaagcttgtagctgaaaaagtacagccagccgtgtctgtagaacacaggcatgaaagcgtccacaaaggcaaacgcacagcaggcaatggtctgatacttatgctctgtcatttttgtcgccctgaatatctcatatattgcaagtgcagaaattgcgcccaccgcaatgttgaacaggaacgttccgtgtgcgataagcagtatcactgcgataacaatggcaactgccgcagatttaatacgggtagacattttttacacccctccaaatcttctgtttctttcgctgtatgcgataacagccttgtcaaggtcgctgcctttgaagtcaggccataggatatttgtgtaataaaactccgcgtaagccgcctgccatatcataaagtttgacaatctttgctctccgctaggtcttataacaaggtcaacaggaggtatctcctcagtgtagagatttctctctatcatatccattgtgatatcctcaggctccagcttgccttctttcacctgctgagccaatgtcttagccgcatggcaaatctcgtccctgccgccgtagttgatagcaagcacaagggtcatagagtcaaagtcctttgaatcctcctcaacggaagccattttcttttgcagattttcgctgagccttgttctgtcgcctataaagcgcaccctgatattctcctcaataaagtccctgacctcgtcaagatacttttcaaaaagatccataattgcgtctacctcgtccttaggccttttccagttctcggtagaaaacgcatagtaagttatatactgtattccaagcgccttggcgtgtcttgttatggcacgaaaggtttttgcgccctctctgtgtccgaactttcggggcatacccctctttttcgcccatctgccgttgccgtccatgataacgcccacatgaacaggcacagacacgttctctccaaggtttatcttctcattcttcgccatggcttagatagagagtatctctttttccttttcggcaacgtgaccgtcaacttccttaacgaacctgtcagtaagcttctggatctcgtcctcgcaatccttaagatcgtcctctgtgatctcgttgttcttcttcattgccttgaacttttccatagcgtcacgtctgatagaacggatagcgaccttgcactcctcgcccattttcttgatttccttaacaagctccttacgtctgtcctcagtgagctgtgggaaagtaagtcttataacagtgccgtcattctgtggattgatgccgatatcagaagcctgaatagccttttcgataggcttgagagttgacttatcccatggctgtataacaagcactcttgcctcagcaacagaaactgccgccatctgtgtgacaggtgtcattgcgccataatattctacctggactttgttgagtacggacggattagctctgcctgctctgatgcctgcaaagtccgaaagcataacgtttatggatttctccatttttgtcttagcattttccttgatctgtttcatattcaaacgatcctttcttgatttctttattattttacgagagtgcctatattttcgcccatgcaagcgtcatagatattgtcaggtcttgcaagatcgaaaacgagtatcgggatattgttgtccttacacattgccgcagcggtcgagtccattacctgcagaccctttgcaaggatatcagcaaatgtaagtgtgtcatacttaacagcgtctggatacttgtgaggatccttgtcataaacgccgtctaccatggtagccttaaagaatatatcagcctctatctcagctgctctcagtgccgcagccgtatcagttgagaagaatgggttaccagtgccgcagccgaagataactactctgcccttttcaaaatgacgcatagccttgtttctgatgtaaggctcagcgacctgtggcatggatatagctgtctgtactctcacttcaagaccgcagttctcaaggccgtccgcaacagcaagtgcgttcatagcagttgcgagcataccgatatggtcggctcttgttctgtccattgcaccgcttgatcttcctctccagaaattgccgccgcctacaacgatacctacctcaacgccggcgtcaacacatttttttatgctcttgccgaatgaggtgataacgtcatagtcaagacctatcttcttatcgcctgcaagagcctcaccgcttaatttgagcaatattctcttatatttaggttccatatttcaaagcactccttaacacatatttcgttggaattatccatattaattatacaatattttcagcagattgtaaagaggaaaaacgccaaaatcagccctttattatcttcacaaaaaagtttcttgttctcggtccgtcaaactcagcgaaatagataccctgccaagtgccgagaagaagttcgttatcgtcgatgataacagtttccgaagcaccaacacagcttgacttcatatgagcgtcagagtttccttcagcgtgacgaaactgcggtctgttcggaaatgtttcctccaaagcgtaaagaagatccgtctttacgtcggggtcggcattctcatttatggttatcgccgccgtggtgtggggacagaataccaccgccatgccgctttgcactcctgattctgttacagcctgccttacatagctcgtgatgttgtaaagccctctgcgttctgtcttgatagtgtatcttttaagcatatgtatcagtcctttcaacggtcgctttcctaactcaggaaagttgactcagtttcatttctgttcggtctgcccataagatttttgatagcgttggccgcaggctcaccctcaaaaagcacctttgcaagctgttctgtgataggcatttcaattcccattctctttgaaagctcccatgcgtttttggtgcaaacatagccctcaacagtgccgacctgtcttacagcctcctcaggggtaactcccttgcctatgagaatacccgcacggcggtttctgctgtgcattgaacagcaggtaacgataaggtcgcctatgccgctaagtccgccaaaggtttcaagctttgcgcccattgcaactccaagacgtgatatctctctgattccccttgtcataagtgcagcctttgtgttgtcaccaagtcccaggccgtcgcaaacgcctgccgccaaagcgatgacgtttttcagcgaaccgcctatctcgcagcccataacgtcatcattaacatacactctgaacgtatcgttagaaagagtgttctgtatataatatgaaacctccctgtcgtcagaagcagtaacaacagtagtgggaacttttcttgccacttcctctgcgtgtgacggaccagtaagcaccgcaacatgattgttcggaaagcactctctcgccacacagcacatagttttaaggcttccgccctcaagaccctttgccgtgttcacaactatagtcctgctttcaagataaggcacaacgctttcgcaaacctctctgaggaaaggcgaaggtatgccaagtatcaccatgtctttatccttaacacagcttatatccgttgtaagctcgatagtcttgttcacctgaacgccagggagctttgctttaagctcgcctgttctcttgatagcatctatctcgtcctgaaactttgaccatactgttactttatgccctgcattgtcgcacattattgccagtgcaagaccaaatccgcctgaaccgagtatagtaatatctgccataataaaacctcccttacgcctttttcttgcttccgaatttattttcggtgccgttcataaggcgtttgatattaggtctgtgcatataaatgataagcagaccgatagccgttgccataagagtgtttgcaagaacgccgtcgccattgatgataaaaagctgaacgataggcgtaaaaacaggatatgcgatagcggcgcatatagaacctacagacacgtattttgttgccgcaagcacgatagcaaaaacagccaccgagaaagcacaggtcagtgggtcgatagcgataagggtcgttgccgcaataagaacgccctttccgccgtgaaaaccatagaataccgggaaaatatgtccaagcattacaaaaaagcccgcaagatatccgataaatttatcgtcatgaaaaaatgtcacgccgaagccattagtcaccacaagtcggcagataactaccgcaagcacgccctttgcaaggtcacacaacagcgttgccgccgcaggcccttttccgaatactctcagaacattggtcaaacctgcgttgttgcttccgtaatcacggatatccttatgctttaaaactctgcacacgattatggcagaattaagacttccgaaaagataggaaaaaattatagtgaatgccagacttaaaaatatgtccacaaaataacctccagaattttatttaacgtcgtccttgtcacgctctcttatcttgaaaacgataggcgtgccttcaagtccgaaggtctctcttatctgattttcaatataacgctgataggaaaaatgatacagatcggctctgtttacaaaaaacacgaatgtaggcggtttggtagacacctgcgtcatgtagtatatcttcagccttctgcccttgtcagacggtggctgtaccctctgggtagcatatgcgagaacatcgttaagtctgcctgtcggtattctaatagagttctgctctgcaacgaacttgatagtatcaaaaagcttgtccattctcagacctgtttttgcagagatgaacacaaaaggtacatagctcatgaagctgaaatcgtcctgaagctttttctgaaagtcgttcatggtgttagtttctttctcgatagcgtcccacttgttcaccgcaacaacgcaagccttgcccttttcgtgagcatagcctgccacctttgaatcctgctcagtaaagcccacagttgcgtcaataacgataaccgcaacatcggctctgtcaacagccatataagccctcaacacagagtatttctcaatagtctccagcacctttgacttacgtctgataccagccgtatctatgaaaacgaacttgcccttttcattttccacaaccgagtcagtagcgtcacgggtagtgcctgcaatatttgacacgataacacgttcctcaccgcatatcttgtttattatagaggactttccgacgttaggcttgccgataacagcgacctttatcgaatcatcgtcatcgtcctcttcattttcctccggaagatatttcagcacctcgtcaaggagatcgcccgttccgtgaccatgaacagaagaaacagggaacggttcgcccaaaccgagattatagaactcatacagctccataggcggttcgcccacattatccaccttgttcacgcaaagcacgataggcttgcccgatttcaaaagcatctgtgccacctcatagtcagtggcagtaactccgcatttaaggtctgtcacaagaatagtgacatcagctttcagtatagcaagctccgcctgtctgcgcatctgagcaaggataatatcatcagactcaggctcgattccgcccgtgtcaaccagcatgaactcgtgtccgagccattcgcactttgcatatatcctatctcttgtgacgccaggggtatcttcaactatagaaagtctttgaccgataagcttgttaaaaagagtagacttaccaacattaggtctgcccacgatcgcaacgatcggcaatgacatatatatcgacctcatttcatataaatttgcacattgatacatcatatagtataacacaatttctcacgttttgtcaaccatacgagaaatacagcacccacattccatagattttttactacaaatatgtagaagcaaacagcgtttgcccgcctttttcactgctacaacaaaaaagagcagaacggcctaagccattctgctctatgtgcttatcaaaaattatgcttccttcttgataacctctacgcccttataataaccgcaattcttgcaaaccttgtgtggtgaagtaagctcaccgcagttagaacatttacaaagtgcaggtgcgtcaagcttccaaactgctgaacgtctcttgtcacgtctagccttggatacttttctctttggtactgccattctggcacctcctcgtcagtaaaatcattatagtctgttcagctatttcccgtcaagagcagttacatttgccctcattcaaatcctgtccgcaaacgtaacacaaacccttgcagtcatccctgcaaagaatttttgtaggcagctgtaacaacaaatctgaaatagctaattcgtccagatcaagagtattgttctcgcagaccacataatcgtccctgtcgctttgaacacttctcaccagagtgtgttcaaagtcataaacatactccctgctgaactcctttagacatctgtcacaggtgtgatccatagtaaaaacagtcttgaacctgagtgttaccacccctgccctgttctctatctcacctgttaccgcaacgggcgatgcaaaagaatatccgccatactccgacagcttgtctgctgttatggaataatcgatcgtttttcgctctccgattatatcgaaaagttccttcaactgtacattcatacttgcacctcaaacatcacaaattccattataacctgagaaacgtgatttgtcaatactttttttcaattttttcgtttttgctatcaaaataccaataaacgaagcgcaaagccttacttgatgaaagcctttacctttgcaggcagctcgtcaacgtcagcagatactgtgaaagtaacgtttacgtcctttgtgagaactgctaccttttcaagcatattgccaagagcgtcataatctctgccgccgatcttcaggataccgtcaacgaaaacttcctgaatgtcatagttgccagccatcagacctgcaacaaagccatagaagctgtcaaaactgttgataccgtattcttcagcgtcagccaatcttacattatgaggaaggtcataggtaagctgcatacctctttcgatgcaaacaacgttgcctgtagcattttcagcagccttcttgatagaatcaacaagtatcttagtcttgcctgtgccctttttacctggaatcaaattaatcatataaactctccgttccgcttattaaagcatttattttaagagcagacccccgaaggggaaacgctcaaaatttccttttgttctgcctttgggatattagcccagcttagcctcgagttcagccttctgtgactcataacccggcttgccgagaagagcgaacatattcttcttgtagctctcaacgcccggctgattgaatgggtttacgccaagcatataacctgagatagcacaagccttctcaaagaagtagatcatctcgccgagattttcctcgtcaagcttgtcaacatctataacgatattaggaacgccgccctcagtgtgagcaaggatagtaccctgatatgccttttcatttacaactgacatattctgatttgtgaggaagttaagtccatcaagattatccttgtcaggctccaagaacaggtcgctctttggtgtcttgatgtgcataactgtctcaaacataagctttgagccgtcctgaatgaactgaccaagtgagtgcaggtctgtagagaatgtagcggcagatgggaatatacccttatcgtccttgccctcgctctcgccgaacagctgcttgaaccactcgcccatcattgtgaatgaagggtcatatgaaacgagcatctcaacgctcttgccttttctgtagagaatgtttctgagagttgcatacttatagcaatcgttgttatcatcagcagaatacttcttcataccctctcttgcaccagccatgagcttgtcgatatcacagcctgctgctgctatagggagaagaccaactgctgtaagaactgaaaatcttcctccaacatcgtcaggaacaacgaatgtctcgtagccctcttcgtcagaaagctgcttaagagtacccttagccttgtcagttgtggcgaaaattcttgtcttagcctcttccttgccatacttatcttcaagaagcttcttgaaaattctgaaagcaagtgcaggctcagttgtcgtgcccgactttgaaattacgtttacgcagatatctctgccctcgcaaattgaaagcacctcattgaggtaagccgagctgatattgtttccgacaaaatagatgtcaggagtatccttcttaagattgttgtagaatggcgacttgagcagctcgattgcagctcttgcaccaagataagaaccgccgataccgataacgatgagaacatcgcacttttccttgatccttgcggcagcagccttgatccttgcaaattcttccttatcataatcctcagggagtgttacccagccgagaaaatcatttcccagaccgtttctgtttaccagagtattatgagctgcagttacctgcgcagccataccctcgtattcatgttcacttacaaaaccctcaagatactttgtgttaagctttaatgacattatccttcatttcctttccttacctgtcggagagcgtgacaccataaaacacgtttctccgttaatactagataaattatactatatttttgtgaacatttcaagagttttataaagcgaaatcatcttttgtacattttaaacaaatataatattacatactcagcaaattgtacacaagcttttttatgccgcagataaaattcattttcttcacctctttgcaggcgactatctttccatctaatatcacctcgtcgcccatggtgtatcttatttctcccgcagtttcgccatttttcacaggtgcgtcaagcttctcctctgccgtaaaatcgcactccaccatacgatatgttcccctcggtataactataggataaagcccctcgggagcaagcttcacagaaagctcctctcctccgcacaccacagtttcctttaccatatcctcaggaagttcaggggtgtatatctcatatgtatcgaacgccaagttcagaagtttcttcgcctcagcattcatatcctcctgcgaatcgcagccgttaagcactacgcatactgacatatcccctttttcagccgttgccgcaatacagctcccagccttttcacttccccacgctttcatgcctgttacgcccttgtaagtacgcacaagcctattaaggttcacaagctccgccttgccgtctctcacagtgtcgagccagcaggtaaggtaaggagtgagatttttgtattttgcaagttctgaacaaagcaaagccgtgtccttcgctgttgtaacattgccctctcccacgccagtacaatcagtgtaaacagtaccattcatgccaagcattttcgcacggctgttcataagctccaccgccttgtctgccgagcctgccaccttttccgcaagtgccgcacagccgtcgtttgcattgcctgccgacactgattttataagctcctccacagatatcttctctcccttgtcaagccatatctggcttccctgctgagagttggcatactccgacaccactgacgtgtcgctcatggaaagctcaccgctgtctatcttttctgctgtgagcaaaagcaccatgagcttcgcatagtgaccgcactcacactgctcctgcggctctttttcaaaaagcaccctgcctgtggtcatctccgtcaccactgcagacctagccgtaagcccctctatcatatcgctcaccgccacagtgtccgcaggcacaaagttctccgctgacagcgcacctgctttttcttttccctccgccagcgaacacaccataaacactgccaccgccgcacacaacactgccgagcatattttccttaatattttcacattttccacctctcacatatactatttttatatttatattcaccctgtcccgaaattagcattatgccccgaaaagtttctggaaactcatttgtaaatagttgcaggaatttgttaaataactgttacaactcttgaaataaatatgggagtgtgctataatgtattctatagaaatgtgtattttataagcgaaatatttatatgaggtgatttaacaatgacagaaatggaactttacaagctttggtgtgaaaaggctgttgacgatcctgatctccagacagagcttaagtctatcgagggcgacgaggctgcgatccaggacagattttacagagatcttgaatttggcacaggcggactcagaggagttatcggtgcaggcgcatacagacttaatgtttacactatcagacgtgcaacacagggtcttgcagactatgtaaacggcgcatttgaaaacggcagcgtagctatcgcatatgacagccgtatcaagtctgacaagttcgcaaaggaagctgctgcggttctggctgcaaacggcataaaggtatacatctattcagagcttatgccgactccaatgctttcctgggctgtaagagagcttaaatgtcaggcaggtatcgttataactgcatcacacaatcctgcaaagtacaatggttacaaggtttacggcgaggacggctgtcagatcacactcgatgttgcaaacacagttatcggcaagatcaacgcagttgagatgttcggcggtgcaaaggtaatggactttgaggacggtatcaagtcaggcaagatcgaatacatcaagcaggaagttatcgacaagtatcttgacaaggtagcacagcagggcgtacatactgacctcgtagcagacagcggtctgaaggtagtatacactcctcttaacggcacaggaaacaaacctgtaagagctatccttaagaagataggcataaaggaagtaacagtagtacctgagcaggaaaatcctgacggaaacttccctacctgcccattccctaaccctgagataaaggaagcccttgcaaagggacttgagctttgcaagacagtaaagcctgaccttcttcttgcaacagacccagactgtgacagagttggtatcgcagtacctgaccctgacggaaactatgttctgttcagcggaaatgaagtaggtgcaatgctcctcaaatacatttgtcaggaaagaacagcccttggcacaatgccaaagaaccctgtagctgttaagactatcgtaacaacagacatctgcaagaagatagcagcagaatacaatgtagagcttagagaagttctcacaggcttcaagtttatcggcgagcagatcggattccttgagaaagagggacaggacgacagatatatctttggatttgaagagagctatggttatcttgcaggctcatatgtaagagataaggacgcagtagtaggctcaatgctcatttgtgaaatggcagcattctacagaacaaagggcatctcactgcttcaggcaagagaagatatgtacaagaagtacggaaactatctccacagccagaagtcattccagtgcgagggtgcaagcggaatggagagaatgaaggagatcatgacagatctgagagctaatccacctaaggctattggcggactcaaggtagtagacatagcagattatcttgcatctgaggaaacaaaccttgaaacaggcgcaaagacagttcttacacttccaaagtcagatgttatcgcattcaagcttgagcagggtgcaagtgtaataatcagaccttccggcacagagccaaagatcaaggcatactacacaactatcggcgacacaagagctgatgcagaagcacaggaagaaaagcttattgaagatttcaagggcattcttggtttctaataattactgaatatagcgaaagcaggcgagtcagttttttgacttgcctgcttttttatttgcgatattcacacaatgctttgcgtttcacaaaccatgtaggggagcagcgcaatttctgcaagcagaaatgcgacgtcccgcttctcgtttgcctgtccaattctacgttatccgcacaacgttcggcatattttttcaaaacgctgtacggcacaacatttccgcacacggcacatctacacaaattcatgaataatcaaaccttaccgcttcgaaacgggctgtcgagggcgccagcccctacattttgttcagacaaattcgctgtgccgcaaaatcgctacgctctttgcggattttacgttgtgctatgggatggaaaaagcggtgcagagtttttttactccgacaccgctttgattttgcttttagtttgtttttcttctattgcttttctgcaccgcttttgtaggcttgcgcctattgaggctctgcctcaaactccgacagggctttgccctgtacccacaatgggtttcaccccttgaccctgaccaggggcgtgcccctggaccttttgctcgcttcgctcggtgttgacttttactttatgcttgtgatttgttcggttggctatgccattcctcactcctcactcctcactttaaccgagaagtttatccgcgatcgtatccagccagccgccctcgacttcttctatctcaccgttatcgcaagctttcgcaaacttcgggtctataggcattttcgccacagcgtcgataccaaacttcactgccgcttcgtccacatggctctcaccatagatattatgcttctttccacaatcaggacactcaaaatatgacatattctccactattccaagcaccggtactttcatcatatccgccatatgcaccgctttctcgactatcatagaaaccaattcctgtggcgaagtgacgataactatgccgtcaaccttaatggattgaaaaactgtcagtggcacgtcgcctgttccaggcggcatatctataaacatcacgtcaacgtcgttccatgccacatctgtccaaaactgcttcactgcacctgcgataacagggccacgccatacaacagggtcagtttcattttcaagaagcagattaaggctcattatctcgataccggtcttgctcaccgcagggataatgccatacatattggtattagctctctcgtggatattaaacgctgtcggtatagacgggcctgttatgtcagcgtccagcacagcggtcttaaaaccacgtctttgtgccgttactgcgagcatacttgtcaccaaagacttgcctacgccaccctttccactcattactgcatatacctttttcacagagctcgcagcattaagctcctctttcaagctctttttatcagagcattttgaagcacagttttcgcaatcatgtgtgcagccttcgctcatagaatcattcctttcaaggcatttacgcctttatttactatgttaagtatatcactttgaccgtgaaaagtcaaccaatactgacttttcacccaaagcactgctgccgcataaaataaaacagccctgcaccttgtaacaaaatagatactttggtataataccccgataataaggcaataataggaacaagcaggagcaaaagcctgcaaatcaaggcgaaagcccatagaataggagtgtttacaagtgactgtacacaggggcgatatatattatgcagatctcagcccagtggtaggctcagagcaaggcggtatgcgaccggtgctgatagtacaaaatgacataggcaataaacattcacccacagtgatagcagcggcaataacgagccgccttgataaagcgaaactgccgacacatatagaagttggcggtggcacctgcggactagcgaaagattccgtggtattgttggaacagatccgtacattggacaagaaaaggctaaaggagaaaatgggaacacttgacgtaagctccatgtccgcagtaaattcggcattatcaataagctttggattaaagctctagttaaatgaggaatgaggagtgaggaatggcatagccaaaccgagtaaatcacaagcactaaataaagaacaaaagataaagcggtgtcggagtggaaactctgcaccgcttttactatctcattttacaaactccccccgcaaagagcgccagcgattttgcagcaatagaacttgcgaacaaaatgtaggggacggcgccctcgacgtcccgttcggagagtgtcaaggttttgctttatcacaattttgtgtagacgtaccgtgttgcaaatgttacgccgttaagcattttgaaacaatacgtcgaatgttgtgcggataacacaggattaagcaggcgaccaaatttgggacatctaggacgccagcccctacagaatttccacacagaaaaaaggcggtcaaaaaccgcccttctaaaaatcatatcaaacctatccgagaatatcagagtgtagcaataataattcctcactcctaacacccaactcctcactaaccatgaccctgtgaaaaggcagattgtaagccgcataatcagttatgcccttgccctgattaggattagcctttgagtaaacagcgtcacaacagaataatacaacaagtatcacacacgccgcaaaccttgccttgaatggtatcttcttcaaaagatcatcaaaaaacggtgccatgatgtatattcctgcacagcctgcaaagccaaatatcaacgctccctcaagacatatcctgccattgatgttgcagaaatatcccgtgtaatcccaatatttcatgtgcttgaacgtttcaagataccagctcgttacgtattcgaccaccgagcataaccccacaacaaggaaaaaagtcgccacatggtggtctatgaaccgcttcagcagtatgataccgcacacaccgccaaaaccatatataggaagccatggaccaaacatggttcctcgattgacgaaaactccgtcctcaacgatgtgtatgcccacttcccatatccagcctataaatgcgaatatgaaaaacagcagtatatacgtcatgagtgtatagttcctgtgatagtcacggtgaactatagtcttgttggcaaatcggctgaaatgcgcctttctgtctaccgcaagaccggggtattgctcaaattcccgcagatcgtcaagcgtcagcgttctctccattattcaccgcccccattctcattattttcaggcacttttatcgtgcatatcggtatgcttctaacaatgtccggattttcgcccttttgtgcagcttcctcagccataagctcttccagaaggtcaaggtcaagcagcttgtcattaagctcctcatagccctctatcttgttcttgatagcctcacgccttagctgtaaatacacctctgcgtctatcgcagttgtgtatgggttagaccagaatactcccaccgcaccgaacgatatgctcgaaagcagtgtccagcctatcatagaaagatccaccttgaaaagctgccacttgtatcccctagtcatggcaatagaaagctttattgcctttctcgtcttgatgttagggttttccgcacatatgaacggtaccattgaataggcataatgttttataggatatcccacgatagtaaacgcccataaggtctgatatatgctggttacaaacatagtccttgcggggtgaagcgttctctcgcggaaaaggaagcctagtctgcctatcttcgttttcttgtatgtgtgattttcaaggaaaaatcttctctcacatacccaaagcacatttactatgaatatggtgaacatcaactggaaaataaaatacacgaatgaaactatagtatcccatgtggatttttttcctaaaacattcattatcgccgtaagcaatgaaaactgataggaattagagcttgttgcactgtcaaaataaaccgaagcagaggctgtaaaattattgagcctgtcattaagataggtctgtgtcttttcctttgcatttcggctaaaagaaaaagcgtctgccagtgcttccagattagaagtgtcgtttgatgaaccaaagaacgtgacttcctttgaatttagcccgtcaactccgtattttttataagcgtccagccacttttttacagcgtcaggattatctatctgccacttgtcactgacctgctctgccgtaagttcatttttaaccatatcctcaatgatctcttccttatcttcggcgtcatatttaagttcagcaacgtgagaattatcatagcttgacatattctgcgtggtcgagccatattctcctgcaataaataccattataaagcacactgctatgcaggcgatataatttcgcttcaccctgcctttagccgactgctttattttttttcggtcaagctttatgaccaccggcatatcttcatttttcttcatctaaaactatgcccccgacgggacatatcctcccttcacacataccacttaacaaaacactacataatcaacaataaatcgactatttaattatatcttttttttgtgaatatgtcaacgattttgagatcaaaacaagtttattttaagatagttttaagtttacgtttaaaacggcaaactttttttgcatattttcatctgcaatgtagaaaataacatcaaatgacgatattcatcaataggagtgataaaatgaaagccactaagcttatgaaaacctcaccctctgtcatctctttcgcagccataggcggcaagaaagaaaacgaaggacctttgggcgattattttgacaaaataaatgacgatccctatttatccacagatagctttgaaaagggcgaaagtcagcttcaaaagcaggcagtgcttcacgctttggataaagccgccctctcccccgaggatatagacgtgcttttcggcggtgacctgctaaatcagtgtgtcggcactacctatggcgtaagagcctttgaaatgccctttctcggcatttacggagcctgctccaccatggcggagggacttctcctcgcctctcttttcgttgacaacgacctcgcaaaaaaagcaatggcggtcacatcttcccacttctgcaccgctgaaagacagtaccgttttcccctcaactacggtggacagcgtactcccacatctcagtggacagccacagcctcaggctcattggtggttgccccctcggacaagcccccctacatcaggggctgtactatcggaaaaatagttgacttgggcgtgagcgacgccaacaacatgggtgcagccatggctcctgcagccttttccaccataagcacatttttcaccgacacaggcatgaccccctccgacttcgattatatcgtcacaggcgaccttggcaaagttggaagccgtattctctgtgagcttttcgagcgtgaaaatataaatatccgtgacaatcataaagattgcggcatgatgctctatgactttgacgagcaggatatccacgcagggggaagcggctgcgggtgtgcaggaagcgttctgtgcggctattttctcccgaagctccgtgcaggtgaaataaaaaatatcctctttgctgccacgggtgcgctaatgtcaccaacagtaaatcagcaaggggaatctatcccctctatctcacatctcgtgtggctgtcaggggaaaaagatatgaaaggagcaaactaatggactatctatgggcttttcttataggaggtcttttttgtgccataggacaggtgcttatggacttcacaaaactgacccccgcacgaatactggtggcatacgtcacaggcggcgttcttctgggtgcgctgggactttataagccacttatagacctcgctggctgtggcgcaactgtacctctcacgggcttcggctatcttctctataacggtgtccgtgaacagatagataaaataggcttcctaggcattttcacagggggacttaccgcctccgccgcaggcataactgcagccatgacattcgcctttatcttttcgcttttctttaaaagctcagcaaaagaatagttttatcttgacaaaccccaaacccagtggtattataaagatatgtaaattgggggtgcagaataatgtacaaacagatatatcccgtcataggcgacgaaaaaaacctgcccttttatgtggtaggtctgggacttgaaagctggcagtttccaataaaacgtgcagatggctacgagtacccacaaatatttttgtcacgctcaggggagggcgaggtcataataaacggagaaaccacaaaaataccgcccgatactgttttctatatccccccattctgtccacatgagtatcatgcgctaagcgatgcgtggtatctggattggatagccttttctggctcacaggtcattcccctcttggagcagtggaagcttaataagttcaccgccattcaaggggtagatatggacagattacgccgtatcataacacgcatctattatactctgaaaagagataagctttatggcaatcattacgcttcagcacagctttacgactttcttatagaatatcgtaaaatagctgataacaggctctcgtcattttataccgcacaatctgttgccttggcagacgtattgcagtatattgaagagcattatccggagcaaataaagcttaacgagcttgcaaaaatcgcaggagtatccgagcagcacttatgcagactctttaagaaaaattttcagctcagacctatggagtatcttgcgcaagtaagagtacagcacgcaaaggatctgcttgtgtattccaacaagaccataggcgagatatcagatgaaacgggctttcaggacggatcttatttctccgtggtattcaaacggtatgaaaatatgactccgggagagtatcggagaataaaggtgtaggctaagtgaggagtgaggagtgaggaatggcatagccaaacctagcaaagagccactaccaagtagaagaaacacaaactaaagcaaataacaaagcggtgtcggagtaaaaaactctgcaccgcttttactatatctttgtacaaagtacaatccgcgaagagcgaagtgattttgcggcggtagaatttgcgaacaaaaaaaagagcggtcaaaaccgcccttttaaaatcatataaaacctatccgagaatatcagagtaaaagcaagaataattcctcactcctaactcctaactcctcactacttagtcagcagcttctttattctctccatagcctcaacagtcctgtccttgtcaccaaaagcagtaagtctgaaccagccttcgccgttcttgccaaaacctgcaccaggtgtgccaacaacatttgcgttctcaagaagataatcaaagaactcccaagaacccatgttgttagggcatttcagccagatgtatggcgagttcttgccgcctgtgtacttgataccaagctcgtcaagtgtggaagccattacctttgcgttgttctgatagtattcaatgtttgctcttgtctgtttctgaccctcctcagtgaatacagccgcagcagcacactgaacaggatatgatacaccgttgaactttgagccttcacgtctgccccaaagctgagcgatagaaacttcgctgccgtcagatgccttaacaacaagctcgtgagggataacagtgtatccgcatctcattcctgtgaagcctgctgtctttgaaagtgaacacatctcgatagcacattcctttgcaccctcaacagcaaaaatacttcttggtacgtccttttctgtaatgaatgcctcgtatgcagaatcataaatgatgatagcgttgttcttctttgcatagtctatccaaactttaagctgctccttagtgtaaacagaacccgttggattgttaggtgagcaaagataaataatgtcgcactttacgttctcgtcaggcatagccgcaaagttgttctcctcgtttgaatcagcataaattacctttctgccgttcataaggtttgtgtcaacataaacaggatatgcagggtctgtgataagcactacattgtcgtcaccgaaaatgtcaacaatgtttccgcagtcagactttgcaccgtcgtttatcctgatgtcgtcagcaggaatgacaacaccgaagctcttgtagtagcctgcaacagcctctttcaggaagtcatatcctgcaccgctgtcctcatagcccttgaatgtttccttgacacccatttcgtcagcgccctttttcattgcctcaacaacgcactttgcgataggctgagtaacgtcgccgatacccattctgatgatgtcagcctcagggtgagcctcagtgaaggcctttaccttcttggcaatgtttataaaaagataattcttttccagcttgagaaaattttcgttgatacttggcataattccaactccttttcatttttgcgacccgaagtttcacgggtcaaacttataaaacgcacacagccgcaaagctcattcaaaacgctctgcggctgccgcttttttaacgcagtgtccgctgcgaaatttacattacgatgtgacctgagaatactgttacagcgtcgcctgtaagatatacagcctcgtctgtgtatcttatcttaagagtgcctcccttaagtataacagatatttcctcgtcctttttgcagaatccgttaagaacagccgcaactgctgctgcacaagcaccggtgccgcaagcccaagtttcgccggagcctctctcccatactctcatcttgagtgtgtggtcatcgatcaccttgatgaactcagcgttcactctctcagggaatatcttgtcatgctcgaactcaggacctaccttgtcaatgtcaaggctgtcaacattgttcataaatacaacagcgtgtgggttgcccattgaaacgcaggtgatgttgtagtcatttcctgcaatgttcacctttctgtcaactaccctgccgttctcgtcaggctcaagttcaacaggaacaaggtgaggagcaagaatagccttgcccatgtttacagtagcaccgcttacctcaccgtagtgacggataagtgaaactgtcatgatacccgaaagtgtttcgatagtcatttcgtccttgtcaacaatgccgttatctctcatgaacttagcaacgcatctgataccgtttccgcacatcttgccctcagaaccgtcaagattgaacattctcatcttagcgtctgcgacctttgaacggcagataaggataacaccgtcaccaccgataccgaagtgtctgtcagacagattaagtgccagaccctcaggattgtctattctctggtcaaagcagttgaaatagatgtagtcattgccgcagccctgcatctttgtgaactcaaatgtctgcttttcagttctcatgttgttgatatcaactatctcagtagttgactcagtgtatttacttctgatagatgccgcaatagcgtttgcagtgtcgatagaagtcaggcaaggaatgttccactcaactgtctttcttcttatcttaacagaatctctggtaggtattcttccctttgaagaagttgagataacataagctatctttccgctctcgataagtgtaagagtgttgttgtcctcattctcgtgtatcttagccactacctcagcgtcaatgccatgctcgtgaagcaccttagcagtgccgtttgtagcgtatatcttaaatccaaggtcagcgaacatcttagccgtctgtggtatctcgcccttgtcagaatctctgacagtgatgaatactccgcccttcttgccaagcttgtagccagcagcagtaaggcccttatacagtgactcttcaagagaattagaaactgcaagtacctcacctgttgacttcatctcaggtccaaggtggttgtcaacgccgataagcttctcgaatgagaatacaggaactttaacggcaacatatggtgaatttctgtaaaggccagtgccgtagcccatgtccttgagcttctcgccaagcatacacttagttgcaaggtctaccataggaacgcccgttaccttagagatataagggatagttcttgaagaacgtgggtttacctcgataacatatatctcgtcatggtatgcaatatactgaatgtttacaagaccctttgtgttaagtgcgatagcaagcttctttgaacactcgataattctgtttatcaagctgtcagaaacgttccatgcaggataaaccgcaatagagtcgcctgagtggatacctgttctctcgatatgctccatgataccagggataagaatatcctcgccgtcacagatagcgtctatctcaagctcagtacccataagatacttgtctataagtacagggttctcgattccctggtcgagaatgatagccatgtattccttgatatcatcatcattgaatgcgattatcatgttctgtccgccaagaacgtaagaaggtctcataagaacaggatagtgtatcttgtttgcaacttcaagagcctcgtcacaagtcatgaccgtaaagccctgaggtctctttattttaagctgttcaagcagctcgtcaaatctctctctgtcctcagcagcgtcgatagcgtcaggaggagtaccaagaatgtttacaccatgctcagccatatgctttgtgagcttgatagcagtctgtccgccgaatgccacaacaacgccaacaggcttttcaactctgatgatgttcataacgtcctcgtcagtaagaggctcgaaataaagtctgtcagcagtatcaaagtcagttgaaaccgtctcagggttgttgtttacgataacaacgtcatagcccttttctttcaacgcccatacgcagtgaactgacgcatagtcgaattcgataccctgacctattctgataggacctgaaccgaatactataacagtctttctgtcatgacccctgtttgcaatgaactcgcttgcctcgtcctcgttgtcatatgttgagtagaagtaaggtgtcatagccgcaaactcagccgcacaggtatcaaccattttaaatacagcatgaacaggcttttctatcttcttgcctgttatcttctcgatgaccttatcagtgtagcctatcttcttagcttcaagataagtttcctcattgaagtcattcttgagtgtcttttccatgtctataagcttgcagagcttgtagaggaaccactcgtctatcttagtgatgctgtgtatctcatcaacagaaactccacgtctgagagcctcgtatacaacgaaaagtctttcgtctgtgcagtcagaaagtctgtcatggatagtcttgtcatcaaggtcaagcatcttaggtgagataaggcagtcatgacctatctcagctcctcttacagccttcattatagcctgctcaaaagtcgagccgattgccataacttcacctgtagccttcatctgtgtaccaagctcacgcttagcataaacgaacttgtcgaaaggccacttagggagcttaacaacaacatagtcaagggcaggctcaaagcaagcataagtcttgcctgttacagcattctttatctcgtcaagagtatatccgatagctatctgagctgcaaccttagcgataggataacctgtcgccttagaagcaagtgcggaagaacgtgaaactctagggtttacctcgataacagcatactcgaagctatcagggttaagagcgaactgacagttacagccaccctctactttaagagtatcgattatcttcaaagctgcggaacggagcatctgatattccttatcagccagcgtaacagcaggagcgataacgatagagtcgcctgtgtgaacaccaacaggatcaaagttctccattgagcaaacagtgataacgttgcccttagcatctctcattacctcgaactcgatctctttccagcctgcgatacatttctcaacaagcacctgagtgataggtgaaagataaagaccgtttcttgtgatctctttcagttcttcttcatcattaactataccgccgcctgtaccgccaagtgtaaaagcaggtctgatgataagaggataaccgataccaggctgattagcgaagtctacagcgtcctcaacagtattaacgaccttagacgggatacatggctgaccgatagactccatagtgtccttgaacatctgtctgtcctcagccttgtcgatagtttcagggttagcaccaagaagctttacattatacttgtcaaggaatccctccttagcaagctgcatagaaagcgtaagacccgtctgaccgccaagggtagaaagcaggctgtcaggacgttcttttttgataactctcttaacagtttcaagagtaagcggctcaatgtatatcttgtcagccatagcattgtccgtcatgatagtagcagggttagagtttataagaataacctccagaccctcctgcttgagcgcacggcaagcctgtgtacctgcatagtcaaactctgcagcctgacctataacgataggacccgagccgataacgagaactcgctttatatctttatttaaaggcacttaaattcaatcctttctgaaaagtttagggaaacgctgaaagtgaggagtgaggagtgaggagttatcccttctcacactctcgaaaaccgcacccagcagccctctgtgttaaagcttaacaacctcagtaaaacataatgtaggggcgaacagcgttcgcccgttcactatcacgaccgccccatataaaagccgctcgaataatgaacactacaatagtcatatcaaacacattccgtcagccacgggcgaacactgttcgcctctactgttgcagaaactgagatcaataatttctatacttcaaaaaatcagagcttatttcttgttagtgtcaatgagcgcaataaactcatcaaacaagaagtcagtatcatgcggaccaccacaagcctctgggtggaactgtacagaaaatgcaggctcgttgagatatctgataccctcacaagtgccgtcattggcatttacataaagcacctttgcttcaccctcagggagtgaatcgttctctactgcatatccatggttctgtgatgttatgtaaactcttcccgtttctgtgttctcagcaggctggttcgcacctctgtgaccatacttcagcttgtgtgtcatcgcaccatgtgcaagcgccaaaagctgatgacccaaacaaattccaaacgtaggtatcttcatctcggaaagctttttaagctcctcgattatctccacattctccgcaggatctccagggccgtttgaaagcattatgccgtcaggtgaaagctcctttatcctctctgccttagtatatgcaggaacaacagttacctcgcagcctctcttaacaagctctcttccaatgttgtgctttgcaccaaaatcgtaaagcactacctttctcttgacctctccctcaggctcgaatgttttctcctcagagcaagtcgtgttctttacagcctcaactatcgtgtagttcttaagatctgtcaagccgaaacttgaaccctcaggaacgatctttccgttcataacacccgactcacgaactatttttgtgagctgacgagtgtcaataccgtaaagacctacgatgttatgctgctttaaaaaagtgtcaagatcaccctcacaacggaagttgctaggctcttgacaccaatctctaacaatataagctttaacatgaggacattcactttcaaaatcctcaggaataacgccatagttaccaattaacggaaatgtctgaacaactatctgtccgtagtaactagggtcagtaagtgtttcgagatagcctgtcatagccgtagtaaaaacaatttcgccaatagcttcgccagctgcgccgaaacttttaccctcgaaaatagtaccgttctccaaaatcagatacgccttctgcactataagctcctcctttttcacgcaaatttttacgattactattataacacaaccgcctgcctttgtaaaggcttttaacactttttttagtttttatttttcagtgtaaaataaaaaacgagcagactgaagtccactcgtaaaaaccttattccgcagctgcagatacagccccgcttttctgttcacgctctctgaaaataagtccgaagacgaatctaactatcggacctgcaaagaaaagctgccagcaaagagccataggaaagttcatagcagttgtttctaaccataccgcaataacttctctgcctgcgtccttaaaaagcagcgtagccgcaaggctcatgagtggacacataaaaataacagagataacagatatggcaagcacaagatgaaaaggattatcctttctcacatcaacaatgctgaaagcctttttctttgctatctttcccacagcaaaaaagtcaagaacaaaagctatcggagccattatgacaagctcatgaaaagccttgagaaatacggcatttgacattccgcccatgttgagtacaatgttgtagcatatcatggcgtataccatcacaaacaccatcagcaccgtaaaaactatctcctgaaacaaattctttggcataaaaaaatcctccttatgatatcaaacctacagccctttctcagacgctgtgttgttcgttatcattcagagaatgtgcgtttccaatataaacctgtcctaacaatattctattgctgtattccttacttatttattttaccatattttaagcctgccgtcaattatccaaacagacagaatattttcaaaaatgcaggacaaaaaatatatttttacacaaaaaaacaggcagaccaaagcctgcccgtattaaaatgacccaatataatctgtaggggcgaacagcgttcgcccgcttttacggcttatgcaaagcctattttctctttttcaacgccgctttaagccctctcatgataacatctctcgccttaacagcgtcctccttgtcaagaggcggcgtgtcaccaagaggataatctataccgagctgctcatactttaccttgcccatggtgtgataaggcaaaacgtcaagcgctttcagcgtctttagctgagaaataaattcacccagcctgaaaagatattcttccttgtccgtgatacccggcacaacaacatgacgtatccatataggcacaccatgctccgacaaaaacttcgcaaacgcaagaatgttgtcattgtaatgccccgtaagcttcttgtgttcctcacggtcaatatgcttgatatccagcataacaaggtcagtgcatttgcaaagcctttcaaacttttccgtgctgtcaggcgtaaaagtgatgcccgagctgtcaagacaagtgtgtatccccttttccttagccttttcaaaaagctccgtcacaaagtctatctgtaccaaaggctcaccgcccgtgcaggtaattccgccatttttcatgaactcttttaccgagtcatattccgccagcagactttcaaccgtcctctttgtacccgtgcctatcttccaagtatcaggattgtggcagtaaagacaccgcataggacagccctgaaagaaaataacaaaccttatccccggtccgtccaccgtaccaaagctttccgtagaatgtataaatccctccatgggatatccctccttttttatttcgcatgaacgcacgcccgttcagcctgcacaaaccattctgtaggggacggcgccctcgacgtcccgtttctgctcgctcacaaatttatatcaccgcacacctatccacaaaaagtaacaaacgagcggcagctcccctccacataaaacaagaagttccatgtaagacgacgccgaccgcccgtgtgcatattatccgcaaagaaactcattctatgcggcaaagctcaaattaaaggctcttatggaacgttcttgaaataacgtcgtcctgctgctccttagtaagctttacgaagtttacagcgtagcctgaaactcttattgtgagctgtggatacttctcagggtgagcctgagcatccaaaagagtttctctgttaagtacatttacattaaggtgatgaccgcctttttcagcatatccgtcaagaagtccgataaggttgtctacctgtgcctctgttggttcaaagtttgccatagtattacattcctttcttagtatttatggaaaacaagcggagaacgaacctccgccgttttctaaaatagggagttaatcttcatctctgtcaacagcgtcctcttctgtaggctgacagcaagccgtcttgccgtcaccgccacaatcggaagtgctgtaagttttaacgttcagaccttcttcagtttcgtcaatgtctatcgtaagatgaccctgaccgcccatcataagtctgtcaatgacgtcaacaagctcgtttacctgagcctcgtcctcgtcctttttaacattaaaccccatcttcgttaagctccttagctatgctttcgatatcaaggtcgcccatgaataccttgtcgtccttgccaagagcgtcaggaatgatagagaatgtgtttgagataccgtcctgagcgtgtctgaatggcagcttagcaactgaagaaagtgatgcagatgcaccgtgagtatctctgccgtgcattgggttagcaccaggagcaagaggcacaccgatctttcttccgtcaggtgtagaaccagtcttcttaccataaacaacgttagatgtgatagtaaggatagacattgtaggaacaccatctctgtatgtgtggtgctttctgatcttgtccatgaatgttctaacgaggtcaactgcgatcttgtcaactctctcgtcgttgttgccatacttagggaaatcgccctcaacttcgtaatctgtaacgattccgtcctcatctctgatgcactttaccttagcgtacttgatagcagaaagtgagtcagcaacaactgacagacctgcgataccagtagcgaagtatctcttaacatctctgtcatgaagagccatttgaactctctcataagaatacttatcgtgcatatagtggataacgttcagtgtatttacatacagaccagccagccactccatcatatcgtcatacttagccattacatcatcataatcgaggtaatcgcctgtaactggacgatacttaggacctacctgtatcttaagtctttcgtcaacaccgccgttgatagcataaagcaagcacttagcaaggttagctcttgcaccgaagaactgcatttccttaccgatcctcattgaagatacacagcaagcgatagcgtagtcgtcaccgtgtgtaactctcataaggtcgtcgttctcgtactggatagcagaagtcttgatagaagtcttagcacagaacttcttgaagtttaaaggaagctttgtgctccacagaactgtcatgttcggctctggtgcaggaccaaggttctcaagtgtgtggagatatctgaatgaagtctttgttaccattggaacgccgtcgatagaaacgccgccgatagactctgttacccaagttgggtcgcctgagaacagtgagttgtactcaggtgttctagcgaacttaacaagtctgagcttcatgatgaagtggtcaacaagctcctgagcctcctgctctgtgaggatacctctgtccatatctctcttgatgtagatatcgataaatgtagaagttctgccaagtgacatagcagcaccgttctgctccttaacagcagcaaggtagccgaagtacagccactggatagcttccttagcgttcttagcaggacgtgagatatcataaccgtagatctcgccaagcttcttgagttcgccaagggctctgatctgctcagaaagctcttctctgagtctgatgttcttagaagtcattcttaccagtgaggtagcaagctgatccttcttgtcctcaacgagatagtctataccataaagagcaactcttctgtagtcgcctatgattcttcctctgccgtaagcgtctggaaggcctgtgatgatagcagcgtgtctggcaagcttcatctcaggtgtgtaagcgtcaaaaacgccctgattgtgagtttttctatattcagtaaagatctttacaacttcaggatcaactgtgtagccgttctgctcgcaagcattcatagccattctgataccgccgaaaggctgaagagaacgcttgaaaggcttgtcagtctggaaaccaacgatcttttcaagatccttgttaaggtaaccagggccgtgtgaggtgatagtagaaacgatcttagtgtccatatcgagaacaccgccggcttctctctccttctttgaaagctccattacctgttcccagagcttagtagttgcttctgtagggcctgtaaggaagctgtcgtcaccgtcatatggtgtgaagttcttctggataaaatcacgaagattgatagaagtgtttgaccatctgccgggcttaaagccttcccattcgtcataaaactgtctttccattttatactctcctgacataagatttcgggcagcacatattacctcaatattctgtattgcatacctattaataatactaccgctcgtatgttaaaataataacacacttcaaaatcaaagtcaagtcacattcagaaatattactcttacgccatacttctttcatatgttagaattggttacccaattcacggaaaattatttgaataaaaaagtaattgcctccaaaaagctcaaacatttttcgcaacaaaagcggtgcagagtattccgctccgacaccgctttgtaattgatttttttcaattcttctattgcttttctgcacccgcttagtaggcttgcacctatagaggctctgcctcaagctccgacagggctttgccctgtaccttttgctatcttcgctcgtgggtgcttttactttgtgttggtgatttactcggtatggcgctgccattcctcactcctcacttaaaaactacgctctctcgactttgagcagatttgtcgttccgctcattccaagcggtactcctgctgtaataacgacaaggtcgcccttcttcagatagccaagctccacagaacgctccaaagcgtgtctgatgagttcgtcagtgtttgttttctcttcgataacgcctgctctgataccccatgaaaggctgagctgatgatatgttgtatcgtcagttgtaagtgcgattataggacagttcggacggaattttgaaagcgttcttgctgttgttccgccctttgttactgtcaggatcgctacagcattaaggtcatgggcagttgtaacagtagcgtgtgagatagcgtcagtgatagatgaatttctctcgtctgctcttttcttgaaacgtgagatatagtcgatatccttttcggtcgtttctgcgataaggctcatggtcttgacagcctcaacaggatatttacctgcggcagtttcccctgaaagcattatagcagacgagccgtcataaatagcgtttgcaacgtcggttatctcggctcttgtaggacgtgcgtttgttatcatagactccagcatctgagttgctgtgataacgttcttgcctgcgttgtaggcttttctgataagctctttctggatagcaggtatctgctcgaaaggtatctcaacgcccatatctcctcttgctaccattattccgtcagcagcgtcaaggatctcgtcaatattggcaacaccctgagcgttttctatcttagcgataattctaggattgaaccagccaaggctctgagtaaattttctaagataaataacgtcagcgcctgttcttacgaatgaagctgcgatatagtcaaatcccatttttgcgccaaattcaaggtcagacatatcagcgtcagagatataaggcatagaaaggtttacgtcaggaacgttgatacccttgtggtcggaaacaactccgccgtggataacttcgcagacgatgtcagtgttgtcaactctggtagctttcagctcgatatttccgtcattaataagtattctagtgcctacagaaacgtcctttggaagctgtgggaatgtgatagagcagatagtttcatcaccctccacttctcttgtggtaagtgtgaatgtatcgccgtccttgatagtaacaggcttgtgatccttaaagtttttaagtcttacctcaggtccttttgtatcaagaagagttgcaatattaacgccaagttcttcccttagcttgcatacagtttcaaaacgagccttatgaacactgtggtcagagtgtgagaaattgaatctcgcaacgtccataccgtttttcataagctcacgcataatgttttcgtcatctgtggaaggtccgatagtgcatacgatcttagtttttttcatttttactctcctaacatacattactatttcaacgcattagcgttttaatccaaaaaaacaaagctttttaatttattataaccgattttaacttaatcgtcaatagcacaatgtataatttgtgtaaaatcgaaaaacaaaatcatacatttttcaaaacaaaaaaacggacggtcttaataaccgcccgttcaacatcttatcttccgaagcaatcctcgcaaagctcacgaagatcctttgccgccttttcaatatcaggctgagataccaccgcagaaactaccgcagcgccgtcaatacccatacccttaaagttcggcacagttttttgattaactccgcctattattacgataggaatatccacagcggctcttatttctacaagttgttcctttgtgacagctcttgcgtctgtctttgtgttggtggcatacattgcaccaacgccaaggtaatctgcaccatctgcctgtgctttcttagcttcttcaagagttgccgcagaaatacctattatcttgtcctcaccgaggatttttcttgcaactgcacatggcatatcgctctgtcccagatgaacgcctgcacagtcaacagcctgtgcgatatcaagtctgtcgttgatgataagcggcacattgtatttgtccgttatcttttttactcgaactgcaagctcatagaactctcttgaagtgcagtccttctctcttagctggataactgtacagccgccttttacaccctcctctaccgactgctcgatagtttcgcaggacataagtccacggtcagtgcagagataaagcgtgtagtcaattttcgatttgtccatttttttaccctcttatcttttatcataaaataacttccatacctgtcttgtatggcttcagccctgctttttcgtaaaattttcttgccgatggattacactcccacacgttgagagtaacattataacagccctgctccttagcgaatttcttcaccgcctcgtaaagtaccgagccgatatgctgacctctgcaattttcatcaacgcacagatcgtcgatatacaaagtctttatatccgtgagaacgttgtcgcccttatgctcctgaaacacacaaaaagcgtagcccttcatcacatcattttcatcaactgcggcaaatataggctttgttttatccttgagcatatctttaagctcgttatcagtatactttttcgcaccctctttaaaaaggtcaggtctgccctgctgatgaactctttctacctgatagagcaggctgttcatttgcggtatatccttttcacaagcaaatcttacggtcatttttcattctcctttgtatgaaaaagtataatatgcaatgcaaacggacgaacgctgttcgcccccgcaagcaacatcaccacataaaatttagtggcatcacattgatatgataccactagatctgaaatattgcaatactaaacttcttctatcttagccttagccgcaaatacctgactattcattttgctgattgcgtcaatgatagaaatatggaaacttcctgagcctatctctccagcattttcatatgcgaactcgcctgctatgcccatgcttgcaatgcctgttacagcggcggtatacatatcgtcgcaagcacctgcaaatgagcctacaagtcctgttgtcatacagcctgtgcctgttacctttgaaagatatgggtgaccgtttgatatccttgcgactctttttccgtctgttattgtatccaccgcaccagtgatagctgcaacgcagttatactttgcggctgtttttttcgcaacggaaacagggtcgtttttctcgtcagcttccgaggtgtcaacaccctttgtggaaacttctagtcctgcaagatatgacatttcagaaagatttcctctgagtatacttattttcacattttcaagtatacgctttgcagtttcatttctgaaatttgatgcgcctgctccaactgggtcaaaaaccacaggaacgccaagctcgttggctttctttccagcagctaccattgactcgaccgttcttgcattgagagtacccatgtttataacgagagcctttgaaatagaagttatatctgctgcttctgcgatatcgtctgccatgataggtgaagcgccaatggcgagaatgcagtttgcaacgtcatttacagtaacataatttgtgatacaatgcaccaaagggcatatatctcttaccttgtctgctgctttcgcacagctttcaattatagagcccattatgctcttacctcctttgagaagccaagaaaattatcaaatacttttgcctttttaagagctgtaacgataacgatagcaagaactgtaccgcctgcacagcttacaaagaaaggcaggatataaactgttattgctgcggctggtgcgccaacgagaaatcttgcaacagggtatgcaagaagtccaccgaggactgatgtgccgaaaagctcgccaacataagcgacagggagcttctttatgtacttatagagcatacctgcaacgaatgcgccaaccattgagcctgggaacgcaaggagagagccaagtcccagaagatttctgagaagtgcggctgtgaagccaacgcccactgcccatgcaggtccaaggaaaactgcaccgattatgtttacaaggtgctgaacaggtgcgcactttgaagcgccgatagggaacgagatgagcgagcctaccactgcaagggctaccaatactgctgcgaataccaatttgtgaatgtttgtctttttcatttttattcctccatatcgtatcgcaccgccgaacgaaaaagagcaagttatccagcggcgcacagaccgtggctatgctatccgctcacgatctgacgtaaattattttcggtcggtgctccattgcaccctctcaccccgaaacacgggttccctcgctgaatactttttatgaaaaagttcgcaagacgctcctcttgcacattacattctttttatatctgctctcatgtaattgtccgatttttcgtacaattgtcgagctgacattcaatttttatatcatgcgggcgaacgctgttcgcccatacatcgagttttctacttctctgagcagaattttacctctttgccctcgagtatcatgtttgttgttctaacggcacacatcttgccgcacattgagcaggtatgtctgtcggcaggtggagtctgctcaaagaatcttcttgccttttcaccgtcaagtgctatctcgaacatttcgtcccaatccattttgtgacgtgccgctgccattttatcgtcgatatctcttgcaccctttacgccctttgcaatatctgcggcatgggctgctatcttgctggcgataatgccctccttaacgtcgccaacgtcaggaagtctgagatgctcggcaggggtaacatagcagaggaagtctgcaccgcttgctgcggctattgctccgccgatagctgatgtgatatggtcatagccaggggcgatatctgttaccagaggtccaagtacatagaaaggtgcaccatggcatatcttcttttccattatcatatttgcggcgatctcgttcattgccatatggccagggccttctaccattacctgaacgtccttttcccacgctctctttgtgaggttgccaagctcgataagctcggagatctgagcggcgtcggaagcgtctgcaagacatcccggacggagtgcgtcgccaagtgagatagttacgtcatactctctgagtatttcaagcacctcgtcataatactcaaagaatgggttttcattgcctgtcatcatcatccatgcgaagagcagtgaaccgccacgggaaacgatattcatttttcttccctcacgtctgaaagcttcgattgcacgtctgttgatacctgcgtggatagtcataaagtcaacgccctcttctgcatgggcttttactaccttaagaaagtcctgagcggatatctcaaggaggtctttatcgaggtagccgatagcgtcatacataggaacagtgcctatcatggcaggcgactttgctactagctcttttctgaaagtattggtcttgccgtagtttgacagatccatgatagcttcagcgccgaacttgatagccatatccactttctgcatctcaatgtcataattcttagcgtcccctgagataccgagatttacgtttatcttagttttaagacctttaccgataccctcggcagagagagcagtatggtttacgttggcagggattgccacctgacctgctgcaacaagagccataagctcgtttacgtccatattttctttcttagccactgtttccatttcaggggtaacgataccctttttagcggcttccatttgagttttatagtttctcatagaacagttcctttcaaatcgtaatagtcataaaagtgattaacggggctatgtcctttgcccactgtgaatgatttttctattgcctcggtgatatagtttttcgccttagttacagcggagagcatatccataccgtgggcaaggtttgcagttatggcagatgacaaagtacagccagtgccatgggtattaggcgaatcaacacgcttgcaggcaagcttatgaacgccctctggggtacagagataatccacagcgtcgccagtgagatgaccgcctttgacgaggacgttttttacgcccatatccattattatccttgcagctttttccatatggttttcattctttatctccaagcctgagatagcttcggcttcggggatattcggtgtaaggagcgtaactataggaaagagcttttccctcatggtggaaacagttccgccctcagagagagcgtcgccgcttgtagcgaccatgacgggatcgcagacgataatacttggtttatactcattaagcttatccgcaactgctgaaataatttcggcagttgggagcataccgagttttacggcatcgacgtggatatcctcaaacacagcgtctatctgtttttgtatctcctcaacgggtacgttgaaaacagacagcacacgggtagtattttcagcgacgacagaggtaataacgctcatgccgaaagtttcattagcgctgaaggctttaaggtcggcttgtatacctgcgccaccggagcaatccgagcctgccactgacaaacattttaacatactttattcctttcttatggaaaaggggaaacaaaaaaacctcctgacaatgcaggaggtaaaatttacacaaattgcttcctacactggtcttgaccaacaggttcaaagggtcaggttttaccttctcaacccagctttttgcttgggttcccctgcaaactttattcgatttttcgcagtttttctgcttttttattataacactggtcagcgagattgtcaaggaaaaattgtgcagatatcacaagtattatcgagcaaacaaaatcgggctgtcgaggacgccagcccctacatttacatttgaaaatttgccgatacagtgctatgaaaccaagttggcgaacaaaggtcgcccctacagctattcgacagtttgttatgccgcaagatcgctttgctttacagtattctcctgatagtgtttatctttccgcaatacttgatatttgcaagcggctgtattctgatcccataatatgtactcatggcatggactattttcccaccgcctatatacattgctacatggccatagttattacagattatcaggtcgcctgcttctatattcttcaaagacactgcttttcccattttcgcctgcgaatatacgctgttatacatattcacaccggcttttctataggcttgcattgtcaatccacagcagtccgttgccttatattttgttccgccccagacatatcttccgccgttcatgcttgcggcataatcaacggctgtttttattcttgcttttctctcaggtgtacgcttcacaccttttccaaccttgacgtacttacccttatgatcgccttcattgataaggacataatttgctccgccgatattcttgttcttacctgccacatgcttatttttatcggtagtaagagtacccgacacagccacagaggcttttgtttttgaggatttcttgaacttaccgtttttaaagctataaagctgaacgtttttatctatataatagtatgtttttgctgctgtctttacgttgaggaccgatgactctgacttggcactgccgtttactgctttgacgatgactttatattttgtggaagctttaagataaagcttgccgtcattggttatatttatatagttatcctttttaagtgcctgccatgtatattttcttacatagcgtccgtttacatagacctcaaatgtagtctttgatgaaaagctggtgagattttttactcctgcttctattttgtttgaatacgcttgtctttttatcaaaacaggttttttcattgagtcagcagcagaagctgttataacattcacataagtcttagcggatccctgcggtgcaaatgccacaaaacttatcattataactgatgaaattatcactgctgttatttttcttattacgttgataacggatcagtcctttccggttttttgtattcatgtacttatacgatttcatttatactattatacaccgtaaattattacaatctgtaataattaagtttctattttgtaaacctttatgataatattatacatttttgtttatcgttagtatattaatctcctattttaatgcagttgttggtgctttcttgcattatcatgaacagcatatcattatttattaatattatataaatataatttatgacaatcttacaaatataagaaaaacatcatcttatggtttggtcgatttaatcaagaaaattctacaaattggtattagtcttttgcatcacttgcgaaaacgtttgctactataaaattacagcattctcaaagattgagaacgatatgtgaaaactaaaattattttgcgtaaattaattgtgaaaagtgacaaaaaagccgttcacaatcagtgaaaaagttctgaaaattaattttttataaataaaatattgcgaataccattgacaaacatagtttactgtagtataatttcattagaaaatacagaaaacgtttaagttcagttacgaggtatatatttatagtgggtataatggaggtcacgctgatgaaaagcattaattttatgggcgacaatggtttcaaagaagcacttgagagcgttggtgtaactgcaagcagcagtatcagcagcgagaagatctcgggctgttttaaatatgttacggctgacgatatgtgtattatcactggatactgcggtgacagccatatcgaagtgctggagcttccttttgagcttcgtggcaaaaaggtcatagctgttgcaggcggtgctttcgcacatctttacgaccttaaatgtgctgttatctcaaaggacgttgttatcatcggaagaaaggcattttacaaatgctgttcactggtgaatgtgactatacctgagagcgtaaggtttattggtgagatggcattctgcggttgtgaatctctgagatttgcgactatacctgatggtgtggaaaggatactgccattcacattctacaattgcgacagtttggagagagctgacctgccagagagcgtaagagagattggtgagtctgcattcggtttctgctcttcaatgaaagaaatttgtcttaatgaaaatatagtttccataggaaacggagctttccagaactgcatttctctgagagagcttgagataccggcagctatgatcgagatcgcagagaatgctttcacattctgctcaggtctggaagcgatctctataccatttggaatcgaggctgttggcgattacgcattcttcggctgctctgctctgaaaaaggttgaattcgcaggatctgtaagaaagataggcgagtgtgcatttgcactttgtgagaagctcgagagcgtttatcttcctgattccgttagcaggataggcaagagagcgtttgctcagaatactgtagttaagacggtgaggatatcaggcaagatcgcttatgttggaagcgaggctttccgtggctgtaaggctttgagagaagttgttatcccatcatctgtgaagaagcttggtgcaaaggctttcgttgattgctctgagttaagaagcgttgttattcagcatggtgccgatggcattgcggaggacgcttttgagagaggcgccgccttgatcactgctgacgctgttcctgcacttgatgacgaaacattcaggatagccgaggctgtttacaacaaaaatttcgctttataaaatatataacctctggatcggggcggcagcttttaagttgccgccttttttctgtctatttgcaggtgggatagaataatccaagtcggtaggatacgggtcattgtcggtggtacataaaaaaacgagcgaccaaaggtcgccctgcgatatgtaaacaaaaaaaatacgctctgcttaacgcagaacgtattcagtggggtgggtagtgagattcgaactcacggtcttcagtgccacaaactgacgcgttaggccagctacgctatacccaccatacatattagaagaaaatactcgcagcagattttcatctggaacgagtttaatggtacgccatactggattcgaaccagtgacctaccgcttagaaggcggttgctctatccaactgagctaatgacgcatactgtactcattgatatctcaaactcggataaaagtttaagatatattggagcgggtgatgggaatcgaacccacatgaccagcttggaaggctggagttctaccactgaactacacccgcatactgcctgaccaggcttttttggtggtctttcaagcttaccgctcaatcaacgatatttattataccactacaagagccttttgtcaagcacttttttatatttttttcatctaaactcaactttgtgcaactttacttatttgttcttcttatgttgtttcattttattcactataacatctttgaacaaaaagccaacgatacctgctactagagctactccaagcaccacaagtgcaactgtgaagttgccgctttttacattgcttcccaaaatcgtggagagcattattgccggaagtctgcaaggcatgacataatagaaaaaatccttcttgcttatgggagtcagagggacgatatatgagataacgtccttgggtattcccggtatgagatagaggattataaggataacggttagctttttctcattttgcaggaatttgaatttttttagctgtttctcgtcaacaaaggcttccactattggtctgccaaattttttcacaagcacgaatattgccattgtgccaaggagcgtacctaagaatgatagcaacccgccccagaaccagccgaacagcactccacccaccacttgtataggcggtatgaccgctatgaccacttgaagagcttgtatgaaagtaaagataagcactcccacaatgccgctgtagttatctagcttacgctccaaggctgcaatgcctgccttgctgtgaagcgcttttataagaggtatacacgccactatagccattgctatgaccgctattattgcaacaaggcttattatctgtatttttttcttgtgccttgcagtttgtattttcgcctcgtttaatatttctttctcttgttcttcgttcataaaaacgtcaccgtcattttcttctgagtatttttttcctaaaccaatttatgtacatatctgtcaactgtgtgagtgcatagtcataaataaagaaaaacaggtttgccgccgcccacagaacaagcacggcatacttgccaaacatctccatgccctcgagcatatccaccgaagtaaagatatactgaaaagccaaaaagaatatgactatcgccacattgaacactgcaagctttattgcccacaccaacaggctgtttttcttttggtcgagataatatttaagtattggataataccccatgaacaatatgaaaagcagggtcgcttcgtaatttggggtcacgaaaatgctcagcaggctcactgcacaataggtggctatcgcccagtttttatccacctccactatcatcacaaccatcataaagcctgcgaaggtagggatagtataatcgagcatgggcaaaaagctgcttgaaaacatcaaaagcaggcagacagcagagcatatgccgccaagtgccactcgaaaagctattttatttctcatgattatttagcagcacggtataaggtcgccgcccatcatttcacagcagcagtctgcacagcaaagggaggaacagcagtcaggtccgctcatgccgcctgcttggtagccctgggttgggttgccgctcatatagccgcttcgctgtctgttcatctgggctaacacgctttgatactccatgttatttgggtcgagctggacggctcttgtgaagttgttataagcctcattgagccagcctctgcggtggcagatagtgcctttgaggaaataccactcggcatttctttccgaggaggacacgttatcaagtatctgatctgcctgagtatagctgccgctttggataaggcttctgatatagcctgagtcaaagccctgcgaagaggcatagccgtcatagccgctttctgcggactggtatcctcccccacgtcttgaagtcatgatctgatcgtaggcggcgtttatctcggacattttctcctcagctacgtcagccagggggttatcctgatactggtcggggtgatattttttcacaagctctttataagctgattttatttcagcgtctgaagctgttggggatacacctaaaattttgtaagggtctttggagatcattgatcgttatttcctttcctgttattgcggaattttccgcttcttatttgagtatagacatttttaagtccaagatacacgatattatcaagtatatcacgatatcgctcaagattgagcttcacatagatatctgccatttcgcccagggtgaaatttatgctgtcatcacaaaaggcgtgaacttttttgagatagtccgcatttatgccctcggtgggtggaaattttgcaaggagcggattgtagctttcactctcgtggtcgtcgggcaggtcgtcaagagcgtcgcagatatagataaatctgccgaggaggtagccgaatcgttcaaggagcggtcggcgttcgtcctgcctggtgcaaagatttcctgcaacggcttgcatcataagtgcggtaggctcgcaggcaaggtctatgcctgctgttttttcacgttctattttattttgcaattccattgcgttttcaacggcaggggcaagatccggatagaggcaagccgcttttttatagggctttttgaaaaaaggcagcagtgcaaatgcggcaagttttccttttatgcccttatcggctatatcgtcacgaagcttatgatatgtgagtatcacggcggctgaggacgtatatttaagattacaggtacactttgcgcacatggtctttttaagagggtgtgcgatacagcgttgcttttctgcgtcaagcttcactcccctcacagagagatccataagggagagaaatgcgaaatcatagctaagggtaaagcgtgtcacaaagccatagcgcctgcccatatccttacagagtccgcagtagacagctttatagatatcatattcaaacattcgcatatagggtttgaaagggcggacatatccgaacataggcactccttaggttttcgttactatacattataaaacacgattgtgtatatcccgtgaaatatataacattatacaacaattttaagataaaagtcaataatttttatgataaaaataagggtggggtaatggagggatcaaaaagacggacgggataaaaatagggcaaaatacaaaagggcgaccaaaggccgcccctacatcaggtttttataaacaaacgctgggatcaggtcacagcaaactgtgagttatagagatcggcatagaagccgttctttgccataagctcatcatgacttccctgctctactatgtgtcccgaatccattactatgatagtatctgcgttcttgatagtagaaagtctatgggcgattataaagcttgttctgccctgcatcattttctcaaaggcacgctgtaccaatatctccgtacgggtatctatagacgatgtagcttcgtccagaatgagcattggtggcagtgagagcattactcgtgcgatacagagaagctgtttctgtcctgcggagatagtgctgtagctgtctgaaataacggtatcatagccctttggcagacgctttataaagccatgacaatgggctgacttggcggcggctatcatttcttcctcggtggcgtcaggcttgccgtagcagaggttctcccttatggtgcctgttttcagccacgtttcctgcaagaccatgccgtacatacttctcatggagtcacgggtacaatcctttataggctcgccgcttatgcgtatctcgccgctgtcggtgtcgtaaaatctcataaggaggtttatcatggtggttttgccgcagcctgttgggcctacgatagctgtacgctgaccgctctttacatggaggttaaaaatctcgataagcttcacatcaggcacatagctaaatgacacgttgtcaacgtctaatgtgccgtcaacggaggtaagaacagtagcgttagagctgtcaggtatctcctctgtttcgtctatgacctcaaagacacgctttgcagaagcgaatgcactttgaagctcggtgataacgcctgatatttcattgaaaggctttgtatactgatttgcataggtgaggaaacagctaaggttaccaactgtgaagcccacgccttttattacagaaagtgcgcccacgataccgacagccatatagacgaggttgtttacaaaacgtgtgcatgggttggtgagtgaggagaagaatgtggcgttaagtccaactttctggagtttcaggttcacttcttcaaactgctcctcagcttcttcctgatagccgaatgctgttactaccttttgattgcctgtcatttcctcaacaaggctggtcatgtcgcctcttgcaactgattgctggtgaaaaagcttgaatgtgttcttggcgataaatcttgcgacaaatagggaaagcggagtgaggataaccacgataagggttattttcacgtttatggagagcatgaagccaagtgtaccaaaaattgtacatacgcctgtgaaaagctgtgaaaagcccatgagaagtccgtctgacacctgctccaagtcggagattatacggctgattatatcaccgtgagggtgggagtcgatataagaaaggggtagcttttggagctttgcgaaagcatcgtttcggatatctcttaccacgcaataggttatcttatttgtacaaagtgacatgagccactgggcaatgcctgttacggtgactgttacgccaagcttgatgatgatattgataattccgtcaaaatctacaagtcccttggctatgataaggtcaacggcgttaccaacgaggataggagcataaagggtggtggcaacggttatgactgcaaagaccatagacatgacgaacagccacatatgcggttttgcgtatcttagaagcggtctgagagctgaggtatcaagcttgttttttgtgctttgcttagccatttgcctgcgcctccttttctgaaagctgtgaaaggcatatttctttatatacctcgcagccgttataaagctctgaatgagtgccgatacctgctattttgccatcgtcaagaacgattatcttatcagcactttttatagatgagattctctgtgaaactatgaaaacggtcatgccgcttgttttttcgtggatagcttttcttagtcttgcatctgtggcaaggtcaagggcggaggctgagtcatcgagaatgagtatctcaggaccaccaaccaaagctcttgcaatggtaagtctttgacgttgaccgcctgagaggtttttgccctcctgcaagatcatttcgtcaagcttatcaggctttttctctacaaagtcttttgcctgagcaatgtcaagagcgttccagatatcctcgtccgtggcgtttttatcacgccactgcatattgtgtcttatagtacccttaaagaggacggctttctgaggaacaatgcctatcatacctctgagctgtgagaatgggtactcttttacgtcaacgccgtcaacaaggacttcgccctgacggacatcataaaatcttggtataaggttgataagagaggtcttacccgagcctgtaccgccgattataccgatagtttcgcctttcatggctttgaaacttatatccgaaagggagtcggcttcggctgatgcgtacgagaagaaacagttcctaaactctacgcatggggcattaccgtcagttgcgacaggcttattatccttatcggatacacttggctccacagcgaaaacgtcgtttattctgatagcggaagcctgcattttggtgatattggtaacaaggatagccatagcaaggagtgccaaaagtatctggttcatatagtttacaagggctatcacttcgccctgtgaaatagagcctgaataaactgttttgccgccgaaccaaatgatagcgatgatagcgaagtttacgataacataggtggcagggttcataagggcggaaattcttcctgcgataatctgctgacgtctaagttcttcggtattatcggcgaactctttctcctcgtctttctgacgggaaaatgctctgataactcttgcgcctgtgagagtttcgcttgtcataaggttagttttatccagctttttctggatattcttatactgcggtatagtgatgtgcattataaggtagataacataggcaaggcaaggtgcgattatcaggaagataagggtaagcttcactgagatagagaatgccattatgatagaaccaagcacgataaaaggcgaacgaagaaacagacgaaggaggatattcacaccctgctgagcggtattgatatccgctgtcattcgtgtgacgagggtatgacttccaacgctgtctatttccgcataggacagtgaattgatatgcttgaagaggtcacgtcggagggctgttccaaagcctagtgacgcttttgcggcgaaatactgagcagtcagcgcacaagccagaccacagaaggcgaggagaacaagcacgccacccattttatagatgtagggcttatcttgattttttatgcccacgtcgatgatattagccataacgatcggcactgcaagctcgaaacaggcttcgataagcttaaacagcggaccgattatgctttcttttttatagtttttcagatacctaaaaagcttcagcatttttctttctcccaactaaataaaatcatataaattttattatatcatatgtttttgtacatttgtagacgaataagttaattctttaaaaaagcgggggataatgcaggggtaaaaagtttgcccgtctttatacatcggcatagtttgtgatgattcaagcctcgcacctccgagcgggacgccgagggcgtcgtcccctacaataatcatcgccgcaggcgataccttcattcctcacttcttattcctcacttctaaaaaagggggttgacaaaaggatgaaagtgtgctatagtcatatcaataggtttaaatgctatgacggaaataagtagccttttgcgaaatttcagagagctttcggtcggtgcgagaaagcatttctacaaagtgtgaatacattcctgagctgttcgccgagaaagcttttgcgtaaggcgaaacggtttgcacacgttacagtgctatggcttcgctttctgctgagcctgtaaggtcgggagttttcccgataaactgaggtggtaccacgatgattcgtcctctgacagatactctgtcaggggatttttttatttatgtaccgcaaaaaataatacggaggtatgaaaaatgacagtatttgaagaactgaaaagaagaggtcttctcgctcagcttactgatgaggaggaaataaaggagcttatcaacgctggcaaggctactttctacatcggctttgacccgaccgctgattcactccacgttggtcactttatggcactttgccttatgaagcgtttgcaaatggctggcaataagcctatcgttcttatcggaggcggtacggctatgataggcgacccgtcaggcaaaacagatatgagaaaaatgatgacaaaggaaactatcaaccacaatgttgaatgtttcaaaaagcagatgtcacacttcattgatttttctgatgacaaggctattatcgtaaacaatggcgattggcttctcgaccttaattatgttgatgtgcttcgtgacgttggcgcttgcttctctgtaaacaagatgcttacatttgagtgctacaagcagagaatggaaaggggtcttactttccttgagttcaactacatgataatgcagtcctacgatttctacagacttttccaggattacggctgtaatatgcagttcggcggtgacgatcagtgggctaatatgctgggcggtactgagcttattagaaagaagcttggcaaggacgcttatgcaatgactatcactctgcttcttaactctgagggcaagaaaatgggcaagacagaaaagggcgctgtatggctcgaccctgaaaaaacttctccatacgagttctatcaatactggagaaacgttggcgacgctgatgttatcaagtgcctgaagatgctcacattcgttcctatcgaggagatagaggaaatggagaaacacatggagggtgctgaatacaacaaggctaaggagcttttggcttacgagctgacaaagcttgttcacggcaaagaagaggctgacaaggctgacgctgcggcaaaggctatttttgcaggcggtggaaacagcgacgatatgcctagcacgactattgcggcggctgatcttactgacggcaagataggtattcttacacttctcgttaagtgcggactttgcccttcaaatggcgaggctagacgtcttgttacacagaacggcattgcggtgaatggtgagaagttcactgaccctaagggtcttgttgatctctctgagcctgttgttatcaaaaagggtaagaagatcttccacaaggctattgcggaataatatagtgcaaaataatttccacgggtggacagaagttcacccgtttttttgtatacaaatatatggtattttgcaatattcataaacattcacacaaaatacatataagatttagctatatttaaagttattcatatatacttttaatcaaaggaaagtttacacgaagcatacgaaaaaaacacgaaaagaggcgtggatatgaatggcaatcaggaagtgttcagacggatagagaaaaaatatatcgttgatgaaccgacttatgaaaagcttataaaaaagctcgatgggcattttgtcaaagacagatattacaaaagcactatctgcaacatatattatgacacaccaagtcatcagcttgtaagaaactccattgaaaagcctgtttacaaggaaaagctgagagtgaggagctacggcgtacctaatgatgaagacatggtctttgtggagctgaaaaagaaatacaagggtgtggtctacaagaggcgtattgaaatgacccttgcacagacccgtgatttctttgcaggcaaagaggtacctcatgataatccgcagatagagaacgagctgaaatattttctcaaattctatgagggcattgctcctgcaatgtatcttagctatgacaggcttgcttactgcggtacagaagacccgtcccttaggctgacctttgacacgcacattctttaccgtgaagagcaaaaggagcttgacaagggcatttggggaaaagagcttctgcctgctggcatgagggtaatggagataaagataccgaacgctatgccactttggttatcggctatacttgatgaactggagatatatcctgcgtcattctcaaaatacggaactgcgtatcttaacgaattttctgaaaaaatacataaaggtaaggtgataagctgtgcttaattcaactactcttgcggctactactgtgaccaccactgaaacgaccgtggcggcgataactacaaacgaatttgttttctgcactgcggcgtctttggtgcttggtcttataattgcatttgcattcaacttcaagcagaaaaagacaaaaagctttatgatgacgcttgctttgctgcctgtgatagtacaggtagtgataatgcttgtaaacggaaacatcggtacgggcgtggctgttatgggtgcattcagcttggtaagattccgttctgtaccgggaagtgcaatggacatttgtgctatcttcctttcaatggctgtcggtcttgcgacgggcacgaaccaccttgcgttggctcttatgcttgcggtgtgcgtgagcctgctgaacattatttatacgcttctgcctattggcaaaaagaagtcgggtcacaaggatcttagtatcactatccctgaaagccttgattacactgaggtatttgacgatatatttgaaaagtatctttcagaatgtgagcttgtttcggtaaagaccacaaatatgggaagccttttcaagctgaaataccgcattgagctaaagggtgacgctaacgaaaagaagcttattgacgaacttagatgcagaaacggcaaccttgagataatgtgtgcagtggcagcagacattgaggaacaatcattctgacaaaataacaaaagtatccataagcaaaaccgcacaaggctaaagcggtcttgtgcggttttttcaaccttttttaccatacaagggggtatttttcatgaaaatttcggacactaaaaagctggcagctatcacggcggcgttttttatcacggtcacggctttttcaggctgttcagagagtgcaagttcttcacagaccacaaacagtgtttctcagtcggcaaagtctgacattgacgcaagcattgcggcagaggacattgacgttggatatgacgaggaaagctcaatagggattacatttgctgatggcagtgcagctatagacggtgagggtgcgacctcagaaggggaaactgttaccatttcgcaggcaggcacttacattctttcaggcacggcgaccaacggcaggataatcgtttcagcggacaagacggctgaaataaagcttattttcaatggagttgacataacttgtgctgacaacgctcccctgcttgtgagcaaagctaaaaaagtttatatcgtgctggaggacggcacagagaacgttttgacggacagtgcaagctactctttaggagaagatgacagcaacacagacggtgctattttctccaaagccgaccttactataaacggcagcggtacacttactgtgaatgcgaactacaagcacggcattgtttcaaaggacgatcttgttatcactgacggcaatatcaatgtgacctcggcatcaaccgctatggagggcaaggacagcgttaagatatctggcggaacattcaacatttccgcaggcacgaacggcataaaatccactaacacagaggcttctgacaaaggctttataagcgtgacagggggaagcttcacagtagtcacaaacaatgacgcattcgaggcggaaactgtgctttctatcgagagcggaagctttgacatcaccacaggcggtggaagtgcaaacgcttctatgaagtctgacggcacgccaaacagaaattggcaaagcaacatgagcaacggtggtggtggtccgaacggaatgggcagacctgacgataacggaaacggcacgggaggcgacctgcctgcaatgcctacggctgacaacacaggtctgactatcaagactacggccaacactactacagacagcgacagcacttcaacatctgcaaaggctttaaaggcaggcaacgaggtgaacataagcggcggcgagttcaagatagattcggcagacgattcagtacacagcaacggaaacattgttataacagggggaaacatttctgtggcgtcgggtgacaacggaatgcacgctgacggaaatctgaccatatccgacggcactgtagacatcacaaagagctacgaaggtatcgagggagctatcgtgacaatagacggtggcaccatatcagtggtagcaagcgatgacggaataaactgcgcaggcggaagcgacactggatcaacagacagaatgggtgctgaccaattctcgtcacaggacggtgttgaacttaacatcaacggaggaactgtaaccattgacgctgaaggcgacggacttgactcaaatggcaacttcacaatggcaggcggtacggtttgcgtttgcggacctactaacggtggcaacggtgcacttgactacaacggcactgcaactgtaacagggggaacgctcatcgcctgtggtgcagttggaatggaagaaggcttcggtgacagctccacacaatacagtgttctgcacgatcttggttcaaccgtttcagcaaacgaaaaactgactatcactgacagtgaaggcaaggagatcttaagctttacccctaaaaagacttggcagagcgttgtattcacaagcgctgacctgaaggaaggcgaaacctacaccattacggcagggtcgcagtcggaaaccgtgactattgacggcattgttacttctaattccaaaggaatgagctttggcagaggtcatggcggaggacgtggtttctgatatgaacgacaaaaggacgaactttgggttcgtccttttttatttggccgatttatcgttcatagtatgcgggacgtcgagggcgccgtcccctacatttgtgtaatataaattgtaggggcgaacagtgttcgcaagtttttgctcacctttgttgtatacatacgcaaaaaagaccgcctcatgatgaagcggtctttagtaagcaatttagttttggctgtgcagattatgcaagctcagcaaagtacttgattgttcttaccatctgtgatgtgtaagagttctcgttgtcgtaccaagaaactacctgtacctcatagagatcatcagcgatcttagataccattgtctgagtagcatcgaagagtgaaccaaatctcatgccgataacgtcagaagaaacgattggatcctcgttgtagccaaatgactcagatgatgcagccttcatagcagcgttgatgccttcaactgttacgtcagcaccctttacaactgctgtaaggattgttgttgaacctgttggaactggaactctctgtgcagaaccgatgagcttgccgttaagctctgggataacaaggccgatagcctttgcagcacctgttgagttaggaacgatgtttgcagcaccagctcttgctcttctcaggtcaccctttctgtgaggaccgtcaaggatcatctggtcgcctgtgtaagcatggatagtgctcatgataccgctctggataggagcatacttgttaagagcattagccataggagcaagacagtttgttgtgcaagatgcagctgaaatgattgtatcgtcagctgtaagtgtcttctcgtttactgagtaaacgatagtcttgaggtcgttaccagcaggagctgagataactaccttcttagcaccagcatcgaggtgagcctggctcttagcctttgatgtatagaagcctgtgcactcgagaactacgtctacaccaagcttgccccaaggacaatccttagcgtccttttctgcataaatctgaagagtcttgccgtcaacagtgatagtattagcctcatcgtcagctgatactgtgtgaaggttctcaccgatcttaccacagtaaccgccctgagctgtatcatacttaagaagatcagcgagcattgaaggctttgtcaggtcgttgattgcaactacctcgtagccctctgcgccaaacatctgtctgaatgcaagacgtccaatacgtccaaaaccattaattgcgactttaactgccataattaatttacctcctaaaaatttttctgtacttattatactacatttttctatacattgcaagtgtttttacaaaaaacttagaactttttttctttaaggcaataccgcacaaagattgtgcgtcagatgcgtagtcagattttttcgtcaggtcacataaaaattccgcaggcatactgtcgtatgtcaagggatttttgtgtgatatggcggaaaatctgcaagcagatggcgtgcaaagccgtcaggcgggctttgtgcggtgttgccttaaaacttcaccgtaaagctatctgtgtcttgatccgtcaaagcactgctaaattctttaaaatatgatcaaatattgatgattttttattgactaccccgacagtttaggttataatatttacatgagatctttatgaaaggcaggctaacaaagtggaactgacatcttctgtgaaagagatatatgctcagtctgaggaaaacattatcctcactgacgctgagcttaatgtcatttggaaaaatcatggcgatctgcctgatgttatagatatttctgctttatgcgatactccggaaaacgctttcattctgcctgttgaaaagacagctacctttgaatataagggcaggtttgcagactcagcggcaatgcggtttgaaccgctgagagataatggcgttataacgaattatctcatacactattactcctgcatggacatagaacgtctttcggacaagtctgggtatttacgcttcaaatcgaattttctcggcaacatcaggatagagctttctaaaatgttagcgatgcttgacagccaaaagaaatccttttcttcaaaaaccggcactgaatatgagcattttgaccacgaggcaaggcttcgtatactaaagacattttccgcaacggtgaacatgacagagcttgcgaaatatttcagtggcaatttcacaactgaatatcagagcctatcagacatatgcggtgaggtatgcgacgaagaaggcaatttgctggaggaggacggctgtattttcagatactccattgacccatgcatttattttgaaacaaacaaaagccttattaaaaatgtgcttgtaaatctgcttgtgaacgcatatatgtacaatgacaaggaacagcggcaggttgagcttatcctaaaaaccgaggacgacaggataatactgtcagttagtgataacggcaacggcatgacagacgaggtatggcaggcggctatcacgccctttggcacatttcaaaaatacagcagcaatgaggcattgggacttgcacttgcaaaatgcttctgcgtccgttttggcggtgagctgagttatcgcagtgagatagacaaaggcacttgtgtgaccatgagtttcccttgcgacagccgtggtttgccgaaagaattccatgttagcagaatgccacccataccgaacccatacggcagcacatactgcataatggctaaggggcttgatccgctgaaatagggtttgggcaatatacagagcaagtgaatagataggacacaaaaaaggcagtgccgattttctcggtactgccttgatttttttatgaaaattagtccttgatgatagacttacctgtcatttcctttggctgctcaagacccatgagtttgagcattgtaggtgaaaggtcagcaagcacgccgccctctctgataaggacattgcctgcacctgcgatgataagcggtacaaggttcgttgtgtgggctgtgaacggtgagccgtcatcttccatcatcttatctgcgttgccgtggtctgctgtgataagtgctataccgccctttgcaagaactgcgtcaactgttttgcctacgcactcgtcaactgcttctactgctgctacggctgcgtcgaacacgcctgtgtgacctaccatgtcgcagtttgcatagttgaggataattgcgtcatacttgtcagactcgattctcttgagaacttcgtcacaaacgaggtatgcgctcatttcaggctggaggtcataagttgctacctttggtgaattgatgagggctctgtcctcgttctcaaaaggagcttctacgccgccgttgaagaagaatgtaacgtgtgcatacttctctgtttcagcgattctaagctgtgaaagacccttctttgcgatatactcgccgaaagtattttcaaggcttgctggcttgaatgcaacatcaacgtttggcattgttgcgtcatactgtgtcatgcagacatagtaaagtgggaatctgccatttcttctctcaaagcctgtgaaatcatcgtcaacgagagttcttgttatctctcttgctctgtcaggacggaagttgaagaagataacgctgtcgtttgcggatatcttgccgttctcatcgataactgtaggaacaacgaactcgtctgtaacgtcagcggcataggaagccttgatagcgtcaactgcgttatcagccttattgccctcgccgtataccattgcgtcataagccttgcctacacgctcccaacggttatctctgtccattgcatagtaacgtcccattactgttgctatcttgccgacaccaatttccttgagcttttcttcaagctcagctacgaagtcaacaccgcttgtaggaggaacatctctgccgtccatgaagcaatgaacgtaaacctttgtaagacctgctttcttagcaagctccaaaagaccatagaggtgtgaattatgtgagtgaacgccgccgtttgaaagaagtccgaacaggtggagtgcgctgtcattcttcttgcagttctcaacggctgctgtgaaagcttcatttgagaagaattcgccgtccttgatagactttgtaattcttgtaagctcctgataaactattcttcctgcgccgatatttgtatggcctacctctgagttacccatttgtccctcaggaagtccaacgtccatgccgcttgcgccgataagagtgtgcggatagttggcaagaagtctgtcgatattaggtgttttggcagctctgatagcgttgccgtaatccttgtgattatagccgaagccgtccataatgataagtgctatgggtttctttgacatatttcttagtcctttcaacatcatttatattcgtattatccccaataaccgccattttcaaggaagctcaggacatattccttaaattccttggcagtatcgtcgcttgtgtaataggtctttgtgccgatacggacatagttgctctctcctgactcatagtagatagctggaccttctgaacattttatatccagccaatcgccaccgacaacatactcctttgaatccggctctttttcttctgcgttttcagttacctttttggtgaactctgcggttttgtcgagaagctcgctgtctgtaaactcaacgccgctaaggagcttactagagtccattttgatagttacattttcaagcttagcctcagatgttgtctgagagctttctgccgctggtgcgctgctttcgtcaacgcttccgcaggctgcaaatgacatacacatggataatactaatgctgcaaatattatttttttcacagttgcgtcccccctgttcaaaaaaagcagaggacagccgcagccgtcccctgcggaactttttatttgtttgttcttgtgacgaatgatattttacccctagatatccgtctgttaattagccctcaacagcagcctgaacgatagtgttgaagtcagcagccttcagtgaagcaccaccgataagaccaccgtctacgttctccttagaaagaagctctgcgcagttcttagcgttcattgagccaccgtactgaattgtaactgcctctgctgtagcctcgtcatagatcttagcaagtgttgctctgatgaatgcacaaacttcctcagcctgatctgctgtagctgtcttgcctgtgccgatagcccatactggctcgtaagcgataacggacttcttaacgtcctctgctgatacaccgaagaaatcaagctttacctgtcttgcgataacttcctctgtgatgttgcactcacgttcccaaagaagctcgccaacgcaaacgataggcttgaggcctgctgcaagagctgcctttgttctcttgtttactgtttcgtctgtttcaccgaaatactgtcttctctctgagtgaccgataacaacgtactcaacgccaagctcaacgagcatatctgctgagatctcgcctgtgaaagcaccgctcttctcaaagtgaacgttctctgcaccgatctttacgtttgaacctgctgttgcgttgatagcagtttcaaggtttgtgaaaggaacgcaagcgataacttcaaccttgccctcagcgtttgcaacaagtggcttgatagcttcgagaagctccttagcctcaggtcttgtcttgttcattttccagtttcctgcaataattgcttttcttacagcttttttcatgataaaaaactcctttattttttatagggaacagaaaaactgctcctgctagttttccaagtctattatacaacattcactcgtatttgtcaactaattaacaaaggcttggacttattttatctgtttttttacagcttatctataagcatgaccacaccgaaaacgccaagcaggacaccgatagcgatagccgcatagccgaaaggcgttttctcctctttttcctcggcttccttttcctcctcagtgacttctacctttgatttttcatcgtcaaggtaaaattcctgtgggttttctgggttatactttatgtctatcatgtcgcccttttcatagccgttgtctgtgactatctgggtatacttttcgccgtcaatggtatagcctattttccactcggtaaaaactctgtcctcaccgccgttgaagtcaggcattgtggtcttgactttctgcaaggcttttgcctgagttggttcgtagtgatcctcctcagggatattatattcctgctcagggaaaaagcgatagccctgcaaggctttgataccgaaatagataagtcccacgcctgtgagcagaagaattattccgcctatgccctgccagcctaatccgctttttgcaagtagtgttatttcattcatttttactacctcgatttctgcataaaaaagggacaggcaaaacctgcctgcccctagcttatagcttagtaaaatatattacttgtcagcaatcacgtcgatacctgggagcaccttgccctcgaggtattcaagtgaagctccgccgcctgttgagatgtgtgacatcttatcagcaaaaccgagctggataactgctgctgctgagtcgccgccgccgatgatagttgtagcgtctgtttcagcaagtgcctttgcaactgcgattgtaccctttgcaagtgttgggttctcgaacacgcccataggaccgttccaaacaactgtctttgcagacttaacagcctcgccgaagagagcctgcgtctttgtgccgatatcaaggccttccttgtcagctgggatcttatcagaatcaacaacttctacgtcgataggagcgtcgattggatcagggaagcctgctgcaactgttgtgtcgatagggagaagaagcttcttgccgagcttttcagcctttgccatcatttccttgcagtagtcgatctttgtatcgtcaacgagggaaagaccaacttccttgccctgtgccttaaggaatgtatatgccataccgccaccgatgataagtgtatcgcacttctcgaggaggtttgagataacgttgagcttatctgctacctttgcgccgccgaggatagcaacgaatggtctaacaggtgtttcaactgcatttccgagatagttgatctccttctgcatgaggtaaccaactgctgtttccttaacaaactttgtaacgccagctgtagaagcatgagctctgtgagctgaaccgaaagcgtccattacgaatacttcgtcgtcaacgaggtcagcaagttccttagcgaaagcttcgccgttctttgtttcctctgcgcctctgaatcttgtgttctcgagaacaacgatatcaccgtcagccatttcagcaactgccttcttagcgttgtcgccaactactgtatcgtcagcagcgaatgttacctttgtttcaggaagaagctctgcaagtcttgcagcagcaggagcaagtgagaacttagcctctgggccgttctttggcttgccaagatgtgaacacagaactaccttgccgccgtcagctaccagtttcttgatagttgggagagcagctgttattctgttatcgtttgtaataacgccgtccttaagaggaacgttaaagtcaactcttacgagtacctttttgccctttacattaatgtcatcaacagtaactttgtttaaacctgccattttaaagacacctctcaatttaattttttaattcacgttgttaaaaaactaacaaccttacctttattatataacataccgccataaaaatcaagtatttttttataatttttaccctgattttataactttaggcttttaaagtgcgtccacctttatctctccgttgtcagcggatattgccacggcggacactgctccctcgcccttgtctataagcagttcggctatcttatcctccacctcgtttcttatgacacggcggatatctcttgcaccaagcttctgaccgtatgccttatgtgcgatagttttcagagcttcatctgtatatctcaggctgatatgtttctcctccagcggcgacttcatctcgtccagcataagacctgctatgcctgcgaaattctcctctgtgagcggattgaacacaactatctcgtcaattcttccaagaaactcaggtctcaggaaatctctcagggctttcattgctttatccttggcaatatcactgtcggtcttattgaagcccacacctgtatctctatcagtcgaacctgcgtttgatgtcatgacgataactgtgttctcaaaggaaacacttctgccctgtgaatcgttgatacgtccctcgtcaagtatctggagaagtatgttcataacgtcagggtgagccttttctatctcgtcaaaaagtaccactgaatatggtctgcggcgcaccttttcggtaagctggcctgcttcatcaaagcctacatatcccggaggtgagccgataagctttgatactgagtgcttctccatatactcggtcatgtcaactctgataagcggctcggtggcgtcaaaaagctcttctccaaggactttcacaagctctgtttttccaacgcctgttgggccgacgaaaataaatgaagccggtctgcgacgttttgaaagctgaacccttgtacgctttattgcctttgcgaccttatcaacggcttcgtcctggccgataacacgctttgaaagggcttctttaagatgctttatcttatcatactcggtctgagctatcttattggcagggatacctgtccaaagctctattacctttgagatatcttcctctgtgacctgaacgtttttaagagtttcttccacttcattgagtctgttctgtatcctgagtatctcgcccttttcctttgcgattatctcatagtcagggtctgacttctgctcgtaatcctcaacgagcttttcatgctttttaagttcctcgttaagtgcgtcgaactcctctatctcaggtgttctgatacttgtgcaggcgcaggcttcatcaagaagatctatcgccttgtcagggagaaatctgtcgttgatatatctttcagaaagcactgcacactctctgagcatatcgtctgatatcttaactctatggaaattctcgtaatactgctttatgcctttgaggactgtgattgtgtcctcaactgtcggctcggaaactgttacaggctggaaacgtctttcaagtgcagagtccttttcgatatactttctgtactccttgaaagtcgttgcgcctattacctgtatctcgcctcttgaaagggacggtttcaggatattagctgcattcatcgttccctcgttatcgcctgtgccaacaagggtatgcacctcgtctataaagaggataacattgccctgctctttgacctcttccacaagacctttgcaacggctctcaaactgtcctctgaactgagtgcctgcaacaagtgcggtaaggtcgaggaggtaaagctccttatccttgatatgaaacggcacatctccgccaactatcctctgtgcgataccctcggcaatggctgttttaccaacgccaggttcgcctataaggcatgggttgttcttctgacgtcttgacaggatatggataactcttgatatttccttatctctgcccacaacgttatcaagcttgccctctcttgctttctgagtaagatttgtgcaatagttgttgagaaattttagctttttctttttatcctttggatttttatctccgccctcatcggtggctttaggcatacctcctgcgaggttgctgaaaagattggctgcgtcaccgccgaaaagattgctcaggaagttcgttccgcccggctcaaaatcgtccccatcggaagcctccataagctgatttgacattgcttcaaggtcatcgtctgagatgcccattgccttcatataatcgtccacctgcgaaatgccaagctccttggcacaaacaaggcaaagtccctcgttcttcttgtgctgagggtccttggcgttcatctgtgagatgaacaccacagcaggacgctttttacatcttgaacacattaacatttttatttgctcctttccttactgatacaccttacggtaatcatttatacagaatatcaaagaagtaactgaacagataggtattttcaaaaacagcgctgttgaacttgggaagcttgttctcggtagcatttatcacagtgcagaccataaaggctatcaacaccagatacagaccgcctttgcaaagaccaagcgccatgcctgcaaaacggtttgccgctgtcagacctgccattcgggtaaaaactcccgacagacgcaggataagccttatgactatctccataagcacatacaccgtcatgaacacgcaaagccttataaaagtcagggcgatcggccggaaaatgttcttttccagatactcagcaccagttctgccaccctcagagagagccttgacggcttcgtctatctgctcggtagtgaacttcaccgccttagacagactttttccaagcttattgctctccagcttttcgctgagcttttggggcataacgctgtggatatactctgaaagctcctcgcccttttgctgagcggtatcaaggtctgttccctttgaaacaagcagcttttcggtattctccgcaagagtgcctgcccctgacaggacgttttttatctcctcatctgaaaggtcgatatcaacgccctcatttttcagttcattgctcacaagctttgaaagatccgtctgttcagcagcgttttcaaggctcgttataagctgtgttttgaaatatttgttatatacattttcagccgacatattggctataagaaaagccacaagaacggctgccactgttccgagcattgtgatgacatatctcacaaagcccttacagtatcctgtcagagcggtcacgataaggatcattataactgctccgtcaaaaaaatatgccatattttcctgcctttcgtcaggtctcgaaagctattttgtttatctcatgcagacccaggaaataaacgctgtcgttgaggtaaacaaagtcaagatactcagaggacactgccgctgttgcaagtagatttcctgcactgtcataggcttctatattatcctcgccgagaaggatcaccttcttgttctctgcggtcattttcttaggcttgccgctttgagtataaacaacgctgtcaggcttatctccgtcagagtccgaacggaacactgcaagagttcctgttttacgctgtatgccatcgaatgcaactgcggcagtggtatctgtcagggcatagtctgaaagttcctcaggatattcatactgcataagtattttaccattgctgtcaagcttgtagaagcaggtatcgcccactacccaataatcgccgttatcgtttcgctgaacggcaactgcgagagtttcaagctgttcgctcttcatcttctcctctgtgctgtcaaaggtcacataatagacgaccgagcgtaacgctccgccactgctggaaaatgttgagatgcaacagccgcttccgtccttatcaaagcttatatcaagtattcttcgtgagcttgaccactgatatatctctgctcccgaagagtcataaactgtcagcactgcggcatatttctcagtctgggtgaccactgcaactgtgctgtcaggggctatctccgccaaaagtatagactggtctatatcctttgagagcagctcgccctttttattcagcactctgaaagaatttccaccgttatcgtaaacaagcacacgctttccagatgttcttacaacagggtttgcaaagttgtgagaattatccgatatcttattgccagactcgtcataaaaagcaatgttcctgtcgtcaactcgaactataccgtcggaaagctgttttataacgttaacggagctttcatcaaaggtcagcgggaaatttccgctttgctttttgccgtcgtttactatagtggcatgaggtctgtccaaaatgccctcaagcttcggcacccacactcctcttgaagcgtaaacgccaactccgaaagcgaccaccactgctatggcagctatctttttatagagctttttgtttttctctttctttcttgccgctcttatatcggtgacgttggatatctcctcgtcagacctctcggctttctcagcctttttctcttttctgcttttatgctcggatttttcatctttgctttctgaagcctgctctttattttcaccgcctgatactgttatcttgctttcatcagctttttcaggcttttcctccttggctttatcctcggtgttcgtcagctctattctgcttcgtgactcctcggcttcttccgcttcttttcggagctgttcttcctgctcacgttccgccgctttctgagccgcctttttctgacgctttatctctctgaaagtaacgttcggcataggctcttctgcaccgtgaaactcgtcacgctgaacaaaatccgtctgcttggttattcttattgttttttcttctttggtaggcggatttttctttctccgcctgctctttgatcttttatcattcaccttgttcagatcctttatctttatcataatacacttcgttaagatacaatccctgcggcggaacggtctttccgcctcttgttctgtcctttgacgcaagtatatcgggtatttgagtttctcctatcttgccctcatttataaaaataagcgtgcctaccattatccttaccatattgtacagaaagccgtctcccgaaactgtgaatatcacaagctcgccctcacgtcttacatggaaagagaatatagtcctaactgtattctcctttgtgcaatcggtggaacacatggctttgaaatcgtgcgttcccacaaaatcctgtgccgctttatcgagctttttttcgtctattggaaaccaactgcggtaggctgtatccctataaaaaggattttttatctcgctgttatggataatatactcatactccttgccgctgcacatatatcttgcgtgaaaatcaagggggactttttcgcactccagcaccgagatatcgtcagggagctttgaattaagcccgaaaactatcccacggcaggttattgtggactctataagaaaacttgcacaaaatcttcttgcgtgcactcctgcatctgttcgtgaacagccgttcactgtgactgtctgtcccgtcagggcgaggatagcttcttcaagcacctgctgaacggcaagggcgttgttctgcctttgccacccatgataggctgtgccgttataggcaagtattatcctgaaatttgtcatgagtatatcccgtttctttagtcgagtgttatggaatctatattgtcaagtcttactatcatggtgctgtcgcttttcttttcgtggacgataagctttacccactcgtcgtctgcgtcaagaatagtacagctatgaccataaatcccatcgccgtcaatggtacattctctgccgataagttcttttataatgcctgacattttacttcccccatttgcatttctctcaagtttcttgacttttctttccaaagcatcaagtctgtcgtcctgatccatatctttaaaaacactgctcataatacccctcctaaacgactatatttatgacgataacgcctgcaaggaacagcacgcagaatatagagccatagagatcgactatgctcatatggagctgtttcattcttgttctgccctctccgccgtgatagcaacggcactccattgcgagagcaagctcctcagcgtgtctgaacgatgccacaaaaagcggtatcagcactgggataagggctttggctttctgtatgagcgagcctgtttccatatccgctcctcttgctttctgggctgacattatcttgtctgtttcctcgataagggtagggataaatctcagggcaatagtcatcatcattgcaagctcatggacaggcacttttatctttttcagcggtgaaagcaatctttcgatagcgtctgtcaggtcgataggcgaggtggtgtaggtaagaagcgaagtgccgacaataaggcagattatccttatcatcatgaacactgccgtgtcaacgccttcatcggttatcttgagaaatttccactcaaaataggctttgcccgttctgataaaaagcagattgagtatcgccgtgaatattattatcggcacgataggcttcaagctttttagcatgagtttaccgggtattttcgatatgataaaagtgagaatagtaaaagctatgcccacaagaagtccccacacgctgtttgcggcgaaaagcattactatgaaaaccgccgtcattattatttttattcgtgcgtccattcggtgaatgacagaatttccgggaaaatactgtcctatagtaatatcctttatcaaggtatattcctccaattttctatctcaacttacacagtcctgctctctgctcatatgggtcaaaggcagtccgctgcttacttattctttttctgctccagcatttcaaggatgacctttttcgcatagccaactgtatacacatcgtccttaatatctatgcccatggctttgagcctgtttataactcttgttatctgtggcactgcaagtcccattgacacaagctcctcagagcggtggaacacctttactgtatcgtcatagcagaaaagcttcgattcgttcatgacgagtatctttgaaacgttctttgcgatatcctccatagagtgggataccagcaaaacagtgtttttcatctgctcatgatactctcttataagaccaagtatctgctctctgcccttagggtcaagacctgaggctggctcgtcaaggataagcacctttgggttcattgccataacgcctgctatagccacacgccttttctgtccgcctgaaagctcgaaaggcgatttgtcaagtatctcagggcttagccctaccattcttgcggcttctttaacatacttgtctatcagctcttccttgatacccatattcttagggccaaaggcgatatccttataacaagtctcctcaaagagctgatactcaggatactgaaacacaaggcccaccttaaatcttataggacgaagccttgatttatcgtcccacagcctttctccgtctatatagacgcttccgctcgtgggcttcaaaagaccgttaaaatgctggataagggtagacttgcctgagcctgtatgtcctattatacccaccatttcgccgtcatttatctctatattaacattgtctacggctgttttgcgaaatggtgtgccctcgccgtaaacataagtcaagttttccgttttaattactgccattgttactccctatcatttaagcatttcataaagcttctgaacgcactcatcctcgtggattatctcggtggagatgtcatagcctgcccttttaagctcccagcaaagctctgtcacctgcggcacgtcaagtcccagatttttcatggtttccacatttgagaatatcttcttcggaacgttatccattatgacctcgccaccgtctattacaacaacacgctgtgcctgtgcagcttcctccatataatgggtgatcaacacgatagtaacgccctgctcgttgagcattttgacagttttcattacctcgtccctgccgtgagggtcaagcatggcggtaggctcgtcaagaagtatacaatcaggcttcattgcgattatgcctgcgatagccacacgctgtttctgtccgcctgaaagcttatgaggtgcatgaagtctgtattcatacataccgacggttttaagagcctcgtcaacacgtctgcgtatctcattcggctcgacgcccatattttcaagggcgaaagccacgtcctcctccacgatagttgcaactatctggttatcagggttttggaataccatgcccaccttttctcttataggcaagaggttattttcgtccaaagtgtccatgccgttcacatagacagcccccgactcaggaagatttatagcgtttatgcactttgcaagtgtagatttgcctgagccgttatgaccaagcactgccacaaactcgcctttttctatgttcagatttatgcctttaagcacctccgttttaacaggtggctcttcaaggtcgttcacataggaaaagtgcagatcctttatttcaataaaactgctcattttactttccttaccaaatttagtttattccttatcttcaggctgttctttctgttcagcctttctttccttatgcttttcgtaaacattttcggctttgtctattcctttatcaaggagcttttcagccttgttctttacctttttgcccgtttcgctctctgcgaactcgtgggctttttcctttcccttttcaaacagctctcctgctttgctctttatcttctgccccttttcactttcagcagcctcgtgagctttttctttgcccttttcaagcatatttcctgccttgtgtttaagttcatcaaaatcaaaagacataacgtttcctcctgtctgaaatttcggtttataccttattataatatatgggtatgcgaacgctgttcgcccctacatattgcccataagcttttcaatatcttttactgttggcggataaagtgcgataggaaacttttccaccgccgcacctgccacagcacaagctgttttcaccaatgtatcgtcatcaagacctttataaagtccatatacagcgcctgccttaaagctgtcccctgcgccaagtgttgacactacgtctactttaaatgcagggcacatctttggcacagcaccctttctgccatacatcgcacccttttcaccaagtgtgaatatcacaagcccgtctgtattatctgtataaagcctgaaaagctcatcatagcttttatccggataatattcatcaaggtgctgatgagatatgcaatttactgcacaatgctcatgtatatagctgtcataggcacaatctatggtgacgtatttcttgccatattttacgcaatactcagctatcttatcaccaaaataagggtcagccgcaacgcaggctgaatttttcactgactcctccgaaggctgttcataaaaaggctccggacgtgaataaagcttatcccactcgccaaaacaggtgcgtgtatttttatctatgataacatagtcggtcacgccctcgaaaccctctgttacaagttccgaaaggtcagcagtcttgtctgcaaaataatcctttataagcttttcattgccgcttccaaggtgagtacccccaagctttacaggcacattcagactgcaaagaacagccgccgctgttccggtctcaccaccgacaaggtgatatttttcctttatctctgccgttccgtctgcctttggaaaatcaccgtcaagaagaaacgaacaggtggagatcatttgaccgtacatataaacataattctcagtatatttcatgcgaacaccattccttactatagcaaagctatttctgccaaatcgccgttgaaccgcatggaagcacaccgcctgttgcctccacaggcaatcctatctcatcagccgtaacgtttccgccaaacctcgttccgaggacatctctcaggatatatgccataactgagggtgaaagtcctgtggtatagctgttgagcaggaagaaaagcggctcgtcgctcaaaacgcctgagcaggtctttacaaggtcatagatacaatcttcaagcttccatatctctccgccaggtcctctgccgtaggacggaggatccataacgatagcgtcataggtcttgccacggcgtatctcacgctgaacgaacttttcgcaatcgtcaacaagccagcgaataggcttatcggaaagccctgacacagcggcgttctctcttgcccactgcaccatgccctttgatgcgtcaacgtgtgaaacgcttgcacctgcttcggcacaggcaagggtagctccgcctgtgtatgcaaagaggtttaacacctttatctctctgtctgcgtttcttattttatcagccatgaagtcccagttcacagcctgttcagggaaaagacctgtgtgcttgaagcccgttggtctgattataaacttcaaattcttatagcctatgttccagctttcaggcaggcgctttctgtattcccattcgccgcctccctttgaggaacggtgataaatgccgtctgcctttgtccaaaggtcagaacgcttcggtgacttccagattatctgagggtcaggtcttacaagcaccttgccgccccagctttcaagcttatctccgcttgaagtatctattatcttatagtctttccagttttctgcaattctcatattttttatccttatataaaatttactttttccacggccttttattttccgtccagccctttgcctgccaatatgcactgtcagcagggttccagccctttttgtttgcaaagtggaaaatagtgaaaaacattctgcctttaaggctgacctttggctcaaagctgtcgcttttaagctttgcggcaatgcgatcggtctttttctctatctttgcaagcattttgtctgaaaccatgctccagctcgttgcgtgtatgccgaagcctatcttatatatcttaggcactccccagaatgacaagctatccgccatatctttgttagtgctgttcatgcctgcacctgcggcggtggatattacaacggcacgctttgagaacattttctcctcagggcggtggactatccaacgccagccgtaatggtcgagccatgctttcatcgagcccgtgcagtggtagacatacacaggggaagtaagtatcagcacgtctgcttcgtccaccgctttggtgataggctcaagcttctcatagtgaggacacttttcttcgcctttcataaagcaattggtacagccacagcagaactcgccgaaatctctcggcaggaagaactctgtcacctcgccgccaagtttatcggctaacattttgcctatatgatatgtagagcctttatggttttgaccgtttatcaaagctattttcaaaatatcaccttacattttttcgataagctccgctatcttgtgtgcatattctgtgattatgcctgttctcttgccctctatcataacacgaacgagaggctctgtgcctgactcacggacaagtatcctgccctcgtcaccaagcttttcggaatacatctttatagcgtctgttatctcagggactttatcccacataccctttttgtctgctgttatcttaacgttcacaagcacctgcggatagcactccatgcaggaagcaagctcgcttgccttttcgcctgtacatttgaggactgtcagaagctttgtacctgtcagctcaccgtcgcctgtgtttgcatagtcaagaagaatgatatggcctgactgctcgccgcctatattatatccgcctttgagcatttcttcaagaacgtatctgtcgcccacctttgtggtagcggcaacgatgccatttgcctttgcatacttgaagaagccgaggtttgtcataactgtaacaacgcaggtgttgtttttgagtatgcccatgttcttcatatattttgagaagatagcaagtatcttgtcaccgtcgataagctcgcccttttcgtcaactgcaagacatctgtcagcgtcgccgtcaaaggcaagaccgatatcgcaatgattatcaacaactgccttttgcagaccctcgacatgtgttgagccgcagtccttatttatattcgttccgtccggcttatcgttgagcattatgcactttgccccaagtccctcgaaaattctctgtgcgcacacagaagctgagccatttgcacaatcaagtgccacacggataccattgaaatctgtctgaactgttttcataacatagcggatataatcccaagctgcgtccttttcgtaataaacgtgacctatatcacagccgtccttaagctctatcttttcaggtgtgtccaggataagtgcttctatctcgttttctatctcgtcagaaagcttgaagcctgtgccagagaaaagctttatgccattaaactcaacagaattgtgtgaagcggatatcataacgcctgcgtctgcgttgtatttctttacaagcattgcaacggcaggggttggaacaacaccgagtatatgagcgtctgcaccaactgagcagataccagccaccagtgcggactccagaatgtcgcctgagatacgggtatccttgcctatgattatctttgccttgtggttcgtttcctttgtgagcaccattgcggcagctctgcctatctgcatagcaagctcacaggtaagctctgtgatagctactcctcttgcgccgtcagttccaaataatcttcccataataattagctccttttcgaggtcatacctctatattattttttatttatgtaaactctatattaacacacatattaaattgatccgatacaatttttatcaaagacagaaaagtgcggtaacggcgaccaaaaatcgccaatacagaacaagacagaaagtgcgggtcctattcgggcgaacactgttcgcccctacagaacaagaaattcatcgccgctaggcgataccataattcctcattcctcactcctcattcctcattaagcattcctcattaaatcaaaggtgcgtttgtccgtccttgagaaatcccagatgatcgtaagcaagctgtgtcgccacacgtcccctgggggtctttgagaggaaacctagctgcataagatatggctcgcaaacgtcctcaatggtgactgactcctcgccgatagccgccgcaagagtttcaagtcccactgggccaccgtcatagccttttattatcattgtcagcagacgtttgtcgagagagtcaagtcccagtttgtcaacgtccattctgttgagagctatctttgcaatgtctgcggttatcctgccgttgcccatgacttcggcaaaatcacgcacacgccttaaaaagcggtttgctattctcggcgttcctcttgaacgctttgctatctcctctgcaccgtcatcatcacaagccacgccaagcaaaactgcagaacgctttacgatatcggaaagctgttctgtattgtaaagctccaaacgctggataacgccgaaacgatctctcagcggtgcggaaagcgagcctgctcttgtggtagcgcctataagagtgaacttgttaagctcgatccttatagaccttgccgcaggacctttgcccatgattatatcaagtgcataatcctccaaagcaggataaagcacctcctccacctgtcttgaaaggcggtgaatctcgtcgataaaaagcacgtcgcctttttcaaggttggtgagcaaagccgcaaggtcgccaggcttttctatagcagggcctgatgttatcctgatgttcactcccatttcgtgagcgattatggcagaaagagtggtcttgcccagaccaggcgggccgtaaagcagaacgtggtcaaggctgtcgcccctgttttttgccgcttgtatatatattttcaggttctccttgaccttttcctgaccgatatactcgtcaagtgttttaggtctaaggctcacctcgaaatcgtcagttgtttccgcctgagtttctttcggggtgactatcctgtctatatcaaaatctcctttttcgatcatttatggagttctcctctcaaaatttcgcaagtccgataagagctttctttataagctcttcaacgctcaaattcgggtcaagctttgatatcactgacattgcttcgccctcggtatatccaagcaccacaagggctgtaacagcttcttcgacagctccgcttggaacaaccgcaaagccctgagccgcatttcctctgacggatatggtattctcttttgccaccttatccttaagctcgaggactatcctttgtgctatctttgtaccgataccctttatctttgtgaaagcctttgaatcccccgttgcaaccgcaagcgcaaactgtgacggagtgcaggctgaaagtatggcaagacctgccttcggacctactccgctgacagatatgagcatacggaagcttttaagctcctccttagttgcaaagccgaaaagctccacggcgtcctcctttacggcaagatgtgtgtaaagctttacttcgctttttcctgctatctgctgcaaggtagaaaatgttgttttgcaggcatagcccacgcctgcacattctattacggcaaggtcgctctcggtatgaacgagctttccgctaagtgaatatatcatattatttctcctcaaaatttttcataacacgccttgtgttcaccgaaagcccgtgagttatagcgatagccactgcgtccgctgtatcgtcaggctttgggatagctttaagatgaagcatggtctttgtcatttcctgcacctgctttttctcggcacgtccatagccgactatggagcatttcacctgcaaaggcgtatattcatagattggaatatttcttattatagcaggaagcagggtcactccccttgcctgtgcaacgtcaatggcggtcttttcattggtattgaaaaaaagcttttctattcccatttcatcaggcttataggtggttattatctcggtcatatcatcatagatgactttcagccgtctgttgaaatccatatccgaagaagtggttattgcaccgtagtcaacaacagtgaattttccgctgttgtattcaagcactccgaatcccacaatggcgtagcccgggtcgataccaagtattctcaaatccactcctccgttcaatttcaacgctatcctataatgaccctattataacaattaattataccatatttttcggtcaaatgcaagcaaaacgctgagttttcacctatttctcacaaggcgaaaatgtagaaatgccactttgtgaaaagtctgtttttggctaaactgactatagaacaaaacagcggtcatcaggtatgcccctgacaccgctgttatctttttatgctgtattttctaagtggcgacttccacaatctttggaggataagaccattgagcgtgcctgtgagaatgccgcttattataagataaggcaaaaggctgaacaccgcccatgtgcctgatatcactgccgccgcacaaagctgacctatgttatggaaaaagccgccaaaaactgatgtcacccaaagctggttttcaccaactctcgaaaccgcaatgcacatggcgagatacgctaaaattccgcctgtgagtgagaacgcaaagctcaccacagttccgtaaagtcctgccgcaaggactatcctcaaaagcagcaccaagcctgcttcttttctgccgataaaaagcattgctgccattgtgacgatattggcaagcccaagcttcatgccgcctatgggcataacaggaaactgtgcttcaaccataaaaatgataagtgacaaggcggtaaaaattcctataagggtgattttttgtactgatatcttcatgtttccacccctatatcacagcgtcagcagatgtctcaccgactatttttatcacaagcttgtgcggggcacaaatgacggtctgtcctgcgtgggatatctttcctgcatgaacacaggtctggttcgagcaatctgcgacagacacccaaattcttccctcgccaacggttatggtattagtgccgttttctgtttttatatcaaaggaatactccttatcgggggaaaggtcagaaatagtctttataagcttgccgttttcatatatctcggcagatttttctccgctctttccacctgtgaggaaaataaatatcagacacgcagcgataacagccgcaaaaactgccgcccatatgagattctttctttttaccactgccgcactcccctttttacagtatatctgttgttatgagtataccacagccgttctttttcgtcaagacaaacggcaagtgtctgattttttgtacttaaatattacagcaaggttacaataaggtacaagatttcgtacagttgtaacattgctgtaattttcaccgaaaaagccgaaaaaattgtcgaaaatttatcaaaatatccttattctgttatgttacaatagatagttgacaaaacaaattgaaaaacaacttccaaaatgatataatgttaagtaccaccaattggtggtacttaacattatatcattttggaagttgtttttcaatttgttttgtcaactatctattgtaacataacatttgctttaaatcattaaggcaaaaataatacaaaaaatcgttgcccattgtaaaatttcgctgttacccctttctgatacttgacaatttgtgttatatatgttataactaatacacatactaatttataaatcattattaataaataatgaaaagaggtgatacatatttctacaagaaaagacggtatcgaaacgaaaaaaaagatactcactgtatgcgtccaactgtttctggaacaggggtataaacagacaactatctcacagatagtgaaaaaagctggcgttgcaagaggaagctttcagaacttattctccacaaaagacgctattctaatggaacttgtgggcacgatgttcagcggacaatttggagtggctaagaacattgttggtgataatatgtcgccgatatacacatatgctgtggaaactgccatacagataaccctcactgagctgaatgaaaatctccgagagatctacattgaagcttatactatgcctgaaacggctgagtatatctatgtccacactacggcggaactgaaacagatattcggctcgaattttccgggctataccgaaagcgatttctatgaaatggaaatcggaacatcaggaataatgcgcaactatatggcaagaaaatgcgatatccattttcctcttgaccacaagcttagacgttttctgacggcggcaatgcgggtttataaagtaccagaggaagaacaggcaaaagtgcttgcatttatcggatcgcttgatattagagctatcgccacagaggtcatgtataagctgtttgcaatgttggaaatgacattcgattttaaactttcaaaagatgatgaagagggggaaacaaggtgaaaaaacggttattgagcatcatacttactctatgtatggtaatgtccattacaccattgaacgcatttgcggtcacagaatatggcatatggataggcgacgaacaggtaacatctgataaaacatggagcaaacagggctggaaatacgatatacaaagcaagaccctgacgcttcttggctacaatatggcgactataggcaaacgtataaacggcaacagcgaaaggcccagccgatttggtcttatatacgttgaaggcgaacaagatctgaacataaagcttgtcggcagcattgatcttggtgacagcccgttttcaagccaagctgcaaccaaatacaatgagagctacagcggaatttatgctcctgacagtaatatcacgatcattggcagcggaacgttttcagcagtaacacatgacgcagcaatatactgctcaaatcttactatcggcgacggtactgaacaaaacgctactaatgtatcgtgcgaaagcttcggcgcttgcattatcgtaaagtataatatgatagttaatgactacagtactgtttgggcttgcgcaaacggaccaactgtgggcatgaacggcatttatgttgagggttcgctttatgtaaacggcactaataccactgtggagggccgtgctacatacagacctgttaagggagagtgcaccaattacacacactacagacctaaaaatctcacttcaggcggatatttcaacaatgcaggttcaactattgcaggaataatggtatatggaattttgacagttgacggcagtaaggtcgaaggtaacgtctttaaagagatatacaaaccacaagagtatgattcagaatacacctcaggccttgaagcaggcggtattgtaataaagaacaacgccacagtagaaggcagaaacattaatccgtccacgccgggattcatggaatatggcgtacaagttcaccattacgccataaaatttttaggaagaggacgtgtccgtgccggaacagagtatgtggattatgaaagcgtcaatcgtggtttccgtaaatcaggcggcaacgaaataacagtttcgggacggctgaaactctatgaaagcgatacttgtcccgctgacttcaagaagtttgcgcagtatggcttcggagggtatacagaatattatacagaaaacatggatgacatctatataaaagatgataatggccgtggtaaaatgtcatatttcaaggatatgcatgattatgaaacattttatttagcaagcggaatagatctaaaagatatatatgaaatcgatctggacaccaacgttccatttgatgtaaacatactttcaggcgatatcaaaatgaacatagatatcaaaagcggttttgagcttccgaagatcattgtctatgacggcgcaactttaaaattaaagacctcccctgataaaacatataatttcacttatcctatcgagttgaaaggcggcacgatagaatttacaaacagtgcgatcgtccgaggacttaacattgtaggagagggcaaggtcatcattgatagcggaaactactctggaacgcttggcgacaacgtggtcttgcagatatcaggcggaagcgctgacttcaatgacaacggcaaggctgtggacgcaaaaggaaactcggtacacaagtacacctatgttgcaaggggtgcagatggcaatgagtttataggcagtgctaacacacgtcagccgccatatgacgatttttatggctataaccgctcagaaatattccatgacggaaacaagcttcatctctggctcaagtcacaggattccatttatggcgtgaatgcttttaaaataaaagctgacggcactcttgaagatgagaacacctattttaatctgcgttatggaacgaatatcttagagcataggataccttttgatcctataacattaaaatactttgttgtgaaaaagaacgacgtcgttacgctgaaaacaatggaaaacgagccgtcctcactgcaagacagtgatatccgagtagaatggtacagtgttgaaaacgacaagcgcacaaaaataaatgcccatggcacaagcatgtatgtggggcgtatgggcaacagtgacaatggtacgcattatcaggcagatgtatattatttaggctgggattccaagctcaatcattcatatacctatgacgcatatatcttcattgacgagccggtatttactgctcctgacaaattccacttggataaaaaggcaaaattcgaggtcacaaacaatacaccaaatggcgcagtacggctgaattacctatgggaagtgagcaaggacggcggaaagactttcaccgccattgacggcgaaacttcttctgtttacgagcctactatagaaagccaaatgaacggctggcagataagatgcaaaacatgggtatcaacaggagacggacagaaaactgaaccgaccgttttcggccctgttacgataaacttctccgaaaaagcaccggtcatagtaaagcacccgcaaagcggtgcaacaaacgctcctagccagcctaaacctgttaagcccggagaaataactatcgtaattgaacgttactatttcttcaatgtagaagcaacaggcagtgaaccgctccaatatcagtggcaggaaagcagcgataacggagaaacttttgtggatattccatataccaatgacaattcacattcattaaaagtgcgaaaagaaaacaacggaaagcttgtgcgctgtgttgtatcaaatgaatacggctctgtagtttcaaatgcggcaaagcttacaatatattattctcctgagtttacaggctcactcggcaataagaccataaacagcggagaaaaggctgcgttcacacttcctatcgctcagggaaatccttacggagctgaggtgatatggcaggtgagcaaggacgatggaaagacttttgcagacgttaccgaagctgacggaacgttctctcttgattcaaaagtcgtggacggcaaggaagaatggtcgactacattcaccacctgtgcaacgaacataagctttaacggatatatgtacagatgtacggtcaagaacgctgaaaatgcggactatgtgggtacttgggtatcagaaaaagcaacgcttacagtaataagaaactgcgcagtagacggacatatatttgacgagggaacgataatctccgagccgacttgcatcgataagggtgtgaagaggtttaattgctcagaatgttcacagtacaaagatgagcctataaacccattgggacatgattggaaagaagcgacctgcacagctccaaagacctgcaaacgctgtcaggctactgagggcgagcctatcgaacacaactttggcgattatatatccgacgaaaacggacattggaagcagtgcagtgagtgcggaactgacagccaaaaggaatttcacgcctacaagtggaatacggaagacggcgaatattggcaggaatgtacaatttgcggatatgaaacgaaaaaatcaactattttgaagatatccataaacggaactgacgagacctgtcctttaggtgattatgaatttacatttgctctgcctgagggctgtactgacgtgacagcaggcttcagatttgcaggcgacggtacagaattggcgtttactgcaaaagacgatctttacaccgcaaaggtaagtgcgtcagatcttgagagcggaacaatgacggtttacgcttcggcaaaactcaaagacggttttgtcatcacaggtgaaaaagaagtaaccgtgctggaaaaccatgtgggcggcactgcgacttgtactgaaaaagcaaagtgcaaattctgtaataaagaatacggcgaccttgacccgacaaatcacacaggcaaacctgtttgggactttgacagcaaagaacatgagaaaaaatatgattgctgcggcgaggtgactatcgagagagaaccccacgaatggaacgcaggcgaatgtacagagtgtggatacaagtgtacacattccggcggcaaggcgacctgcacaaagaaagccacctgcgatatctgcggcagtgaatacggcgatatcgacccgaacaatcatggaaagctcacacatatagataaagttgacgcaacacatgataaagagggaaatatcgagtattggtactgcgaagaatgcggcaagtatttcggtgacaaggacggcacaaaggagatacaaaaggcagacactattacagataagctgaaggacactccaagtgatgacaaaaaagataactcaaagccagataagccgaaagacgatactaacgagagcaaggcagacagctctacagcagaaaagccgaaaaacgattcaagcgaaatcaaggcagacagctccacggctgataagcctaagagcgagcagaaaaatccacagaccggaagcggcagtggtatgagcctttggcttgcaatgctgttgataagcggcggtgcggcaatgggaataaagaaaaaacacaagaaataactgatctcttaactgcacacagcggttgtctcaaacggcagccgctgttttttgatcaacatgacaaaaaatttgttacccaaagttaaattaccccttgacctgtggcgaaaatagtagtaaaatagaaatgtaaatacaataattgaaaggaatgttcatcatgccaaagtttatcgttgaaacatctgcacgtcacgttcacgttactcaggaaactcttgagatactgttcggaaagggtgcaacacttacaaagaagaaagatctttcacagcctggtcagtttgcttgcgaggagagagttacagttgtaggtcctaagaaagagcttgcaaatgtttctatcctcggtcctgtaagaaaagcagaccagatcgagctttcagctacagacgcacgttctatcggtgttgccgctcctatcagagaatcaggcgacacagcaggttcaggcgcttgcaagcttgttggcccatgtggcgaagtagagtgttctgagggcgttatcgttgctaaaagacatatccatatgacacctgctgacgctgaaacattcggtgtaaaggataaggatatcgttgcagtaaagatagagtctgcagaaagaacagctatcctctgcgacactgttatcagagtaagcgacaagttcgctcttgctatgcacattgatacagacgagtcaaacgctgtaggcgcaggcagagagcagtacggtgagatagtaaagctctaatatcgcagtacatacaactgttgatttgtaggggcgaacagtgttcgtccaccttttaaaaactttcaaccaaaagaccgctcatcaaaaagcggtcttttttcatacaaaaaaatacatcgccgcaggcgataccataattcctcattcctcactcctcattcctcactattattacaacgtttcgattgacacaaaactccacctgtgatataattttcttgtaaaacacataacgcaaatatggagatcataaaatgaataacgatacaataaaacttatacgcaaaacctcaaacgtaaattcacttatggtgataattttctatatgcttgatatcgcacttataagacttggcgacttggcggtgtaccatatcgcaggaaagtcagcctactatgaggatatcgctcagcttgtgagctactgcatacagtatctcgtggttgtgccaatagttcttgttgcattcagacttgtgagtggcaaaaaagaggggcttaaaataacagcctgtttcagaaagccctcaatgcctgcaaaatgggtggcgaagtggatagtcatatcattcgggcttatctacgccgcaaattatatcaacacatttattttctcatatgtgcagaaagcttcgggaacgagccttaaaggcgttgacttcacttcaagtggcactgccctgggcggcgtaacgagcgtgctggcaatgtcagtgcttgcaccgttttttgaggagcttatgttcagaggtacgcttttcagaaatgctgaaaaatgcggacagctcacaggcataataatggtggggctgacattcggtctttggcatggaagctatcagcagatactctatgcggctgtcatgggaatgtgtgcctgctttatggttgcaaaaacaggatctatcttcccgtctctgatacttcacttcaccatgaacactatcggagcaattcagagcgtcgcacttggttccatagactttgacaagtttgccgcagatcttgaaaaaggtcagatcacaggcacagcaccaatgataataattgctgtcgctcttctctctttcggtcttatgatagtaggacttgtactttttgtaaaagagcttaggtatcaccgtgacagcttcaggctcataaacttctgccctgacgtttcacaaggcaaaaagatagtcatctatttcaccgcaccagttaccatactcgcctttgccgggcttatcttcatcacagtccgcacagctttaggtcttgggctattctaaaatacgcataaaaataacgcagactttttacagcctgcgttatttttttatcaggagttatttattatgatttaaggcttgcgatcttctggttgagttccttgatctcggaatctacagttgcagaatacttctcacgaacctgcgtccatgtggactgtacaccctcttcattaacatttgaagcatcactgtagagtgcgtcaacaaggcactggtttccgtcaaactgctttctgtcgccgagagcggaagatataccgtaagcatagtcaaagagcataaggtaatcgtcagaaacaacgtccattttcacatcatacatctcgtctgtccaattagggttgttctccatgaacttgtccttgtttgtctgctcatacttaggatctgtctttgaagctcttacgcactcgaaccagcacttaacagcttcgcttcttgttgaaccttttacccacatgaaagctgtcatatcagaagttgttatcttctgctgattatcgtcatactgagggataggaacaacgccccagttctcgccctcctttggagtttggttgcctgtgtaagcccactcgcccattgcatagaacaagcagttctgattgaagcaatctcttgcagagcctacccagccgttgaggataagtccgtccttcatcatattataaaggaagttctgagccttttcgatatcggggtcgttaagattgcttgaaaactcgtttgttgcaggatcatagtttacaagacgcttgcccgtctgctgaacaacgtgcgctctgaagaagccgtttacgccgtaacgctcagtatcagccggtgcgttgccaacatatgaggacatgatatcctcccaattcttccaagtccactcattgtttacataaagctcatatggatcgtcaaggccctctgcgtcaatgatatccttatcatagcagagcatagcagaagcagaatagccaagaggtgcaacataatgctttccattgagcatgaactgatctgctgtatcctttgttgcagaccacaaaggctggctgaaatcaactatgctgtcgataggctgatacatatcctttactacctgtgaagggaatgcaagccactcatacttgaatatatcaggaatatccttgttagctgtgatagcagcagcaagattatcaaatctgtcctcatttgaagtctgctggaatcttatctttccgcccttgctctcaaaaagctgaagctctgtgctcttctcaggactgcccttagtagggttaaggtcgccctcaccgagataaagtatctctttttcagcaccctcagggatagcctcgatagattccgtgtcagctaccgcaacgttctctgttgcagaaaaatcgtcctccgccttgcttgaagagtttgatgagcttccgcaacccgctactcctgttgccattgacaaagccattacagccgctatgtactttttgtaattcataaaatattcctccataattaaatattttagcgtcaaagctgtccgtatgtagttgatgagttcatatattaaatcttgctataattatacaacacatataaagctattgtcaatcaccattatagcacaattatcagcaatttcattgtacactttgcacaattaaaaccatatgtatcgttaaaacacaatattacaatcaatatagtttaaaatatgcgcataaagttcaaatattcaatatgcccgttttgaatgaatataaaacaaatacaagagctttttgtagaaaacattaaccaaaacagcaaaatatgtacagcatttatgcagttcgtaaaacttttttcatgtaatcgtttgatgttttcagtggtacttgtaattagcgaattattatagtatacttgtttaagaagattttttaccgaaaggaaattgcttgatatgacagattttgaaagaaacaaagcaagggtgacagccgaatacgaggctctcatcaacagaaaaaacattgtgtccgacagctacaacggaatttatgacagatacgtttaccctgttctgacagccgcacacgcacctattatctggaaatatgacatgaaccctgagacaaatccatacttcatggagagattgggcataaacgcagtactgaactcaggcgctatttatctcaacggcaagtattaccttgttgcaagagttgagggcaatgacagaaaatcattttttgcagtagcagagagcgacagccctgttgacggcttccgtttctgggacttccctgttcagcttcctgacactgaaccggaggaaacaaacgtatacgatatgagacttactcagcatgaggacggctggatatacggtgtattctgctcagagagcaaggacaagacttcaaacgatctttctgccgctacagctcaggctggaatcgtaaggacaaaggatcttaagacatgggaaagacttcctaatctcaagtccaagtcaccacagcagagaaacgttgtacttcaccctgagttcgttgacggaaagtacgcattctacacacgtccacaggacgattttatcgaaactggctcaggcggaggagtatgcttcggtctttgcgaagacatcacaaaccctgttatctgcacagacgaagttgttatctcaccaaggcagtatcacacaatcacagaagtaaagaacggtgcaggcgcagtgcctatcaagacaccaaagggttggatacacattgcacatggcgtaagaaacacagccgcaggtcttagatacgtaatttatgtattcgcaactgaccttaaagacccttctaagctaatcgcatcgccgtcaggacttttcatagcaccacacggcagtgaaagagtgggtgacgtatcaaacgttgcgttcacaaacggcgcgatcgttcgtgaaaacggtgacgtatatatttactatgcttcatcagacacaagacttcacgttgcggcaacaacgatcgacaagcttatggattacacattcaacactccgtcagacccactgcgttctgttgactgcgtaaagcagagatgcgatcttatcagaaaaaatctcgaatatcttaacaagtaatatatcaaacacaaacagacggcttctgctgtctgtttttttgtacactaaaacttttttcaagtctgcgatatccgtgcataaatattgcactacccatgtaggggacgtcgtcctctacaattatgctatggtttgtctgccgcaaaactgctgagtccctttaccgcaactttttttatataccctcttgcaatcgtccacaatctatggtataattaattaataaaagcacaatatatgcaatatcacgcacaaaattttctcttaactaaggagtgtttataatgagatgtcctttttgcaactatgaagatacaagagtaatagattcacgtccaagcgagggaaaaaagcgtcgccgccgtgagtgtccgaaatgcggaaagcgtttcactacttacgaggtggttgaaaagccacagcttatggtatacaagcgtgacggctcgtttgagccttttgacagacagaagcttataaaaggcattcagaacgctatcaaaaagcgtcctgtcagtgttgatgatatgaaaaaccttgttgacgatatagagaacacctttgcaaacaaaatgcagactgaaaccaccaccagcgaaataggcgatatggtgcttatgggtctgaaaaagcttgaccacgttgcatatgtgcgttttgcttccgtttacaaggacttctctgacgttgattcgttcattcagataatcactgagctttctgacaagaagaaataaataagagcgttccgataattttcgggacgctttttttgcaccaaaaaagcggacagccaaagccgtccgccatattttttatattgtattaaagctgtgtatcaacaaaaattgtatagatagccttcattgcagattcaaaatcagcctcgtttacaccgatgatgatgttaagctcgctagagccctgatctatcatctttacgtttacatgagcgtgtgcaagggctgagaatattctgcctgctgtacctctgtttgacttcattgcacgtccaacaactgcaataagtgcaaggtctgtttcaatatcaattgtatcagggtgacagtttctgtgcagacctgacattatctcctgctcctttggagcaaactctgcctgatgaacaacgacagacattgtgtcgatacctgaaggcatatgctcaaagcagataccattcttctcgaatacttcaagcactcttctgccgaaaccaagctctgcgttcatcatatccttttcgatattaactacagtaaagcccttctttcctgctatacctgtgatcgtgaatgcaggcttctgagatgtggactcaacgatcattgtacccatatcctcaggcttgtttgtgttcttgatgtttattgggatacctgcttttcttacagggaaaatagcgtcctcatgaagtacgcctgcacccatgtaagaaagctctctcagttccttatatgttatggtagtgataggctgtgggttgtcgataattctagggtcgcataccaggaagcctgatacgtctgtccagttctcataaagatcagcgtttactgctgcggcaacgatagagcctgttacgtcagaaccgcctcttgaaaatgtcttgatagtatcgtttggcattgagccgtagaaaccaggtattaccgcattgtcaagtgtagctaatctctgaggaagcacctcgtttgttcttgcagaatcaaactgaccctgatcgttaaaatagataacatcagcagcgtcaacaaagttatatccaagatagttagcaagaacgataccgttaagatactcgccacgggaagccgcatagtcacgtcctgccttgccgataaagcaagccttgatagtttcaaactccttttcaagagaaaggtcaagacccaaatcattgattatgccgtaatatctttccttgatagcgtcgaactcgctgctgaaatccttgccctttgcagcaagatcatagcagccgtaaagcatatcagttacctttgtatcgtttgaaaatcttttaccaggagcagacggcacaacaaatcttcttgagctttccgctgtgattatctccttaacctttttgaactgctcagcacttgcaagagagcttccaccgaattttacaacctttgtcatttcacaaaccccttataaactatagaattaatcctgtctgcgtacttttcccacgctgacgttacaataaatagtataccgaatttgcgtgattaagtcaatgtataaatggactaatttttatagtttttttggtgtatgtttgtgaaatacgcttgtatttgtatgacggacaactcatgcttatctgtctgcctattatctgtaatgttcgtctatccacttatcatgttttcgtgaaagaaagccccagcgttcttcaacacaaaatgcagcagataaaacaagcggcaaagaaagcagcacagccgcaataataagaatagccatattacttacgttcacaagaacgcctcccgtctcggttttgttatgactatattatagcgttccttacttaaacagaccttaatgcaaagtgaaaaccatgtgaaaaaaagccccgaccgaaagtgcggcgctgatatagcagtataatcccaactactatattaagaccaaaacagcgagctatgaaaatgaaagacagatacttccacaagagaggtatctgtctttttacatagaagaaacgacttccgttattagatttaactggaactagtggtctgaactaatttattctttatgatttccagacttttaaaaccattatgttcagatgaaaaaccagaaataattgcttccatcgtttcggaactccagtaaatggttagttttttctttgtgcgagttatcgctgtgtaaaatacaccttttgttattttttcggtattaacgctcggaataacaacttttacagaatcatattctaagccttgtgctttatgaatcgaaacggcatatgctaactggaaaggtataatagtcttcttagcgttttcctcgtcatcaacttcatcttcatcgaaagcatatacaatgagtttaatccgagttttttcgtctatggtgtcaatgtactctatttgatctgatttacattgttgttcagtaattattgtttccacatcaatagtaaacgctatttgatcatcagccttttcaatttcaacgatgatccctttaagattattataaagatatgtgaaacgagagttatcattaaagagaattttgtctccctttttaaacctccagctttgccatattatagcttctccatttggatttgcattttggaaataactgtttatattatttaacccgaatttcccatcatagttcaagcataaaacaacttcatctttaacgtcagaagtaaaaatatctgatccgatttcctttgaaaagggcccgtctatgacgagtttttcggtgatcctaacatcattgttccttacttcttcccataggctcagtaagttttcttcccgagtccgccaagtatcaagtaattcaacgttagctccatgtgtagttatgatatctttagcataataaaaccagttaccaaaatcaattgattcgatttgattgatgtctcctgcaaggacaatcaatgaatccgaactaattttactaataaagttaagcatcgttcgattatctattgtactgcactcatctacaaaaataatatcataatctggcaaattaactcttcttgtaaaactatcaatacaaataaaatcagaatctgatcctggattatcaattcttctttgaaggtgttgaatggcagcatgtgttttagtaagaaaaagcttttttgatttgggcataagactagatatataattaataagtgttgttttacccgttccagcagcaccatatatcaacagtattcttgaattaacaaaagcatatttaattgctttttgcttggaaacatcaaccttgtcaaagagtgctgaatgatcttttataaatcgtgcgtttagttctttttgacctttaattcctgcttgcgtaaaatctaacaatctctgtagaatcttaagtgtaatggtttcataggcagatattgtaactaagccactatcatttactatgctatatccttgatcttgctcccactcaactaaatactcattataatcgttaatggatttgtctgaagcaatttcgcttgctttgaaatataattcacccgatttatttatcgcatttcttattcttagatatggtaaaagaatattgattttttctgttccagatgcactaagtatttttgttatactaacttcagctgttttactatgtggtaaatttgctagaagcggattgcgttcaaatggacgacatcctgatgcaaggtaaagaggggaaccagctagcatttttgtgaatctattaggcattacatcaattagacttttttcacgaagattaatcaaaagataacgaacaacattttttccaaatattacggaatcggaagaataatctcttctcaatatctcaatcacttctctaaagtgtttagtgtttgtattaccatatatttgatcagtaattgaatggaaatccatttcttgtaaatcaataagatcaagcaacgtcattcccgttttggtgagaaaactcattaattcagcatactcgccatagtttgcattcaaacttaatggaatatttaatattcttccaagtttgtttaaacaagtaggtgcaatggataccctccagtttgtgatgatttttatatttgaagcaataccccataaatcaatcgttgtgtcggtatagccaatattaattgaataaccagttgaaatattctgctttgaataaacagttattctattaaatttagtagcatatttattggctaattgcaaggtgatttcataataacgtttggtgccaacataaaatggcattttcttttgaacataaaaacgtgtgctttccatagaacgaggtgataaatccgtagattcaatagcttttgcaactatattatagtactcgttgtcaagttgatccgtatttagtgggaacttttcaaggttttgcaagattaaaatcttgtaaatattatcgaaaaattctctaatctgccacatgaagttatagtattttagcatcaatctttcagattgaccatcttccggaatacggcaatcaatatacttcaatcctcttaaaaaattagcaagatatttagttctcaaatcgagttgagcttgttcatatgctaattgaagatttggctttgagcatccaagattataagagtttagtaaaagagccgctctacaaagatcatataatttcggtagaatatcttgtgagacttcatctctagttgcgccaaggctttctattgtatcaatacttctgactatcgacctattacaagccattacaattcttttgatctcatcaagattaagctgagttgaactaagcttatttacaaatgaatgatgttcaattatacgatcaagttttttacaaaaatcaataatactttcatcagtattataaatttcctctgagggggcgaaatcaaccgttatacttccttgagtgaaatttatagagttgatatagtctacagacatatacttccagaaaacacgttcagagcctctttcatcaggattaagtacaacaaagagtattccggggtctaaggtgacatccatagccatcgttgcaggaaaaccaagactttgcaatgaatatttgattttcccattatcctctctgtatgaatgagatccttttatctgaacaaagaaattttgcttaggtcgccttgatacatcaggatctgctacatattcaaacgttccatcagtattaggccacttatcattagatgcaaataatgggttaatccgcccatttgaacgaaaaaagaattctaatgtagagacagcagcttcgtcttctgctgatctttcagtatgcgtttttatgtgcttttctattagttctttgggctgctctaacattttttactcctttctctgcctaaggcaaacaatcgcatcattcaaccttattataataatctagtcttaaatcattaagttcttttcgtacagcccgccaatccttcatgtacaaatccatacatgaaataaaaactgaattatgtgtacgttcctttaaatggagaagttcatgcaatattacatactctaaacactcgattggtttctgtgcaagctgtaaattaaaccatagttttttcttctctgtattacaagttccccagcgagttaacatatatttggtttgccaagaatcacagtatagctcggtaagcctttcccacttcggaagtaatctttcaatttccgcttttagtaagatacggtactgctctcgcacatagttttctctttgctttactgtactttcttcacgcatagagagtattaccttatctccttttatttcaaatccgttcttttgtgaattaggctgaaaggatagataatattgttttccccatatgaaaagcgtttctccgcttacatactgacgtttagtgcttcttgcctgatgttgaaacttttcaatctgttttttgatccaaataagatttgttcgggcatatatttctattaccttatcatcaatagatgacggagcagagataacgacgtgtccatcaggaggcttgacctgaagatgcatattcttgatattctttttatggatatcaataggtatgccagaaatcataattgtcatatattagtattcctcctgcttttcgatgattttaaataatctttcgacttcagaatcatcattaagaataatgaataaagctttctttattctattttcttttataggatcaccacggaatccactcattttactgctaagaacagcattatgaagtttgattgctaatatttcattaccgtcagtattatcgtatagagcttgcaaagccttactttttcttatgctttcaggatagtcttcattttgttccggatgttcaacatttttagcaagttttatttgttcctcaaggagttccttataagagataacgccttgctttcttttttgaatcagctcatccagtattgttgacatcttttcataatacttagggttgaccgcaactttttctaccattttacgacgaatattattttcaattgcttcagctgctccttcttttttatctgagggggcatcttcttcggtcatgatttctccctgttctgctacgaaatcaagtagtgttagatcatcgaactcaccgattttaacgctatctgaagctgtaatatagttgtcgatcagtttgcgcatatccggctcataagctttaaaatccaagaagtctccacttttatttccgattgtctgtttcagctcaacatagaattttactttttcatcgtatgcagatacttctttggcagtataaatatcaaccatgtatggcttggcttctgcaaatgcacgaactaaaccgcttacaagcttataaagcctctctctaaggcgagaatagatctcatcagtttcttcgctcatgccggattctccgcagaaataatgcatatactgtaaatcaccctttggagcttctacgccttcgcatagttcttccaactgatcgtacacttcattgaaatgcttgattgcttcagcgcttctatctttgataagtccatcgacatcttccggatcatagttttcaaatgcacctgatgtataggtgtccatagcattctttaggtctccgaaaagctgcttataatcaacgatatatccaaattcctttgtgtcaccatccagtctgttaacacggcaaatagcttggaacaaaccgtgatcctgcatactcttgtcaatatacagatatgtacacggcggagcatcaaatcctgtgagcagcttatcaaccacaatgagcagtttcatgtttgcaggctggttgataaacttatctttaacatctttttcaaagtcctcgacttttttctgtattgaaagcttttcaggaagattatcaggatcaagtcctaacatacggagatatatctcgtatttttcaaaagtttcagtttcatcatcggcacttacagtatcagttctcagatcaccggcttgcggagtgtaagaggagataatcgcacacttcttgaaacctctctgctggaagatctcataatacttgcaagcagtatagatcgaatctgaaacgagaattgcatttccatttccgtccattaggcgaggcttcaaatcaaaatcctgaattatatcccaagcgacacgttcaagccttgaacgggaactatagattttctgcatacttgcccatttctctttcagctttgctttagctctgcttgaaagagaacgtgttttaacgtcaaaccattggtcaactctgtcatgagcgctaagctcctgggggatatctctgtattcatatctcagatcaagcacaacaccgtcacgcacagcttcgttatacttataggtatgaatataagtgccaaacacttctatgcttgtcttcttatcttttttcagaagcggtgttcctgtaaaaccgatgaatatcgcatcaggcatgattgcctgcattgctgcgtggagcttgcctgactgcgttctgtgacattcatcaacaaagacaaagatttttcctttcgccttaaagtcagcagggagcgacttcttcaactcatcaatatacttgtcataatcggattcagtagcttctccgccacgacgaccaaatttatgcaccaatgaacataagagtgaactgtcataggaattcaacttacggagcagatcatcacagctcttggttctggtgatcttttcatcaacaccaatgtatgtcttttcaatctgctcatccagttcatcacggtcggtgacgataagcacacgagagttttcttctttacaattggcaaggatccattttgacagccataccattgtcaacgttttaccgctgccttgagtatgccatagaataccgccacgctgttttgctaatctgttctgagtacgttttatgccgaaaaactgattatagcggcataccttcttaatgcccttatcgaaaactacaaaattctcaatgaggtctataaagcgtttcttatcgaacatctgatacagctgctgaagcaggaggttatcaatatgatcgcagtattccataatacgtgcatcttcaggatcacgctcgtcttcgttttcatggaatccgtcaggcttccattccatatagtatttttcgcctgtcagaatagtgccgtaacgcagaccttctatttcattgcctgccatacaaaactgcactgtggtaaagaacgatgcaataaagccgtccttctgattggtaaggttctgcctgataccgtttgaaacggacacgctgctctttttcagctctataactgccatggcgatgccgttgacataaataacaagatctggtcttttctcctgacggtcaataaccgttacttcctcggctattgcaaaatcattatttgtagggttatcaacatcaatgaagtaaaccgtcttaggggagctttcgggagtttccttgaccttggcaccgtatttcagcagcgtatagaccttatggttagcatcataaagcccatgtgtcatatcatcagcagctttcacaagttcggcaacagcaccgtctatcagcctttcactgtaaccgctaaggcgcaggtacgcacgaagtcggtcttcacggatatttttatttgctgtgtctttcaggttgccaatatatttataatcgaggatatttctgttcttaaagaaatcaattacacgattttgcgtggttctctcggtatcaccgatactcatacgtacattcctccttaatgtgtttgttatttcatggaaaaaactttctgatcaatcctgcttttatgcttttatatttatcacacttacgctggtgaagggtgataagggtgtcaagttgagagaaaaaggttccgattttttgctgttcatctttttgagtaggtaataaaataggtgtctttttcccgctttcgatagtataagttccgactgttcctattccagcagattcttttataaagttctgaatgaaactaccgttaaaagaatgatagaaaaattcgccatctattctatcttcatttttgaaccaaataatatttccatccttgaagtatagcggttcttcgttgtttatcaacattggaacgcctattgttccaacacccgttacaagcaaatcaccaattttcactttgcccgataaagcactgtactcatcatatttctcttgtgatataaataacggttcagaaacttcttcgttttttgatactgctacaatatctcttgctcttaaaaatcttacacctgaatctgtccaatcggactgatgaattcgttttacagatgttatttccatcagctcacccaacttacgttgttcccaagcgtcagtaaatcctttgaatcttagttcaggcttatcagcaccattttggggaaacatttttttcagcatagccgctttgaattgaatcaacttgtcacacttacgctgatgaagggtgatgaggttgtcgaggttctgaaaatatgctgaaatttctgcttgttcatcaagcgattttggatacgaaatactcgttccttgtaatgcagattttgaaattgaggttacttttgttccctgcattaaaggtatcaatgtatcgtgataggaatttgaatttaagtaatatccaaggtatccagaagcatattcttcctttggtcttactggaattgtatgcaaacccgaaagaactgttttatcgcctaaattggctatttcactgcattttcctactgtcgcatcttctgctgtgtcagcaataataacatcaccattttgaagataggagttcttcatagctgttacaattttatcagaatttatatatgctaacggctcatttccaacatcaagaacctcgccatattttataagcacatcgccatagtgaatgttctgtgcaagtccgctttcatcacacaaatcggctcttgaaagtgtgttattttgaagtatttcaaatactgaactaaacccacgctgttcccaagtgtcagtaaatcctttgaatcttatcgccggagttttgttattattcgacatcgtttgaacctccgagcaattctattaactctgcaaaagctttcatatcataatcattgcctgttaattcaccaagcatatctgacagtgatgattctgcttcgtttatctgaccgtcaaggtctgtaagtgtaagcttatatctttttgaaagctcagtgatacgctcggcaagcttatgagaaattgctgtgtacagatcaattattcccttgcctatggcataataccacttcttgtctacaagcagttccttgatctcatcatcggtaagtgacgcatatctctcacgagccttttcatcaagtgccttatccatttcttttataagctttgtagactcctcagacctttgtgcaagctcaaacgctttctttaactcttcatagtcatcggcgtatgcagcaggtgcaggcgcttctgcacgggctgcacttaaagcattatttatggatgttttggttactgttcctttatcggtatacgcaacttccagttcagcgtgcttgtcgatatactgtgtatattccttctttttcattgacggaagaagattcaaaagcgttacaaggctgtcaataagcggagtatggacattttccatgatcttgtcgattttctcctgaatgtccttgctcttgacttttccaccctctgcaagttccgataatgccgagtcttctgccgatttctcgatcattgccatgagtcttgaatcggtctctgcgacaatatccataaggtcatctatcgcctttttctcctcggggaatagctctgagataactattttcttcggaataagcttaccttcccagcctgcaacctttagctcagggttgccgtcagcatcggttttctttgtctccttcatgatgttctcggtctctcttgcaatttcatagcccttatcatccgagattatcaaagaaacatcgtcattaagcacttcgttccagtatgcaagaagtatctggtaaatatcatacttgttgataagcaagatatcttcaaatgctttcattatattctctgccaactcggatatgagaattttggcagaaacggagctatcaagttttttcaactttgtatctgcaaaagatttccagtctgtgaatgccttgtcgataagatccccatatgccgagaattcaccattagcatatatcattctgcgaatgtcgttttcttccacattcagcttataatagccatcactaagcgaactgagcaactcatctttcagcgtcgggaatgcatcccagtatttactcagtgaatctatatccacagcagggataccgccgtgaatatgagcataaatatcctgaatatcctcaggctcggaagaatctatataacgggaaatattcaggttatagccattcttctctttgatctccttattgggaacaaagcgagcatatttaggatcatctgtaatctgctcattgaatgtagtgactatgcgatagatatcctgttcacgcagtctgttcttgtttccgtccttaacaaatccctttcctgcatctatcataaagattccggaacggttttcagcaccctctttatcgattataataatacaagcaggtattcccgtaccgtaaaacaggttaggcggcagactgataatgcctttgatccagcccttatcaacgatagcctgacgaatagtaccttcagcatttccacggaacagaacaccatgagggagaatgacagcagctttacccgtagatttcagcgtttttaatatgtgcatcaaccaggcatagtcgccgtttttctcaggtggtctatctccataaccggagaaccttccatactccttcaaaccatctgaccagtttttaagagaaaaagggggattcgcaacaatatagtcgaagcgttccagttcggaagaatcttcatttttgataaactgaggatcagaaaaagtattacctgccatgatcttgatagtagctttattatgaagaacggcattcattttagcaagacctgccgtcgaactctctttttcctgtccataacctgatatctcaaaaggaacctctgcaagtgctctgataagtaatgaaccactaccacaagcaggatcacatactgtggcatcatgatccgtacatttatctatgcctataacctttgcaagaatgcgtgatacttctgccggggtatagaactgccccttacttttaccgctttcggtggcaaagtttctcataaggtattcataagcatcgccaatgatatcgtcaccgtcagctttattatttgagaaatccaattcaggacgctgaaaaatggctataagctttgtgagcttatcgaccatttcctgtcctttaccgatttttgcttcatcattgaaatgtgcgatgtcaattacaccttttagactgtcatttacttcagcaaggcgagcgatgattttatctataccttcgccaatattcttcttgttcttgagtgcaataaagtcatcaaaagaacagcctattcttttttcgggatcaggattgggatcatgttctttatcgaaaacggtcaaatctccgtatttatgtcccttatacttatccgttacatacttcataaacaaaagggttagtatgtaatccttatactgtgatgcatccattcctccgcgcagtgcatcacaacttgcccatagtgaactatataattccgttttcttaaccgccataatacgaatctccttacaattaagttgctatatttcctactcaatagcacttttgccgctttttacccatgcatcaagctccgagcgtttgaatttccactgcttaccgattttgtgggcagggatatctttattattgcgaatccaacttcggatagtaacaggcttgattcctaagtgttcagctgcctcttcaaggcttatccatttttcattaacagcgctatttcccattttatcacctcttgtagtagatgaaatatataacaatccattatgattatactatatcggtttgaaaattacaagaggtttagtgttatttcgtgatatttatactaagtttatgtatatgcattgtgcatttttcttgtcgtatagaacgaggctctcagaatcactctgaaagcctcgtttcgtatttatagatatcagaacggatgctgtatctgacagccgcagtgagccattttcgttcgcctgagagcataccacctgcactatcagaaaatttgctccgaattaacgtccaccttaacagcaaacttattctgaaagtgcagttcctccacgatgagaacagcggtgttatcgggagtgttcctgagtgaaccaacaaaggtaatcgtaccgcctttggaatagagaaaactcacagcacttgcattatcatcaaaagcgaggcaggtgaaagtatcgctctcgacatcctcaacgcctttctgcttaggctgctcaacggcgatactgaatttacagtatttagggtcatctttggtagtaacagcaggctcgcttagaagcctgcatgacatcatgatcttattcaacatagtctgctcctttcaatcttcgtccgaacactcgttaagcccgtgtataagctgaatgtatacgcactctgctcggtcgtgctcctcgccgtccgtggacatcattatttcaaggaaatatgccttagcctgttcatagtccgtccagacttcacgcttgccattgcatacggtagtgaccttgtttgttctcggcattgccaattctggtgttttcaacatagctgtgtacctccataatttttatcgtgaatccattatatccgataaaactaccggagtccagcatattagaatgattgtaataattcttgtgaaaggcgcagcaaaagtatgtttttccccagtgcattgcgctgtgatgctaattgactttttcgagtatgtgtgctatgatatttgaaaagaattctagtaaatgctaaatcagcagacatttatgtattgattagaaagaattatcggaggtttttatatgagcaacaccgttgatgtatattttttatttaaaatcatgccaattgagtatattgataattttgctaaaggaaatttctatttttcgtgttgtggaaactgggtagatattgctaaaaaaggatttggaaaaggacaaggagataaatatgaaggtgtatttgccaaatataaaaggaagaacagtagaaagccagtgaagtattataagacactttttaaaaaagatttaaaaatcgaacaagaaggagattatgtattattaagaagaatatcttccttatatattccagcaatttgtttttatagtttggataataatacatcaatagagtttttccctgaaaaagaaaaggctcgaatcgaggaaatcataaacaattgtggagatgcagaagaaataactgttgataaattcccgcttggaatatctgataaatatttgtcggagttttctatcgactcagacaaaatagatgctgtaacgatacagcctcgaaaagtattgaacgaatttaaaaataaaggattattctatcaaaaagttacttatattgatatggataccgaattcgacatatttaaagataagctatatgaaaaatacggttttaactttaatgatgctattgataaacatattgagatatttttcaaggataaagcaaattattcacatcaatgtgaattaagagcgattattcttgatgaacgattaaaaagtataaaacgaggaaaaacaatacatctcgataatctttcaagtatcagcgtaagtggaaaagacggagcaccagtcaatgcaaccggtaaagatttcatatgctataccaaaaacgcaagagatttatttggcaaagtagttctgaaaaagctgaattaaaccatcctaatattgaaaagatattatttggatattgttctttttagctttgtttataaagattctttctcctcccactcctcgatgtttctgctgatgtttttattataaacccgtgcggaagtcacgtcaatccacgctccgtagagtggattattcgatgcattttttctgcttagattcgggggattgggggcatccctcagcaagcattgtatgtcgtttctcacgaaacttgtgggaacgatataccgtgcttgctgaggttgaattttgtcccttgggggcatctctgtttccgagccatcaggctcggtatttttgctcacttgtggttcaagggatagcatcagttcttgtaaaaatctcggtcggggtcataggagcagagctcctgtcaagctatgtatcggagcattcaaatctgaaaatttgtaatgcggagataccgagcttgctgggattgattatgcccccttggtacttctctgtatccgagtcatcaggctcggtgtttttgctcacttgtggtcaataattttgtatcagatcttcatctattatcgttcggggcataggggtagaacccctgtcaagctatgtatccagcattcaaatttgaaatttgtaatgcagggatgccgtgcttgctggatttgacttcaatcgaaattgatagccgtatagaaattagcgcttggatgacatttaataaataatgtgtagtttagatattgcaaataataagacaaaatgctataatatgtacataggtatatggttttatttggaggtataacggaaatgatagatacactcacggcgtataaatgctcatttagatttttgcagcgtaataatccattaataggcgaacagagaaatgccataaaagatgataaaaaaccagattattccttcttggaatttttgaatgactacacagagtatactaaggatattgctgtgggcgaaagttctcatagagcaatttctttatctcaagataatatagattattcagagcaaaacgatatttgtaaatggcatataattatgagtgctggaaaacaaggacagcctgttacagttgttaaaatacatacaaagaaaagatataattatggatcggatacggcggctttatataaccatcatgtgtttttttatcaaaaatctgattcaattattgctatcttccatagacagaatggatcgggatgtaagagcgttttccttgaaaccgcaaataaagcaatcaaatctcgaggtattaaacttgagatggaattaattatgcctatgagcaattcagttatcgatgccactccaacaaagattactcttcagtataaaaaagatgtaatctcatcagatgttgctgataatataggtaaacataagaaaagctatctggtgcgtgaattaggattgaatttaagtgttaatgaaaataatagtatcatgcggatttttagagattttcaattacgcagaattccttcaaatgaagcttttgcattaataaaggcagaaattaatgattcaaaagaatacaatgacgctgaagttaatgttaaaataggaaataggcgaaggaaaattaaatggaatgaatttgaatctatgatgggcacttatgatatttcagaaaaactatataatgcatatagtaaatcgaaagattttgttcgtgaattatacatatcagttgatgaatattataatatgattacagattcagaggtgatttaatatgcttgaaaaaatagcaagtatatctgttattgttattttaatatgtatgctattcttaaatcccaaagtcaatataataaaaatcctcataaaacagctttcggtttttaaaaatgctaaaaatgaaaagatatcagtatgggatttagtctgctttatagttgccccaatagtattagctatactacttgtttttatattgggatatgatatatccaatagtgtcgccagtgttttgactaccgtgtatgcctttgtttttacagtgctattcgggtttgcagctgttcttgtaggaaagattgatagtaaaaatgagcttgaaaagcaagtaactgaggagacttttgtttcagtgctaacttcaaatattctatcattgattaatgcaatagcatctataatcttactaaatattaatgaagactcagaatgcgttcgcaatttaatatctgctattatttacagcatttcatttatcacaattatgcttttattgatgataactaaaagaacatttatcatatactgtgataagaaaaagaaataaaaccatatctgaagcagtctttttaggctgcttctttgcattttcagtataaattgcaccggggaaaaccgaaaatcattccaaagttcgtgcgcaatgcggctggacaatcgccctcattgcgcgctataatatttatagtcgcaaaatactcggtcggtcgaaaggaagaagtaccgaccttgtggctgcatagagggtaagagagataaagcgatgccctcaccaatgcttagagatataaatgcaaaggaaagatcgctatgaaaaaagataacaacgtgtcagagtacaagattgggcgaacaacttacatcgtgaagttagtattcaaccctgcttcaaaggaacgacttgcggatattttgcaaaggctgatagaccgtgagtgcgaagaaatgctcggtgaatccggacaagaacctgagaagcaggctgtgtaatattagcatttcggcgcattgccattgacggtatattgcgctataatgataacatagctcgctttatctgtcgggaaggaagattaatatgacagacaagataacagcgttgtattgtcgtctttcgcaggacgatatgttacagggtgagagcaacagcatcaccaatcaaaaagctatcctcaaaaagtatgcggaggataacggtttcagcaatcccgtttactacgttgatgacggagtttcgggaacaacgtttgagcgagacggcttcaaggcgatgatggcagatgttgaagcaggcaaagcgggaacgatcattaccaaagatttgagcagactcggcagagactacttgaaaaccggtgagtacattgagatcatattccctgactatgatgtccgctatatcgctatcaatgataacgtggatactctcaagagcgagaatgagctgatggatttcaagaacatttttaatgactggtatgccagggatacgtcgaagaagattcgtgctgtattcaaggcaaagggtcagtcgggcaaaccgctttctctgcctatttacgggtacaaggcatctgaggaagataagcacaagtggatctttgatgatgagcctgcagcggttgtccgcaaaatatacaagctctgcatcagcggctacggtccgactcagatagctcgtaagctgactgaggaaggtatccaaaatccgacggcttacgctatatcgcagggaagaaacccagccaacaagaattcaaggcttgaccgctggtgtactgaaactgtcattgacattttagagcaccccgaatacatcggtcatacggtgaacttccgtacacgccgcaagtcctacaagaacaagcgtaagattgaaaatccgaaagaagactggctcatctttgagaatacccacgagcctatcgtcacacagcaggagtttgatcttgttcaggagatgcgtaagaataagcgcagaaatcagaagcaggaaactgtaaaaccgttttcgggcatctgtttctgtgctgactgcggaaagaagctatacctgtgccgttcaagaagccttagcgaagatcaggagcatctgaaatgctctactcattcagctgataaggatagatgttcagcacattatatcaggactgttgtgctgaaagagttggttctgaatgcactgaacaagctccttgataatgtcaaagacaatgaagctgagtttgtgcagacagccatagacaactctgcgtcaaagcattcctctgatgtttttaaggcaaagaaagctctcaatcaggctgaaaaacgtatcgctgaacttgacagactttttgcaagactctatgaggacaatatttcgggtaagatctctgactaacgttttgctgtactgtccgcaggatatgaggacgagcagaagaaattgaaagcgtaagcatcagagcttactgcttttattgaaacagcagagcagaaatgtgctgatgtgaactcctttataaaggtagtgcagaagtatgagaatatcacggaacttactcccgagatcatgcatgaacttatcgagaagatagttgtttacgctcctgaaaagagcgatgggcatcgtactcagcagatagagatacactttcgatttgatgtggctgtcgctacggcaatagctgacagcagagaatacgacaaaaagaaaaaggctgcgtaactgcgatgttacgcaaccttatcttcaaatcacataaactgctttatgcgccccgaccgaagtcagggcttttttcatcagactgcttaaaccgtcacagcctgagtattattctttttaagcacctcaataaaatctttttcaggaacaggctttgagaagtagtatccctgaatgaaatcacagcccatgccaagaagcgtgtcgagttggtgcttgtcctcgataccctcggcgactatctgcatattgagcttctttatcatcgccactgtactttcaatggcgatatgcgccttttcgctcttgaaacattcccagactatttccttttcaagcttgataaacctgaaaggcaggctgagaagatatgtcatatttgaatatcccgtaccataatcgtcaagtgcaaacttcacaccatagtcggaaagggtcttgatgtttttctccataatgtgcggagtatacaccgccgcagtttccgttacttcaagacaaatagacgatgggtctaccttgtatctgtccataatgctgagaagctgctctacaaggtcagattgcatacactggactaccgacaggtttacctgcacatattcgataccaagtgaagttcccacgcctttctttataaagcggcaggcttcctcgaaaacatatttgcctattttgagtatcttgccgttttcctcagctataggaataaattcctgtggagggataaatccaagcttttcatccttaagcctaacaagggcttcacaggaaactatcttgtttcttgaacttgaatatatcggctgatagtatacctcaaagccacgattatccagagccttgtctatagcattctctacctcgcttcgacgtttgctgtcataaaagtttatgtcagttgcatgaagaagtctttccgtttcaggttcacgatgcttgaactgctcgataaagtccaccagcatatctgcattgtcaacgtcctcagggcagtcaatacgcataaagcaggctgttatcaaagtatccacagtacctatattccagttttcagacagctttttccttatcgcacgatacgtttcccccaccttttcagaattcttcggaaacataagagcaaagcattcgtcctccaaataaaatccatcgcccagattaacaaagttataaagatagtcggaaaagcttcttaacagagagttggaaaaacgtccgccaaaggttttcataaacattttgaaatccggtatccttatgagcaataatgtaaaatcagaagctgaggcatattttatagaacacctattgacaaagctgctccagttgagcattttcgttccttggtctatcatatcgtcctgactttgcaaagtgaacattattagaagcatacatacagacgccgcaaagcattccacaagaaggagtttattgatcatctgaacaattaccgccactaccgtcattgagataaaggctgttatagaagtgaccacctgtcttgatagcatacttctattacccattgcgtaaacgatgccaaatataagataataaatcgccacaatgtatgtaaatggctgaagagtgccacgatgataaccaccttgactatccacatatatgataaaatgtgttgcaggcgtcgtaatcacaagcaaaagatcaacgatcatcggtgtatataaaaagcttttgaaaagagcagacatctctttatagccgtccgtcaggaaaagtatatatatcacaaatagaaacggaataagattatgtgtaaaataataagccgtatggaagaagattttaagccctatgccccattcgccggtagaaaacacacttaaaatatccaacacagttgacaaagccgagtcgcccacgagaatgccaaagaccttattcttgttgcacggaatacgctttttgaaatagaatacaactcctgtgatagcatatatcacaagggcacatatatcataatggataatataacccacaacgcagacctccccgtattgttatggtaatattttaacataactctgttatggcttcaaccgatttaacaaaaagttataatatttttggttgtgtgcataacttacatataaataaaagcccgaatttatggtttttgtcaattattatctattcgttgtaatgttcattcttgcggtttactgataagatatcataaacattttaacattatcctaaagcttcacccaaaaatgaaaagttagaaaaacgatgataatttaacttacggcaaaagattatacatagttttaaataatttttaaatttgtcggtttggcttgactaataaacatcttggagttataataaaaacgtggtaaagatctgtcataagacttgtaaaaagctagtcttttgacagagtttctgtatatacagaaataattagttcttactgatctttagagacgaaaacaggaggtaataattatgttaaaatgttttaaagacgagaaattctggtgtgcagtaggcggagcagccgcagtcattcttggcaagaaagtcgtaaaggctaagaaaacaagagagcttgccgttacaggtcttgcaaagggaatgaagctcaagagcgacgctcagtcagcactgagaagcatgaaggacgaagcatctgacatctgctatgacgctaaggtcgaggcagggatagatgacgaggaagaagtaactgaataatgaaagctcagatcgtttatgacaagccctgccgcatacgttttcgctgtggtagcaacgctttcacaaaagaacttgaacggtcgatacataagcttgttatgtcaaacccgtgggcgatcgcctgcgaggctcactatgagaacggcggaatacttatacgctataaagagggtcacagagccgaagctgtcgaacttgtaagaaagctcagaggaagcgacctggcacctgtcagcgacaatcagtatgacaccgaggagatagacagaacattcaaatctgaccttgcaaagcttgtgatgcaaagatatataagaaaagctattctgcctgcacctataggcgcagcacttatcgtgtacagcggacttaaatacatagcaaagggcgtaagcgcactgtttgacggcaagcttacagttgaggtgcttgacggagcgtcaataagcgcttgtcttatccagaaaaattacaatacggctggcactgtcatgttcctgctttcggtatcaggcttgctggaggattacacaagagcgagaacaagagccgctcttaccgacagcttggcgataaaggcagatcaggtatggctggcaggcaaggacgctgatactcttataccaatgtcacagcttcaggtggacgattgcattagagttcgcacaggaagcgttattcctgttgacggtcagataaccgagggcgaagcttacataaatgaagcttccatgacaggcgagcctcttgcggtcatgaagagcgcaggagcaagcgtatttgcgggaacagttgtcgaggaaggctcagttgtgataaaagttcgcaagctttcttccgacacaaagataagcaagataatcgagcttatcgacaattcagaaaaccttaaagcaggggtgcagagcaaagcggagcgtcttgcggactctatcgtgccgtacagctttcttgcctttggtcttacactgctgtttactagaaatgtcacaaaagcagtttccgttcttatggtggactattcctgtgctatcaagctttcaacgcctatagctgttatatccgctattaaagaagccgctgatgatgacgttacggtaaagggtggaaaatatcttgaagaatacgcacttgccgattctatcgtttttgacaagaccggcactcttacaaacgctgagcctgtgcttgaaaaggtaatagcccttggggattactccgaggcggaaacgctgaaaattgcggcttgccttgaagagcacttccctcacagtgtagctagagctatagtaaagggtgcggccgatagagatatcgaccatgccgaggaacacgccgaggtgcagtatatagttgcccacggaatttcaacaacgcttcacggcaaacgtgctatcataggaagcagacattttgtctgcgaggacgagggcatagagataacagacgaacagcaggctgagatcgacgaaaagtcgggagcttgctcggtagtttatcttgctgtaggcgacaagctcacaggtgcgctctgcataagcgacccgcctagacctgaagctgaggaagccgttaaacagctcaaagaagcaggcatcacaaatatcattatgctcacaggcgacagcgcaaaggctgccgagataactgcgcagaagcttggcatatcagatttcagggcgcaggttcttcctgaggacaagcacagatatgttcaacagctcaaagagcatggacacagagtaataatggtcggcgacggaataaacgacgctccagcccttgctgcggcgaatgtttctgttgcaatgagcgatgcttccgatatcgcaaaggaaactgccgatataacagttcgtggtgcagaccttacacagcttgcggctataagacagcttagcgaaaagctaatgcaccgaataaacagtaactacagatttatactgctgttcaattcagtgcttctgctgtcaggagctttcgggcttttacagccgtcagcctcagcgcttctgcacaacgcttcaacaatggcgatctgtgcaaagagcatgacccctttagaggataaaaagcgcaaaaagaaaaacaagtaaacaaaatataaagagcgaatgatcgtaacgtcattcgctcttttttgcatcttaataaatgtaacgcttttttcttaaattacttagcaggtgtacagtagcaaatagaataaactgtgatatcaccgttttttgccgcagcatgaagctgatccagcttatcaaaacctgcaccaagctcctttacacagtctgcatatgtgaatttagcatagtaacgatcattcgctctgcctgtttcgctaggctgaactcttgcccagtttgctcctcctgaccagctctggagaataagctcaaactcgttctctgcacctgaatactcaacatagaaatagccatttgcagaaagatacgaaacatcaaaactgccataattttttgaagtcataactgaaactgcctgaccccatgagccacatgattttgcaccccagaaaatagatacatatggatcctgctccggcttatcagggtcaacaggatctaccggatcaaccggctttgttgactttccgacaatatacttaacactaagaacttcgatatctccgttagccgcaccaacatggaagcggtctactttagagaaatctgttgttccgaatgccgcagcaacatcgtcgtagctgtactttgcgtatacaatgccgtccttttctgttacctcagttggtgaaactctcgcccagtctgcaccgcctgaccaactctggagaatgatctccgccttgtctgtgccgcccttgaactgaacttcaaaatatccgtccttttcgataactgagctgtcaaagctgccgccctccttagttgtggaaagtgtaatagcctgaccccagcctgatgtctttgccgagcctgtgaagataacagtttcctttttgtcacttacctctccagttgcagggataacctctgtctttatcaccttgccgcaagttgtacactcagtgtgctttgagccattttctgtcgcagtagccgccttgtcgattatccatgcgctttcgctgtgacctgtcgcagggatagtttcagtgtacttttcaccgcatgagcaagtgtataccttttcgccgtcagtttcgcaagttgcagcctttgttgatgtgagggtatagctgtgcctgtgaccgatagggtcggtgtaatcgtccttctttgtctcgccgcaggaagcgcatgtgtagatagtgtagcccttttcgttctctgtaggagcaactgtctcgccctttacccagctgtgacccttggcagggatagtttcagtgtacttgtctccgcaagtacaagtgtaaattctctcgccctctgttgtgcaagtagcttcctttgttacctttgcggtgtagctgtgagtgtgtgatgacttaacattcttgacagtgagtgcaaatgtatctgtgtttccgtctgagaatgtgtatgtaagtgtgtaattaccatttgcaagcgtcttgagccagctttcgttgagcattatctgacttccgcttgtagaataatctaagccgcctgtaagcttcttgccgtttactatgatagactcaacgctctttccataaagcacaaggtctgttctcacaccgcttggagcatcagcgtcaaatatgcctgactttgtggaaaggtgtggcttctcgatctgtccgtcctcatagaaaacaacatcgtctatgtaaactgtacctgtcttttgagcagaatctccgcccatatagaacgagaactggttaagttttgatgtatcaagatttccgcccgactgccagcttggcgctttaaagtcagcgaatggtatcttgatattttttccacctgcgaaatcaagtgctatctgcgcttcaaaataattgtcgtttgcgtctctaagctgaacagtaaggctgttgcctgtgccgtccccctctacccaaagctcaacgcctgcaaatgatgaagcatttcttactgcaatagggtggtttactccgcagtagccgtttggcgagccgatatcatatccgaaagcaagcgcctttgaaccgttctttgtagcaagagaaagtgaaacttcattgccgcctgtgtttcttgaataagacgaccaaagtgccttatcatttgaatagctctcaaatgtgtcaagctcatcaaggcctgtggtgtcggaaacatttattgtaagctctctatcctcgccctcatagaaatcgaacttaagcgtcacaatgcctgctgaaagcgttttgagatatgcacttttaagggtcacagtgtcgcccgaagttgtgtaatctgtaccctctgcgagtgcttttccatcagcaacaatgcctctgaactcgcttgtcttgcgatccatagtgatatcaacatcactgcacttcttagggtttacgtcaacagagattatctcaggtgagataatcggcttagggatagagctgtcgctcaccgtcagattgaacttaggctgattgccgcctgttgtgagtatcctgcacgaatactttgcaagctcctgccttttaagataagaagccttgatagtaacagcgttgccacttatggtgtaatcgtctgacgagagtttctttccgccgacctcaacaccgcttatgctgccctctttcatagaaacattcaccacaacgttacctgacttgcttctgtcaaaactgtatgtagacttgtcagtggtgtttacaatgttcttcttttccatttttgcagcagcgttcatcataagagttcttgtgctgtccgtcttttcgataccctcagggccgtaaacggtgtagccgtcatagtcctgataaagagtgccgtcatcaagataggaagctatcatccagtagttgaagccctgatattcgacaccctcatagtagtcccctgttacaatatccagccaatcggaataagcggcatcacgctttgttttgtctgtaagaccgaattcctcaaagataataggcttgtcagcggaagatgtggtctgggcatggcgctttatccactcgaggtcatcatcaccaaggtcaaagccccactgatcaacgtacatatgcggtgtgccaaagtctacagtgtcgatagtcataagcttgtcaaagtcaacaccgtagtagcctgaatatgcggaagacggaagatcttgccttgcagcttcctgatagccaaggttataaaagccctcgtcgccaacagataccatgtgataagggtcgatagactttacatatgctgacatttcctttgcccagttataaagaatatcgtccttgcagaactcgtcaacagtacatctcggctcgtttgaaagctcccaagaaaaaacagcttcagaatccataagcttctcgcctgtgtagtagttggtgtgatttaacaaagtcttgatataatccttataccaacccttgatagtttcattagtgtaaaaatcacaggtgtccttttcgtccactttgctattgccaacgctcttgccatgtgacatctgataccactttacatactgacccattccaccgaacgcttcccaatagttcgtgaaagtgataacaagtttcatatcatgttcttcagcctgcttgataatataatcaagatgtctcaggccgtcctcgccctcgttcacaacaggtttgccagcctcatcgtcccaatactggaagtaaactccgtccttttcgcccgttccgtcattgttgccctcaaaggtctcatgaccagactgcgagtcgatctcgcctgttttcttaccaacgtcaagatttccccaaattcttattactttaagccccatttttgaagcgtcatcgaaaacattctttacctcactctttgacttataggtgagataatagcagttcgtgccgccgtaatagtaagggcttccgtcacacataaactttgagccgtcaacataaacaaatccctctgggtgtgtcgccgcatactccgcatatgcgctgatatctgcgaaaggcacaatgctaacagccattgcagcagccgccagagccgcagaaaatcttctcattactcctgtcataaccatactcctttttcattactttaactaatttctgattaatttagcttgccgaattattgcatttttactttatcacaaacttaatttaatgtcaatctcttaaaacgattaagcaaacaaatttttaaaaatcaatgtttttgacaaataaagaagtacaaacttagtgaattgtgctataagtaatcatcattttatattatttttgtctttcattaccaaaggaaacaatggttaaaaaacgtttacatttcatattaacatcaaacgtttaagataaacaaattaacaaatgcaatttacacacaaaacaaagccggacatatcatttcaagatgatatgcccggctatacaaaaaagatattcaatacacttaccatgcataaagatgatccctatgtaaacataaaaaaacacctatccaagtgccacatcaagtatcatcataagcacaaaacccagcgcaaaaactatcgttccaatattggagtgtggcttttccgacatttcaggtataagctcctccaccacgacataaatcatagcacctgccgcaaagcttagaagatacggcaaaacagggattataaactgtgccaaaagtatcgtcagcacagccccaacaggctcgacaactcccgataaaacgccgtaaacaaaggcttttccctttcccataccctccgaacgcagtggcaaagatattatcgcaccctcaggaaagttctgtattgcgataccgagggataatgccaacgcaccagcggcgcttatagcatgatggtcagccacccagcctgcatatacaacgccaacagccattccttcggggatattgtgaagcgtcaccgcaagcacaagcatggtagttcgcttgaaaccgcttttcgctccctcaggctcggtggcattcatgtgaagatgcggtatagctctatcgagaaaaagcagaaaaaacactccaagcataaatccaaccgccgcaggaacaaacctcagtctacccattttcgctgattgctccatagagggtattagcaagctccacacgcctgccgccaccattactcctgccgcaaagcctgtcaaggctcgctggacaagataatgcagatttttcttcatgaaaagcacacacgccgcaccaagagatgtacccaaaaatggtatcagaatgcctttaaaaatagtcatgctcattgttcttcactgatatgcttcttcaatgccgcaaagctctcgtcagacaaaacgtgttctatcttgcaggcgtcatgttcagatatttttctgtcaacaccaagacttacaagccactctgtcaatacaaggtgcttttcgtagatcttttccgcaacatatctgccggcgtcagttagagtgataaaaccgttttcgtccattgtgatgaactttccctcacgaagtatcttcatagcgtttgatacgctgggttttgtaacattcagttcccttgcaacatcaatgctcctcacctcgccgttttgcttgttccataaaacgagtatcgtctccagatagtcctccccagatgtgtgaatgtttcccatttgtatgcccctttctttgttagctatagctaacttgcatctataaaattactgcacgccacgaaagctaagactatcgaaacaaaatgccttttcacaaaaagctttttgcaaacttagccgcacccttctcgtgcagtatcaaaagtatagaacatcggttaatgtatactaactgatatttattatatcacagaaaatatgttttgtcaagcaaacaaaaaaaccgtgacagaccttttcatctgccacgactttgtgcatagctatttacttgaatcttgcaaaaaatccttttttctcataaggctctctttcagcggaaataaaagtgtagcctgttttctcaactgcttctttaagcttttcatcagggatatcctcatcaactatagccacagtttcgccctttgcatgggaagagctaacctttttcaccttgaaattctgtctgaaagtgtcattcatatgcgattcacacattccgcacatcattccgtctatttttactgttatcttttccatttctgaccctccaatgcttgataggttagaatttgctaaccatgtctattgtaacacagcctatagctttttttcaagtcaataatgtaaattttaatctgccgtttgtctgttgttctccgcaagaagataattcttcacttcccaaagcttctgagaaaggtcaacataataagtgtgcggattttcaaatcttgtgatctcgtcccatagtgtgtctatctcagatgccgcatactttacgatatcctcatatgcaggcttcttgtatacacacttgccgtccttgaatatctgctgttgaataggctttgcctcaaagtttgtgacgacctttttcttccatgtaaactgtgggtcaaaaagcgtaaggggtctgctttcatctatcacctcgtcatgaacacacagcaggtcagccacagccttgtggttattcttatcataaattctgtaaagctttttgaagtgcggagttgttattttcgccacgttttcagaaatctttatcttaggctgaatatttccattatcgtcctccacagccgcaagcttgtaaactcctccgaaaacaggctcgctctttgcagtgataagtctttcgcccactccgaacatatccacctttgcgccctgatatatcatatctcttataagatactcgtcaagggcgtttgaggcacatattttgcagtcaggatagccggcatcatcgagcatttttcttgctttcttggaaagataagttatatctcccgagtctatccttattcccacaggtcggcagcccataggcttcagcacctcgtcaaaagcctttattgcattaggcacaccgcttttcagcacattataagtatccacaagcagaacagtgccattaggatagcacttacagtaagtcttgaaagcttcaagctcgctgtcaaacatctgcacccatgaatgtgccattgtgcctgttgcattgaagccgaaaagctggtcagtgatagtgcaggctgtgcctgagcaaccgcctatgcctgcggctcttgcaccgagtatggcagcgtctgcaccatgagcacgtcttgaaccaaactcagataccgccctgccctgagccgcccttacaatacggttagcctttgttgcaataagtgtctgatgatttatgcaaagcagaagataagtttccacaagctgcgcctgaacagcaggggctcttactgtgatgataggctcgtttgggaacacaacagtaccctccggcacagcaaatatatctcctgtgaagcggaaatccttaagatattcaaggaagccttcgtcaaaaataccctttgagcgcaggaactctatgtcctcttggtcaaaatgcagattttcgatatagtttatgacctgctcaagaccgcaggcaatggcaaatccgccaccgtcaggtatctgtctgaaaaacagatcaaaataagatatcttttcctgcataccgcttacaaaatagccgtttcccattgtcagctcataaaaatcgcacagcatagtgtaattgaatttgtccattttgctctctccttttcagcttataacaagagggactaatgtccctccttgctgttttacaatattatatcacgccacaggtgcaaaaacctgaactaaagcgcaaacttttctgaatattcagccaacagcttctcgtaatagtcaggaccgtttctgtgaagcttatcaagatattcatgctttttaaggctgttgtatttctcttggtttgcgataagatagaccgcaatatttgagcagtggtctgatattctctcaacatttgtgagtatatcaaggaagttcactcccacctcgatgttgcaaagaccattcttagacctgtcgatatgaacagccttaagctcctcaacaagtctgtctactacttcttcaagtggctcgatctccttgagaacgttcatatcccctgtctttgtggcttcgatagcaagcccgattatctcctgaatggcgttgcacacaacgtcaagctcatgcttcgcctgctcagaaaaaccgatctccttttcataaagaacatccgcagtttcatagatgtttatagtatagtcacctattctctcatactccgagataaggtggaaaagcgcagtaacagttctcgactcatcctcgttcagaccgcagtcgttgagctttataagatatgaacctactctgtcctccagcctgtcgataagctcctcacgctcttttatcttgtcgatagacttaaggtcatacttgtcataaagctctcttaccgatatgaaattcttctgtgccagcacgcccatttgaacaactgcctctgtagcctgtgcgatagcaacgtttggagtaacaagaaatctgtcgtcaagaagatcctccttagtaaaagtatcatcgtcctcagcgttcttcttatctctgatagtccattcggcaagtttttcaagcactgtatagaacggcagaaagattatagttaccacaacattgaagatagtatggaagtttgcgatgcttcccgttgtaaagctattattccagaacggaaatcctattgtatactgaatgatataaacgccgataagaaagattatagtaccgataaggttgaaatagaagtgtatcatagcggctctcttagcgttctttgaagcacctatacttgaaataagaggtgtagcacaagtaccgatgttagtacccattatgataggaaatgcagaagcgaatgtgatagcgcctgacactgaaagtgcctgcaaaatgcctatagaagcggccgatgactgtatgatagccgtgaatatcgcacccaccaatacgcccagaacagggtttttaagcactgcaaaaagctgctcgaactgcggaagctctgccagcggagcgatcttctcctgcataagtatcattccggtaaagaggatacctatgcccatcattatctcgcccacgttctttgtcttgttcttcttgcccaccattataattataagaccgataacgataagtatagacgagaaattcgacggcttgcaaagctgcaatatagcagggccgctgctgtcgccctcgaggtttgtgagccttaatatctgcgttgtcatggtcgttccgatatttgcgcccatgattattccaactgcgcccttaagcttcaaaaggcctgcgtttacaagtcccaccacgataacagtagttgcagacgatgattgcaccgctgccgtcaccaacgcaccgaaaagtattcctgagaacacgtttcccgtcattttcgcaaggaccttctccataagtccgcccgaagccttttcaagtcccgaactcaatatggtcattccatataaaaacagaccaagtccgcccgccattccgataatgttaaagatactcaaatcaattcattccttttcttgttttttccactgcacaacgtccgagcacgcccctgcgcaccccattacttaccttacctttacgccgattttacttaataaataaaacaaagccaaagcctgcacggatatcccgcaaggctctgactttgataattatttctttcctgccaccacaagtctgttcatggcacgtcgcagtttctgctccgccctttcaaactctttctggctagcattttctctgagcttgttttctgccgccgcctttgccttttcggctcttgcaacgtctatctcatcagcccattcgatagcagatgtcaccactgtcacaccgtcagcagacacctttataagccctcccgaaatagcggctgttctgaactcaccttctattttgatacggaaaggagaagaaacgatatttgccacatacggcgcatgacctgcaagtataccgatatcacctgatacggtcctcacaatgatctgctcagtatttccctcaaaaaaagttttttcaggggttattatcttaagatcaaaaggcgtcataatctttctccataagttttttacaaatcagcgcatgcggcacaaaattgccacatacattcactatatactataatccgactcttgtcaagtatttttctttaaacgttctgttactactgttcactttctgcgatctgtttgcccttttcaacagcctcgtcgatagttcccacgaacaggaaagcagattcaggcaggtcgtcatgcttgccctcgattatctccttgaaacctctgatagtctccttgataggcacatatttgcccttcatacctgtgaactgctcagcaacggagaacggctgtgacagaaaacgctgtatctttcttgctcttgacacagtgagcttatcctcgtcagaaagctcgtccatacccatgatagcgatgatatcctgaagctccacatacctctgcaagatagactggacctgtcttgccacctgataatgctcgttgcccactatctcaggggaaagtatcctagagtttgactccagagggtcaacagcaggatagataccaagtgatgaaatgcttcttgaaagcaccgttgttgcgtcaaggtgagcaaacgtagttgcaggcgcagggtctgtcaaatcgtccgcaggcacataaactgcctgtacggaagtgatagagccttttgttgttgaagtgatacgctcctgtagctgacccatttcagttgcaagggtaggctgataaccaacggctgacggcattctgccaaggagtgccgaaacctcagaacctgcctgagtaaacctgaatatgttgtcgataaaaagaagcacgtcctgatgctcaacatctctgaaatactctgccattgtcagacctgaaagtgcaactctcattctcgctccaggtggctcgttcatctgaccatacacaagcacagtcttatcaataactcccgactctttcatctcataataaaggtcgttgccctcacgggtacgctctccaacgcctgtgaataccgagataccgccgtgctgattggcaacgttatttataagctcctgaataagcaccgttttgcctactcctgcaccaccgaaaagacctatctttccgcctttcagatatggtgcgataaggtcgatgaccttgataccggtttccaggatctcgtttgaagcagactgctcttcatatgtcggaggctctctgtgtatctcccagcgctccttagtttcaggggcaggcagattgtcaacaggctcgcccagaagattgaacattctcgaaagagtttccttgcccaccggaacagatatagccttgccggtatcaacagcgtcgatacctctcacaagtccgtctgtagagcccatggcgatacatcttactatatcgtcgcctatatgctgagccacctcaacaacgagcttttcgcccttgttgtctatctcaatggcattgagcaggtcaggcaagctgtccttttcaaagcggacatcaactaccgcaccaactatctggactaccttgcctatgtttttgctttccatttatttaccacctttcaaaaagggatatcatagcttgatatgtttaaaagcctgcaaaatgcagacgaacactgttcgcccctgcaagacttctccaacaatatccacaacatttacttttgaacgcccacattcgggcataattattcttcctatcttccgatagttgccgagcttatctctgtaagctcctgagttatctgcgcctgtcttgctctgttgtaaagaagcgacagattgtctatcatttctcctgcgttgtccgttgcagactccattgcagtacgtcttgccgcctgctcagaagcgtaagaatccactatcgcagaataaagcataccgcctatatactgcggtatcataccgtcaaagacctcctcaggggacgggtcatagatagttgacgggtgctttttgccgcccagcttgtcaagatcctccacgggaagtatctgcaaactgcaaggctcctgtgtcagcgccgacacgaatgtggtatacacaagctctaccttgtcataatccccatttctgaagcctgcgataatatcttccacaatgtctataacagtgtcagtgtcaatgttctccgctatctgcggatatttccacacaaggtcatagtcacgcttctcaaagaactcaacagcctttttgcccacagccataacacgaagctgaccgcctgatgacagcacatcgtcagcctttgccttagccattttcagaacgttggagttaaatcctcctgcaagtcccctgtcgcctgccaccactataagcagtgtggaattaagaaacttcttctttgtatacaccgacttgaaagctctgtcgcaggatatatcgcacattgtcttaaaaagcgtttcaaagaacggctgaactgccaccgccttgtctttggcacgtctgagcttagaagccgccacaagctgcatggcttttgttatctgcatggtgctttcaacgcttttgatacgtcttttgacgtctttcatattagctgttgccatcgctcagcgctccttatctgctttgaagaaacttctgtgaatactccgcaagcacatcctttattgcctgttcattctctttcgtaagctctcctgtttctcttattgaaaagaaaatgtcagggtgagtttcatctatatacacaaaaagatctttctcaaattcagcgatatcctcaactctgatatttttcagatagttgtttaccaccgcatagattatgaccacctgcttctcaacgtcaagcggtgaggtcttgccctgcttgagcacctccacgatacgttcgccctgtgcaagtctttccttagtgtccttgtcaaggtcagagccgaactgtgagaatgattgcaattctctgtactgagaataaagcagtttcagcgagcctgaaacctttttcatagcctttatctgtgccgaaccgcctacacgggatactgatataccagggtttaccgcaggtctgacgcctgagaagaacagctcagattcaaggaatatctgtccgtcagtgatagatataacgtttgtcgggatataagctgaaacatcgcctgcctgagtttcgataataggcagagcggttatagagcctccgccgtagtccttgttaagacagcaggctctctccaaaagtcttgaatggagatagaaaacatctcccggataagcctcacgtcctgtcggtctttgaagcagaagtgacatagttctgtacgctacagcgtgctttgaaaggtcgtcataaacgcacagcacgtccttgccctgaagcatgaaatactcagccattgcaacgcctgcatatggtgctatatactgcaaaggcgccatttcagaagccgttgccgatacaactatagaataatccatagccccatgcttagaaagggtatccaccacgtttgccacagtagactgcttctgacctatcgcaacatagatacagataacgtccttgcctttctgatttatgatagtgtcaagtgctatagaagttttacctgtctgtctgtcgcctataataagttcacgctgacccctgcctataggtatcatagagtctatagccttgatacctgtctgcaatggtctgtttactgattgtcttgtaattattccgaaagcagggctttccacaggtcttgtttctgttgtaagcacagcgcccctgccgtcgataggtgcaccgagagcgttcacaactcgtccgagaagcgcatctcccacaggcacagaaactatcctgcctgttctctttactccagacccctcttttattccgtcctcagagccgagaagtacacagcctacaaaatcctgctccaagttcattgccatgccgtatgttccgttagaaaattcaagaagttcgcccgacatacacttgtcaagtccatgaactcttgaaattccgtcgccaacagtgcagaccgtccccacatcgtcaagctcaagcttactgcggtagtccttgatctgctgttttatcaagcctgttatttcatcaggacgtaatttcatattaaaataccgttcctttcctatgcaatgaccccgtcgatctgagccttgatattatcaagcttagttctgacgctgccgtctatttctgtgtctgaatatctcagcacgataccgcccataaggcttttgtccaccttttccacaagcactatctttgcccccgaaacagcctccagcttagccacaagcttgtccctgagcctttcagacagaggcatagccgtcaccgcagtgacctctatgatattattatgcttttcataaagctccttgaactttgcgcatatctcaggcagaaaccttatcctgcccttttcgctcacaaggcaaagaaaattaagcgtaacaggctgtatcctgcccataaacaccttttccagtgtcgcccttttttcgttctccgtcaccagtggcgacgcaagcagctccacatattcctcctgaccctgagagaaaattatatcccttatgctcccaagctcaccatagacttcatcaaggcagttctcctcgcagcacacctcaaaaagtgcattgccgtaaatattcccgatactgtctgccattacatctcacccacattgtcaatgaacttctcgataagacgttcgttgtcctcgcctgtcatatccttttccacaactgccgccgcagccgagaaagcaatatcggtgatctcgttcttgatctggttgacagcgatcttcttttctctttcgatctctcttgaagcattatccacaagaccctttgcctcagttctcgcttcgctgattatctcgtcagaacgctgttgagcctttcttgttgccgtctgtataatctgtgcagactcttcctttgcaccctctaatctgcttgtatactcagcttcaagcttctcggcattttcttttgcctcgtcagcctgcctgtaagtttccttaacatcatttttcctgtcctcgatgaccttgttcaccttatcgaacagaaaatgcttgagcaccaaaaacagtatgagcgtattgagcaaagtcgcaattatcgttgtcagatctattgacagaaactctgtcacatcgcctgctgccaataccatttatccaacctcccctccgcatccatgcagagcaaatcttgtttgaagctttttattaaagctttccgataaatgggttagcaaagagcaggataagcgctactacgaatgcgtagatacctgttgactcagccatagcaacgcctatgaacattgttcttgtgcagtcgcccttagcctcaggctgtcttgcgatagcctcaatagtctttcctactgcgtagccctcaccgataccaggtccgatacctgcgatcattgcaagtcctgcgccgattgctgaacagccaagaagaatagccttttccataatgataaacctccgttatttactatttacatttttatacttttccgccaaagcggtaatttactctgtttccgcagccgcaccaacgtttaccatggtgagcatggagaagatataagcctgtatgcaccctgagaacaggtcgaaatacacgctgagcaccgcaggtatacctacctgaaatacactgaacgcccatgagcctgcctcaaaagtcagtccaagcgctgatgacagtgagccaagtgcaccataaagcagtcccgttattaccatgccgcctgcaacgttgccgaacagacggaacgccatagacgcaggtgtagccacctcgccgatgatattaagcggcaaaatgaaagccacaggctgagcaaagcttttaaggtagcccttgaaaccgttcgcttttatcttgttgtatgtgataagcacgaatgtcataagagcccacgttgctgtaacattgatgtccgcagtcatagacctcagacctatcatactgataagagcgccaaacaccgcataaataagcagcgtagcaatataaggggcatacttcatcatcttaacgcccatgttctctttgaccatgttgttgacgaagttcacaagcatctccgcaaccacctgacgctttttctcaggcacttttttcaaatcgtgtgtgagccacaagcacagtatcagcaccgcaactataataagccagcccatcaccaccgtttcggtgatcctcagactgcctatctcaaacactatcttagggccgtttccaatacccgtcatttatttatcccttctttctcttatctgtatgacatacagaattatcctcggataaaactgcggaagcagtatcccaactggacttactgcctttgtgagcatagcccccgcacaaagcacaaaaagcactccatacctagtcatgtaacacccaagcattgtccgcttagcctttttgccctcaagctccacagccttttcgcaggtcacaccaaggtagtacatacaaaggcacatatagccccagcccaatgcaaagcccgcaagctgtgtgatgtcaaagccccacagcaaagtaaatgcccagcatacaacagccataacaccgccccataagcatatttttttcaacaagccgccaagctcagagcctatatttttcacttattttctccgattttcataaagaaatccaccataaatctttacattttcttaatagcagaaaatatctgcctgatgtatttcattataccacacagccccacatttttaaagagcaaaccgcaaacttaaacatttattttacatggattttacatttcgttcacagttagtcaaataattagttaattatgatttggcgttaataatttatcaatagtcaaccattgacttttgacattgtttgagttttatcatacgatttcacaataaaaaacggactgccgcaagccgaaataatatcacggctgagcagtccgcaagcatatgtgcagcttatctgatgatatcgtcaacaacgctttctacagtgcttacagtatcatcaataatatccgcaccaccgcttacagtgtccttgataccatcgccaacacggctcacaagcgtgtcgctgtcatcacgtctgcttgttacctcatttttagaagttgtggtcgcagtaacgccggaagatgtcgaacctgagttatcgtcatttcttgaacagcctgcgagcataacaccgcaaagaccaagacaagttagcatagcgaacatttttttcataattaagttcctttcagtataagatatgccattttaggctaatgctattatttctcggagatgaggatatattcataaaaaaacaaaaaagagacgagctaaaagcccatctctttgtcagatcaaaaaatcaatagaaccgcgatttctttttcttgataacgaaaataacagcaccgacaataaccaccgcaacgaccacaataactacaatgcctactactccgataccctttgaagattcagcctcagatgacgaagtgctgctcagtccgtttgacttaggctgtatctttaagccctgcacgatctcctgtgcctttgcacttttattgtagccatcgagattcattacccgaagatctacatcgttcttctgcaacggagtatctattacaagattatcaatgtaaagcacatctgtcttatccattttctttataaccggtatctcaaatacgaactttgttgctccgcacttgtcaggtactggtataagtgctgtcgcatactgagtaacattattgcttgcatctgtatttatttcaagctgaacactattgctggtcaccgttttgtattcctcagtacaaggaaaagcaaacactgaatctcccataagcttgccctgagcgtcctgatttatcctgtacttgaaagaaatcatacagccgtcaaaacaagtcataccaaaatccttggcgtcgatctcaacgcccatcgttatatgaggcgtatcttcagaatcagagccaggataaaccaaattcttatcgtcatctcttataagcgaagcaaaagtacaataatcgcttatgtcattaggctgtgttgctgttatcttaaggctcgcaccctgataagcataggtcttttcttgggatgctcccactgatatcttctcaccgtcaggagtcaccttgatatatctctcccaatccttcatatcaaacgacaaggacggtgctgaagtatctgttgtaaggatactcttgtcggcactatattcaggtatttcagcctcactgtcggcataagcaggcacagcacaaacaccaagcatcattatcgctgataccacgccaagtattctctttgatctcattttaattcttatcctcccttgatactattgtatgtaaacgctttcatagccgttcacacaagtatcgaaacgttataaaacgctattaatattttacacctttttaacaaatctgtcaagtgtaccatacaatttttcatataatgtaactgttttgtaatacaagctaagcgttttaaccaaaataaccacacgatttttatgaataagctcttattgacagccattttttatcaaaaaaagaccgccttctcagacggtcctgcgaacttattgaataccaaggaactggaaatactgcttatccggcattgttgtaacagaagtagctctcagatcatcagcctccgaaagtctgtactgcaccttgagaactccgtcctcctttacccagccaacatcaggaactgttcctcttatacccttgttggaaatggtctttttgatacctttctgcttaagagtaaagaatttaagctcgatatcctgattatatggcactacgcatatctttacagcacccttgtcgctgtcctttacatcataaagtattatctgatactggccgtcaggcgatatggtatttgattctgacgttacttcagtgagcttcttgaagttatccctgtagagagcataaacacttgacgatgtgtcaagatctgaatttagcacagtttcaacagacgtgcctccgaaaaggatattaagcacaaaatatgcaactattccaagaacatacataagcagatatattgtacccattataacctttacagtttcgttcgtgcctgctgcaaagaacattatgatagcaacaatgaacggcggaactatcaatatccagtcgcccatgttaaaaagtatcatgcagaacacgaccggaagcatgagtatgctcagtatctccgtcacaagctcacgtctcgaaaagagcataagacccataaaaactacgttaatcaccacatacactgtgaaaaacgatttttctctgcctgccgcaaactccagatcatacaggaacgttgcataagtgagcagagttattacagcaaagtaagcgacattgaaaactgataccgctcgctttacccatacgttagataaaaaatccttcatttttagtcctccctagacactctgttcttttattttacacgaaattacgcaaaaaatcaagtgctttatttctttattttttcttaaaacacaaataagacatatcaaatagtatttagttggctgaatgccgtcaattgagtattatctcttcaccgccgctgagtcccgaaagtatctcaacgttgtcgttgtcctcgatgccaagctctacgtcctgctctatctttacaccgtccacaagcaggttcacatagttgcgtccatcaagcttcttcaccgccttctgcggaactatcacagtatcaagccttgaatacacgtcaaagacaacctctatgccgccaagatccagcatatcgttctcctcgtcaggggttataacataaacatatgccgagaaatctccgctctcattgtagattatatccgtcacagtgccgcccatcgtattggcaccctgcactatctgcactgcagtgccaaaattgacgtttgtgagcgcgttatcaaacacagacacgcacagagccttttgtgatttatcggaagtatacccaagcacctcgcctttattcaccggcatgaacgctgtcagctcctgaccttgtctgtctgcaagatcaaactgtccgtcacatggagcgtaaaccttataatcctccaaggacgccacaagactgtcatatttgagctgttctatctgtaaatcatactgagaaagctgtatctcactgtagtcagcaccgttcgcctgcagtgtagcgaccgtctgcttcgcctgattgagccttatttcttcctcttctatctgttcatccacatcgtcagaataaagtgtgcaaagcaggtcgccctttttcacatcacaaggcgactccacatctatagactttatctgaccgcttgccttgaaggtgacggtttcactgtaagggtaatcataaacgccctcctgatgatactcctgagatatatctcctatctcagcttttaccgtcttatatgttatatccttagtttcaagaataggcacagctatctcgtcttttttctccgactttccgcaggcgcaaagtccgaaacacattgccgctgctgagatcaaagcaataaatcttatacttttcataaaaaagccctctcggtaatacaaaactgcggacacactccgccgcagtgaattataccacattttccgtcatttttcaagcttatcccctacatatcgtatatctattgtataactgcacaacactgtctgcctatatttatacaggtttaccacagcagttcaccgataatagagtttgaagccagaaaccccgcaggcgtaagccttaaaatacccttttcgaccatgcaaagcccctgtttctgaaacaaagcagccttctttcggatattctccccaagctctttaccaccaagctcctcggctttacctatgtcaatgccctcagtgagccttaaccccagcatgacatactcctctgccttgtcagggtcgtcctcaagcaccaccctgctctgcaccttgtcagaaataaactcctcaacatcgctcttgcagtaatatctctcattatcaaagaaagaatgtgccgacgggccaatgcctatatattcttccccgtgccaatatttaagattgtgccatgattttccgccctctttggcaaaatttgatatctcatactgtaaaaagcccttgcttgcaagctgtcccacagtttgcaaatacatatcgcacagcatatcgtcatcagccacagcgtttctcatctcatcacaatcaaaagccgtacccttttctattttcagcatataagccgaaatatgatcgacagggagtgccgtaaggctctctatgctatcccaaaggctttcaagggtctgaccctttaccccgagcatgatatcgcatgagatgtgcctaaatcccacctgagccgccgtttccacagccgactttgcctgagaaaagtcatgaagcctgcccaagaagccaagctccctgtcattagccgattgaacgccaaaagaaagccttgttacccctgcttttctccaccctgacatcttctccctgtccacagagctgggattagcctccaaggttatttcaggctggcaaagatcaaagcactttcctgccgtatctattatcctgtcaacctgttcagccgacagcacagagggcgtaccgccaccgaagtagatagtatcgcattttatgtccctacccttgaaagcctcaatattgcggcacacagcctgcgtgtagtcctcataaagctcaggcctgcaaacggaatagaagtcacagtaagggcattttcttttacagaaaggcacatggatataaattcccgtcatagcatatcctcgtcatcatcaaaagccttgtcgatatactctcctgttttttcacggttgagccgaaatctctctatcgcctttttcacaccaaatataccgccccacacaaggaacatacaaaggcttataagcactgcataaagcacgaaataagcctgctgtttcaaactgagttgaaaatacaccgaccgcctgtttagcatatcggaaactttggggtggataacgatatagcagataacgccaagaatacctgcataagcaagtgtgcataccatgcccataaaagcttctttgaatttgagtaccgagaatttagctcctgcacacaccgcccacacagcgataagcacaagcccaaccgccgcagagatattggcatacacctcataaagcacaggcaatatcaccgcaccgctcagcccgaaagccagcgacaatttcatagacttttgtatatcaggcatagctgctcctttcaaaaaaatgttgatatatttgtataaaccaaaacctatccactctccgaacgggctgtcgagggcgccagcccctacgccaaaattctaccgttgcaaaattactccgctcggtgttttctctactttgtattggtgatttgctcggtatggctccgccattcctcactcctcactgaaactctctactcgtccagtttcagcaccgacataaacgcttcctgcggcactgacacagatccaagctgtctcattcgcttctttccctctttttgcttctccaacagcttcttctttcttgtaatatctccgccatagcacttagcaagcacgtcttttctcatagccttgatagtttctctggctattatctttccgccgatagccgcctgcacaggtatctcaaaaagctgtcttggtatattctctttaagcttctccgtcagtcttctgccccttgaataagccttatcctcgtgtacgatgaatgaaagtgcgtccaccacctcgccgttaaggagtatatcaagcttcacaagcttagacttcgcatagcccatcatctcatagtcaaatgaagcatagccctttgtgcgtgatttcaatgcgtcaaagaagtcataaactatctcgttgagtggaagctgataatgcaggtcaactctagtttcgtctatatacttcatatccttgtatacgccacgtctgtcctgacaaagctccattatatttccaacatattcagacggcgtgtaaatatgtgcgttcactatcggttcctctgccgaagcaatatttgccacatcaggataatttgtcgggttatctataaacacagtttcaccgttagtcagatttaccttataaataaccgacggtgcagttgtgataaggtcgagattatattctctctccaaacgctcttggattatctccatgtgcagaagtccgagaaagccacatctgaaaccaaagcccaatgcaattgaagtttcaggctcgaaggacagtgaagcgtcattgagcataagcttttccaaagcgtcacgaaggtcaggatattttgctccgtccgcaggatagattccgcagtaaaccatagggtttactttcttatatccagggagtgcctcagcgcaaggctcagccgcatttgtcacagtatcgcccacacgagtgtcgccgatatccttgatagaagcagcgatatatcctacctcgcctgcatgaagctctcccacaggcacaaggtcagttgctcccatatagcctatctccaccgtctgaaattcagcccccgtagccataagcctaatggtatctccagccttgatatgcccctctttcacacgacagtatatgataactcccttgtactggtcataatagctgtcgaaaataagagccttaagcggagcgttctcgtcgccctttgggcatggtatatcctttacaacacgttcaagcacctctttgacgttcgtacccattttagctgatatcctcggagcgtccatagcaggtatgcctataacgttctctacctctgtgcaagccctttcagggtcagcggacggcaggtctatcttgtttataacaggcactacctcaaggtcatgttcgatagcaagataagtgtttgcaagggtctgcgcttctataccctgggaagcgtcaacgataagcaatgcaccctcgcaggcagcaagagaacgtgacacctcatagttgaagtcaacgtgacctggggtgtcgataaggttgaaaacatagtcctgcccgtcgtcagcgtgataattaaggcgcaccgcacgagctttgatagtgatacctctttctcgctcgatatccatattatcgagaagctgatcttccatatctctcagcttcacagtatcggtaagctccaaaattctgtcggcaagagtagatttgccgtggtctatatgagctataatgcagaaatttcgtatattattttcgttcatttactgtttttcctctctcagacaagtatacttttccataatactttattataacacgcttgccccacattgtcaatttctccgcaaagaaaaaaggcagacacaacgtgcctgcccaaaaatcatatgttattctgcgctgatatatgccgttacagcgtcatcagagctgtcagaagttgttccctctggataagagctgaatgtgaacttataatccttgtagccctttaccataaggaaaaggtttacatacttgtatgtatttccaacaaaatattcgttctttttctgtgtaagaagctcagtagttccgcccatgccgatataagtagaagctccgtcagcagaaggtattcctccgccgcccttgttagaagcagaatagtttacatcaggagagattatgccccaatcatcgctagggaaatcctcaggaacatagacctcatattccataacgcaaagctcacagtcatcaggtattttcagctcgctctcgtctatcttggaaaaatcactgccaacagagttgttaagctcgatagccttgtttacataatctgcgtcctcgctcttgctgactacctttgttatccttgtgtaaatagtgtggtagaccttgtctgtagcacagtatctggtagtctttatccactgaccgataggcgcaagattttcctcgcttgtttcagaaggctcgatagcactagccgcaatatcgttgctgtcaacgcttgcaggcttgttttcgtcagcagtgcttgtgtcagccacctcagcctgtgatgattccgttaccgcaggagcagttgttgtggtagttgtcgttgctgttgcatcttctgatgagtcagcagcactgctttccgtctgcacagacgcagcagagctttcgttatcactgtcggaagacccactgtcagaacagcctgccatgccaaaagccattaccactgccaataaaagagcagatattttttcataatgttacctccatatttctttaataaatttattttacaacattctcctatgcaagtcaacaatattttcgacatttataaatattttgttaaatacccacaaacagccatagtgtttttacaacataatgtagtaagaaaagcacaacataatgttgtatgatatattaaatatagactatcagaaaggaatggagcgccgcatggtttttcaaagaatacgagatatgcgagaagatgcagaccttaaacaaaacgatatggcaaaaatactccattgctcacagcaagcttacagcaactacgaactaggacagcgtgatattcccacggatatcctcatagccctagctgaatatcacaaaacaaatgtagactatcttctgggactaaccaaaaacatgacctactataaagatatgtaaagcggaaagaacatctctttccgcttttttgcaacccatttcatacacatttatataaatgcctgccccataggatttgttaaaattgcctatgacatttttagaaaaaaagtgttataatgtatataagagacaaaataaagttgtattcacgatttaatgtggaaggagcgttaaaaatgctaaaaaaaggcgacgtcatatcatacggtacaaccggagtgtgcaaagtcgagggcgagtgcgaacagaccgtcaagggtcagaaaaagcgctacatagttctaaagcctgtccaccaaatcaattccaccttgtatgtgccggtagataatgacgagcttaaaacaaagttcaaacctctgctcacaggcgatgagatagaggagattataaaagaaatgcccgaggagagctccctttggaaagaaagtagcagcgagcgtgccgagctttattcacaggtacttgaaagcggtgacagaaagcgacttgcacagcttgtgagaacattgtatctcagacagaaacatcttatcgcgaagggcagacatctccattcattagacgaacgttttttcaagaatgcggaaaatctgctctttgacgaattttcagccgtcctgggcatatcccaagacgaggtcttcgactttatagaaacccgcctgagcaaagcctaaatatatacaaatggcacaaataatatcggcaaataaaaaaggacaaaccacagtggcttgtcctttttgttttcataaatgatgctcgattattccttgtcaacgtcctcaacaggctcctcgatagcgtcgagctgaacttcaacgtcagcatcctcctcagttgcagcctcgtcctcagcaggctcttcagccttttcctcagacttctcagcgtcctctgccttgtcagcttcatcagcctcgtcagaacactcgtcgcagccgcagcaatcgtcgaaatcctcgtcgagatcttcgtaatcgtagttttcaagctccttgtgctttttaaatgcaaaaatagcagcagctcctgcagcgatcgcaccgagtgcagctataactttcaatccgcttgccataataaaacgctccttttttgaatattccactctgaactgcgttcagactatctacagtatagcatatttgttataaaaaatcaagacgtttacaaaaaatactgattttttatacaacctgctcaaaaaatctcagtaagctttgacaaattgcccaccgctacatatttcccgtaaggctcattatcacgctaagagccgccagtggagctgtctcgcaccgcagtatcctaggtccaagactcaccacagtgacccctgcctgactgcaactctccgcctcatggctctcgaaaccgccctcacagccgataaacaagccaatagtcttttcctcgccctcactgacaggggcaatgcctgtcttgctaaggctcacaccgcctttttcgtaacacataaagctctcatcgcactctttaagttcaccaaggcattcctcaaagctgataaaattcgtcacctcaggcacatatcccctgcccgactgtttcgccgcttccaaagctatcttattgtatctttccacacgcttttcatagccgctttttgcaggtcttgaaacgcacctcgccgtaataacaggcactatcttgtatactccaagctccacagccttttgcactataagatccattttatcagacttaggcaacgcctgataaagcaccacattcacagtaggctcgttttcgcttttctcagcagaaagcacatcgcaaaccacttccttatcagaaatggacagaatttttgctctgtattccaccctgtctgcacaaacagtgatgatatctccaattctcatacgcaagcttctgccgatatgataagcatcattacccctgatagaaatcgtattccccgatacgctgtcaacaaaaaatctaggcatattcccaaccagtgtcaagcactgtcctccaatctcaaatcacgattttacgcactttcacgacgctcccgtcgcttcttggtatagtataccacaccttcaaaaattgttcaacaaagttcacataactaacacaaaactttcatacgcagtacatacgggcaaggtattatatagttgtcgcaagggacaagacccaccgaggaaagttccgagagcggcagttgatttttggtatgtaggcttttaccccaagccttcatatatacagcttgtagattaatttctactagcttctcccctataattttttattttttggcacccacagttttctgtgggtgtttttttgtcctgtcgaggatatcgcaggaaaagtttgtaaaacaaactacaaaagcggtgcagaatttacactccgacaccgctttgtgattgatttttcatttgcaattcttctattgctttctacgccgcttagtaggcttgcgcctattgaggctctgcccatttcttgtgagcgaagtcgaacaagaaatttactccgctagggactctgtccctagaccctgcaatgggtttcacccctggaccttttgctcgcttcgctcggtgagccttttactttgcattggcttttcaaccaaattacgcaaacagttcccctgccgtatctttataatactccgcctgtgccgcccacattgctgtatatattccgcctttggcgataagcttttcatggctgccacgctctattatgtggccattgtcaagaactgttatatcatcgcagaaacggcaggaggacagacgatgtgaaatgtagatagccgttcttgttccaacaatgctgttaaattttgtgtagatgtcatattcagatatcgggtcaagcgccgctgtaggttcgtcaaggactataaacggcgagcctttgtatatcgcccttgcaagacacagcttctgtgcctctccgcccgaaatttccacaccgttctcatcaaaatccttgtaaagacaggtttcaatgccgttctccatagttttaagacggtcgccaagtccagcacggataacacagtctgtcacacgctcggggtcatattccgtatcggcagcaacattctccgcaaggctgaacgaaaacagcttgctgtcctgaaacaccaccgagaaaagctccatatactcttcgtatttatattttctgatatcaattccgttgagcgttatctcgccctcggtgggatcgtacagcctgcaaagcagcttaacaagcgtcgattttccgcagccgttcttgcccacaagagccattttctcgccaattcgccatttcagatttatgtctttaagagtatattcctcgctgtcgggatatttgaaccagacatgcttgaactcaaattcatattcgttatcatcacgcttttccgtagggatagtgcccttgtacttttcgtcgggaatatcaagaaagtcaaaatatttcttgcagaaagtcggcgttattttcagcagtccgtaaaagtctgaaagatctgacacgcctgcggatatcttttcaaagtacagtgcaaaagctatcacctcgcctggagataacattccgcttgccgccctcatgaccgcaaagccgtacataagtgcctttgtgaggatattgaccacctgacaaagaaaattcggcagcatagctgacttataagctttgaaccaaccctctgctatctcatctcgtgctttatcaagctctttatcaataagattttgctgggaatatattcttatctctttgccgtttcgataattgcggagaatgtaattactgaaaaagccatctgcacggtttgcctgaatgacctttttgtcattttgtaacttttcaaaaccaagtatcgctttagggtttatgaccaaagatttgagcatttcaagcaaaacagttattataactaccgcaagaaagccccatatagactgaatgaaaccgctgaagcctgctgtggtgacaggctttacaaaaaccattggtatgataagtataacacctgtgattatcaaaaatagtccgccgatagaatatatgacatatttgcacaatgccggtatgcctgcgttattattctcgacctgattatctgcgtttgaaaatctgttttgtgtgtctgtattttcaaggcggacaaaatccattgtcattactttctgccaaagatttttatgcagattggtacttctggcaaaagtctgagaacttgaacgcctaaaaagaaacatctttgtcataaatatcacagcctgcacgccaacaactatcgccgcataagaaagcagcgttccaacaggttttgactgcgtaatcccgtcgataacaagggcagacagatatataaagacaaattccgtggcaagccccaacacatactcaatagtatctctaatgagataaccgctgtcggcgacccttactgctttcagcgttcgctttattatctcacgtttttcctttgtggaaagcttttcttcgttgttattattatttttactcatttatctgcaccccccttatcattataataggaactttgaagctcaaaaagctcggcgtattttccgccctgcgccataagctgagcgtgagtgcctgtttctgttaaagtgccgttttctatcattattatcctgtcgcagaaccttgttgaggcaaggcggtgtgatataaaaacgcttgatttgcctttagtgaaatcggcgtatttcaaatacatctcctgctctgcgatagggtcaagggcggcggtgggctcgtcaagaagaagtatcggtgcgtccttatacaatgcccttgcaagagcaagtttttgcgtctgaccacctgaaagctcggtggcattttcaaaaactgacttcacaagccgtgtgttttccttttcgggcaggctcataactttatcgtaaagccctgccttttttaggcagtcataaactctttcacggtcaaaattatctgcatctgcacctgcgatattttcagcgatagtcaccgcaagcagggcgatatcctgaaaaacagcgccgaaaagtgtgaaatattcatcacgattatagctgttcacaggctttccgttgagaagtatctcgccctctgtagggtcataaagtccgcacataagctttatgagagtggtctttcctgcgccgttaagtcccacaagtgcaagcttttcgcccttatgcaaagtaaatgaaatattttggatagtcggcttttcagcacctgaatatttgtagctgacgttcctaaattcaagctcgcactcccctgtcggaagtttttcgcccttgccacgatttgttttatcgggcatatcgagatattgtcttgcataggaagtattgtttgatagccatttgaaacctgagaacttgtcaaaagcaactctgacagaatgaccgaaattccatatggaattgaaatacagcacaaagtcgcctgcgccgatattgcctttaactaccatataaataacataagcataggcggcaagatctgcaagctgcaagatgatagttgacaccacattgtggcgaaatgtccattcgtcctgctgttcataccaattcaagcgatttgcatatgagcggtcgaaaatctttgtgaaccatttgtccattccgaaaatgcgtacatcttttgccgatgaaaaatctctgcctgcgtcgccgatataatcaagctcacgatcatactgctgccaattatctgccatgttccatatccatttcattttgtgccgctcaagataatagaccgtaatggcgggaactccgacgataagtatcattatagggtcaagcattgaaagtataccgccatatgctgcgagctgtatcagcgccataagaaagccttcaatagtatcaaccgtctgataggttatgtagtctgaacctgtccgagctttttgcattaggttgttgttatcacaactttcgttgttttcataatcagttgacatatgcttgcggagcatttttctcgtcatatggtgaacaaacttaaagtagcccacatatccacggtaatctttcgtttcattttcaatgtactttgacataaattcgccgactataagcagcagacatatgacagcaagccttatgcgtgatgatgttcccagagcaagctcaacaacatatttgcttgtgaacgtatcaaaaagcgtggcggcaacgtttgaaaatatatgcaatacgatcaacatcagcattatcggctggcttttccaaagctcataaagggtataccgcatattttcaaaggtcttgtactttatcttactttgctctttgttgtactcgtcacgcgctttctggcgtttttcttttgtatactttgcaatttttacacgtttcatatcctcacctcacattcatcatacagcaaaaaagaccgcccgtgttgatttctgcacgaacggtcaaaatacggcacgaatggcaatatagtttacagtttatggttaatagtgaatagtgagtagttagtagttggattttgttgattttattattgatgtgagtatctttattagctcgatgcaatcggaactgatgctttcatatgtcacctcataactattaactattcaccatcaactattaactattgagcggcaccattatttcggtggcaaacacgccctcttcattctgacgattaacatatccgccgtaccttttcgcaactctgtcgattcggaataagccgtagccgtgttcaccctctttggtggagagatatgtatttttcgacttgcgcactttgcctgcggagttctgcacagaaagatacaactgtcctttcagcttgccgatatacacacgcataaatcgttcctcttcaggaagcgtgccacaggcttcgactgcgttatccagtatatttccaagcatagaacaaagctcaacatcgctcataggcagtttgtcgggaacattcgcttttacgttaagctttatgttcattttctccgcaacattcagcttgctgttgaggatagcatccgccataacattgcccgtctttattacagtatccacagtgtcaagatcgtccgcaagctcgttgagatagtcagacagcttatcataattgccctctgagagctgaattttcatattgttgatatggttgcggtaatcgtgccgccagccacgcacatgacggtacatattctgtatctcacgcacctgcttttcgataagctcgctctgaaagcgctctattcggcggtctatcatgttatatagggtgcggcggattaggaataatcctacaacgcagagtgctgaaaataagattaccgcacctattatgattgctattttcatattagtcctcacaatcacttataggttcaaacccttgacttattagacattcattaagtagttcaaaaaacatattaacagctttatcttcgtcaccttcagtttcgtaaatcaatgaacaataattcaatacggtcttgttatgaccaagcaacttgacagcaacaaaatcgttaaagccctcaggcaaaatatggtgtttttcatcattgaaatgcaatttagctgcacagttgtaaccgttgaaaaagttttgtaagaactccaatgacattttaccaatatacataccaggacgtcgtttaatattagctaataattttctttcgactatatttatatctgttattgcgttttccataactttatcctttcgtatagaactgaataaatttctcatttacatctttataaagtcgccgagaaagcggaataatcgtaccgttatcaagagcaatttccgtcttgccgatactccgcataaaccgcagatttacgatgtacgagcggtgaggactcacaaatccattcagcctcattgcaaaaaatctgcttatactcaccatgcagtctattatcctatcgtctgataagtgaactgctgtttttctgccgaaagcttcaatgtaagttattctgtcggccgatatatgtgtcgctccgttggtggtttcaataatcagctcgtcagctttgacggaacgtttctctacatatttatcgagaacagcgaacagcttttccttagctacgggctttagcaagtaatgcagggcttcaacgtcatacccctcagcaatgtaatcggaatagcccgtaatgaacactatcgggagcatatccccattggaacgaaggtgcttggcaagctccataccattgagcctatccatttcaatatccagcaggataaggtcgcaaggcttgtcgggatatgaaaacaggaagctttctgcacttatgtattcgtcaatatcaagcgcaaaaggcttgtcggcagaccattctgcgagaagccgacgcatttcttttatttgattttcgttatcgtcgcatattgctattgtcagtggcatttagttcaccttaaaaagttttgatttttttaattatatcatatcagttatttttttgcaacaaaacatattcaataaatggaaatctaagcaacgcaaaaaagcggaacgccccacacagaacattccgcttaaatcaaactattctatttagttatattcagggagcgattatcttgcaccctcagcaaagccgctgtcaacaagatcaacaagaccctttactgctgcttcctcatctggaccgtctgcaatgatcctgatagttgtgccgcctacgatgccaagtgaaaggattccaagaaggctctttgcgtttactcttctctcctctttctctacccagatagatgacttgaattcatttgccttctggatgaaaaatgttgcagggcgtgcgtgaagtcctacctgattctgtactactacgtcttttacgaacatactgatctctcccattcattataatgctgttaaactccctaattaagggactttttcaagataccctcaggttatttgatatatttattatactcgacaagtctgccttagtcaacgcaaattttagacaaacaagcgaaaaaccctcaattttcagcacaatgctctaaactttgcaacttttatgattaaacttgtgatatattcacaacacagatttttacatcatatcattttgtacaaattcatttaacaattatgtgaaaagtgttgaaaaccaatatcactttttattctctttttcttctaatttgtgtataatagccaaatctttttccgtcagcggacttctttccaacagctcaggacgcttcaaataggtggcttttacagcctcctcacggcgccatttcgctatctcagcatgattgcccgatagaagcactttaggcacttccctgtcgtgccacacctcaggacgtgtgtactgtggatattccagcagaccattataatgactctcgtcctcatagcaatccgcctgcgaaagcgttccctccagcattctcacaacgcagtccaccagcaccaacgcaggaagttctccgccggtaagcacataatcccccacggatatttcttcatcgactatttcgtcaatgaccctgctgtccactccctcataatgaccgcataatataaatatgctgtcaagctgagaaagttcctttgcacgcttctgggtcagcgtttttccctgtggggacatatagataacgtgaggctttgcctttccagctgtcaccgacttgtagcagttgtaaataggctcgcactgcatgagcataccctgtctttcactgtaaggggtatcgtctactctgcggtgcttgtcctgagtgtaatccctgatattatgacacgttaccgtgaaaatattcttagcccttgccctgcctactacgctttcagaaagataattctcaagcatttcaggaaaaagcgttgcaatatctatgttcaaatcaattcctccatatcatgtcaaaaggctggtaagcccagttttcctcagcgctgttcaaatgctcctgcacagagccgccgcttttttcatagtatcctatgccctgcacaacaccgatagtcaccacaatagcgattattatcaccacaaataagctccacaaagcagacctgcgcttcttcggcttgttgccctcgttattatagtataccctcagacttgtgagcatattgtcaagctccataaaactcagcccctcgcccttatatgtgttggcaagcctgttgaatccgctctcttttctcagcctttttataagccatttttcctcagccctggaacttctcagccgtggactttcatctatgtatgctgtaaaaactctctcgatacatttcagcgacttttcacggctgttcacctttggaaatatcaggctgaacattccgtcagaataatctctgacaagcctttccaagtcctcgtatttgcagaacttcattaatcaaaaagcccctccagcggagttatcttcatcacgccaccctcgatatccgtttcagccacaacttcaggtatcgcagggataagcttaacgtttcccttttcatcggttatgtggtaaacatcgttagcacccgtctgacttacatctgttatcttgccgtagctttcaccgctgtcagcgtcgaccacttcaagacctataagatcctgaacaaaataacagccctcatcaagctccacatcgtcacggtcgatataaagcaccctgttgcgaagcttctgagcctcctccacagtgtcaacgcccttgactttcattacaacgatattctttgcaactctcgaacgctctatctccacaggagtaccactcttataatatagtgtgtcaaatccgcagagaaattcaggtccgtcacaccatggctgtacttttatctcgccctttatgccgaacaccgatactatctttcccgcctcaagatatttttttacgtccattttgattacctcccgataacaaatcttacagctttctttttatagattgtaacatatttttttaccctttgcaacgctttaactacgctgttatgcacatagctcaggatatttacaaaaagtttattaattacaattcggttacttaaaacgaacttcacgcccctcttttgtacaaaatcaccatgaaaacctgtgatttaacaaaaaattcacacataagagagcaaaatgtgttacaatttgtaatatatcagaccgcagaccagtgcttgaaactgcggtataaaagtttttttgcatattttcactataaaacacttgcaaaacatatcgttttttgttataataacaatgtgcagacatctgcccttatggggtaattatgcccatggcagaacttaggtcgaaaatttttgcaagtagaggggaataacttatgtcaaacagattatttcagagcgttgttcatcagatgcgtgacactatcgactgcgtcataggcgtaatagatgagaacgcaactatcattgcctgctctgagctttcacaggtcggaacgactaacgaatttgtttcgttagatctgggcgattcacacgacatttttgttagagacggttatacctataagccattcggtgctcatatgaaacctgactatgctgttttcgttgaaggaacagacgaggtggctgcaaagtatgcaagcatacttgccattactctttccagcataaagcagtattatgacgaaaaatacgacagaaacaatttcatcaagaacgtagtgcttgacaacgtgctgccgggcgacgttcatgttaaagcgagagagctgcatttcagcgctgacatttcaagagtcgtgctgcttatcagaatactctccacaaatgacgtttcagcttacgatgttatccagaaccttttccctgacaagtccaaggacttcgttttcaacatcactgagagcgatatcgtgcttgttaaggaagtggcaaacggcgttgagtcaaaggatctggaaaagctggcacgttctatttccgataccctttcaagcgagttctatacaagagtcactgtgggtataggaacagtagtcgagggcgtcaaggaccttgcaagaagtttcaaggaggctcagatagctcttgaggtaggaaaggtgttcgatactgacaagaatatcgtttcttatgataatcttggtatcgcaagacttatctatcacctgcctacaacgctctgcgaaacattccttaaggaagttttcaagaaaggctctatcgagtcgctggatcatgaaacacttttcactatccagaagttctttgaaaacaacctgaacgtttctgaaacttcaagaaaactgtttgttcacagaaatactcttgtgtacagacttgaaaagatcaaaaagctcacgggtcttgacctgagagagttcgaccacgctatcatcttcaagatagctcttatggtaaagaagtatctctccgctaaccctgtcaagttctaaatcctacgagctaaaaagaggcttgcttgcctctgtaaaactaaggcggtgtaaattttggtagagtttaaagacgtgtccgttacctattcaagcggtgtggacgctctgaacaaagtaaacctgaagataaacgacggcgacttcgctttcgtggtaggtccttcaggcgccggaaaatcaacacttatcaagctggttcttaaagaaatagatgcgaccagcggtacagtaatggtaaacggcttcaatctgaaaaagctgagaagaagaaagatacctgcacttcgcagaactatcggcgttgtttttcaggatttcagacttatccctacaatgacagtttatgagaacgtggcgttcgtgctgagagtaatcgacgctcctgcaaagtacataagaagccgtgttccgtatgttataagccttgtgggactttccgataaggcgaaaagctatccgaccgagctttcaggcggtgagcagcagcgtgtggcacttgcaagagcccttgtgaacgacccacagctcatcattgccgacgagcctacaggaaatatcgaccctgcgctttcatatgagatagtagagcttctcaagggcataaacgagtgcggcactaccattcttatggttacccacgagcatgaccttgtgcgctatttcggaggcagaattatcaacatcaacaaaggtcagatcgcctttgacgaagtgataggaggctccaatgaaagcaagtagttttagatatcttataaatcagggcttcaagggcatttggaaaaacagaatgatgacgttcgcctctttctgtatactgctcgtttccctgcttatggtaggcacttcggtgctggtttccattaaccttacaagaataatcggcggtatcgaggacaagagcgaagtcatcgttatcgtaaaggacggcacaagtcaggctgatatgcagacccttgaaaataagctcaaagaggtcggaaatatcaacactgtgagcctttattcaaaggacgaagcgtggaaaaatatgctcaagggtatgactgatgaggaaaaggatttcttccagtatgccgacgataacccattgcctgatacttacaaggtaacggtcaaggatatcgagaagatgagcgaaacaaccactcagatagagacctttgacaatgttgactcaacaaagtcccctacagcatttgctgatatccttatcagtatcagaagggtatttacgatagttgcctttgcggtcattgtggcacttgttgtggtttgtctgataatcatttcaaataccaccagagcaagcgttttcgcaagacgtaaagagatcaacatcatgaaatatgtaggcgctaccaacagctttatcaggatacctttctttatcgagggtatgatagttggtctgctcgcagccgcaggcgcactgttgctcacaaagtttgcctacgagggaatttacaacatcttcaatgatgacttcaagctctggagcattctcggtgttcagaatttgtattccttcaaatccctcttgctccctgttgcagcatcttatcttatcgcaggcgctgttatcggtgcggtgggtacttctataagcacaggcaagcatcttaaagtataatacatttgccaaatatagacataaggcaggctatgatccaacggggtttttagactgccttttgttgcagtttaaagcatatcctgacatgagataaaaaagaaagaacgtgcaggataatgcgttagagaaagataaaaaacgtgtaaaaatggtcttttttaagacggaggacaagtatgaaaacaggtatattcacaatgaagcgagtattggctttcactatcgccgtagtcgcttccatgacaatgcttgcaggcggcacacagccggtcatgacagcgcagaacgcttctgcagaaagtcaggcaataaagaacaacaagaaaaaaatatcctctgccaaggataaaataagcgagcttgaacaaaagcaggctgaccttgacaagcagataaacagcacaaaggacgatatctccaaggaggaagaaaatcagaaagctatccaagagcagatagaaactgttcaggaaactatactgacccttgaggattctatcactgaccttgaaacagagatagccgaccttgaagaggctatcgcaaagagcgaaataaaaataaaaaacaagagaactgagatagaaaatggcgttgttgacttcaaacaacgtcttagagcaatgtatgttgccggaaatagttcatacaccgatattcttattggttcgacggacttttatgatatgcttatgaaaatagagcttgtcaaaagagtggctgaccatgacaacaccatgatcgacggacttgttgagcttaaaggcgagtatgaatctcaggaagcagagcttgaagccaacaagactgaacttgaaactaacaaagctacccttgaagaacaaaaggcttatcacactgagcagaagaaaaagcttgacgacctttatgcaaaaagtcaggctgttatcgaccagcttgaggaagataaggcggcttatgaagccaataaggagcagataaacaaggagcaggaagacttcgaggcacagctccagaagctttacaaggagcaggagcagatcaaaaagaaggaagaagaggaacgtaagaaaaaagaagaggaagaacgtaagagaagagaggaagaagaacgtagacaacagcagcaacagcagaataataacggcaattcttcatcttctaatgcaaacggcaacacctctaacagcggtcaatcttctaccaataacggtgactacaattataccgacaagagccagtttacatggcctgtgccgggttattatcatatttcctacggcgtgggttggcgctggggcgcttatcacaagggtatcgacatctggtctcctggaataagaggtgcaaagatatgcgccgccgctgagggtactgttatactcgtcagcaacacctgcacacacgattatggcaagaacggctcatgtggctgcggcggtggatatggaaactactgcataatcgaccacggcaacggctactggactctttacggtcactcacagtatatgagcgtaacacagggtcagcacgtcaacaaaggcgacgttctgggtattgtcggctcaacaggatattcaactggcgaccacctgcactttgaggtgcgattgaacggcgtggctcagaatccgtcaaattatgtataaacaggcaaagccgaaaggtcttgccccacaaccaaaggagtcttttatttcatgaacaggctttacagcttaaaacgtattctcactttcattatcgcattcgctgttaccgctggtattgcaggaagcagctacaattcttctttgaagataacctcagcggacactgaaaactcgcagggagaggactatagctatactgaatctgtggctgacggaggtcagcaaagcgatgaacaaacagaaaatgacgataattctcaggaggagtcaacaggttttgacatcacacagtatgcagaacagctaagagagctatcaaaaaagcagacggaaataaacgaacagctcgaccaatatgatgaggacattgagaaaagcgagaaaaagcagaagcttctgaaagaaaagatagattctataaatgacgagatagacgttctcaactcttacatgaccgcactggagcttcagataaacaccaatcagcgaaatatcgataagaagcaggctgagataaacaagggcatagaggactttaaacaaagattaagggcaatgtatatcgcagggtcggacagctacaccacaatgcttttggaatcagacagcttttatgacatactcatgagattagagcttataaagcgtgtggcacaccatgatgacactatcattgataaccttataaaacttaaaactgaatatgaggatatacaaaagacccttgacaaacagaaagccgagtatgacgctcagtacacacagtatacacagcagaaggatatgctcagtcagctttaccgctccagtacaaaaacacagcaggagcttaaagctaagcagaaaaagctcagagagcagaacgaagcctatgaggcggagcgtgagcagtttgagggcagcctttccggcatactgaaatcgtcaggctcaggcggaacagcaagagataacgaagtttccgccacaatggcacttgcagatgtgaagcttgaggagcttcacaaggagataaatgaccgccttgacaagggcgaaaagcttggagataccgagcctgattactacttcgcatggcctgttccgggggcttactccgtatcatcaggcgtgggcgcacgctggggctcatatcacacgggtcttgacattcctgcggctcatggcacgcctattcacgcttcatgcagtggcaaggtcataaagataaacaccacctgcactcatgactacggcaaggaggagtcctgcggctgtggtggcggttatggaaactatgttatcatcgaccacggcaacgaattcattaccctttacggacacctttccgaggtagatgtagagataggcgacgaggtgaaaaaaggcgacgttatcggcaaaatgggttcgaccggcttttcaacgggcgaccacctgcacattgagatacgctatcagggttatatattgaaccctgcgttctatcttgatgttacacaataaaaaaatcgacctcttatggaaaaacataagaggcctttttttatcttattttgaagcactcacacgcttacaaagacgtgaaataatcgctgtgataaatcttgttcctgcagtgcaaagaagcattatcacggggataaatgtgacgatatatctaggtggattttcccagataaggaaaaagagtataactcccgtgagagtcactatgctgaaaaacaaagcagaatggcgacgcttgccagcggaataaactgcaccaaacgccattgctatgagcattgcactgtgatagccgtctacatagctaccaagtaagcgactgtgcaatacctctcgcagaccacctgaggggtcggagcgtgagagatatttgccataggcaaaaccaccgctgtcccacgttctggcgactttgtgataagccattttgcaggcttcataaggggtgcttatgttttcaaggcgggcttttatttcccggatattcgcctgctttttggcgtcatatgtatcaaatgacatagtgaagtcaacgtcctcgtcaacatgggtcttgtagtcgctgttaaggctcatcattatccagtgtgtaacaggaaaacgatatctgtctaccattttttcatcagagatacccatagtaagaccgccatagtatgccgcctttgacacgccaataaacagcataacagccgcaaggctcaggatagctcccctttttacacccattttcagcacaaaaaatatcatcactgaaatcagaattattgcaatgcttcccttgacagtgtttccaagtgcgataaaaaggcttgctataagagcatagacaacgcttttggttttgcttttttctttcaccgcaagggtcagaaaataaagagtacagcttacaaatatcatgcctgctgtgtcagaatgaaaaaacggtgtatacagaagcataacaggcataagtgccgaaataatgccgcaaaaaagcctttggctgttaagtttaaaaatcctctcccctgtgagaaaggtcattattacgctaagttgaataagaattacgttaaaggtctgccccgcatagatgctcacgccgccggtgaaaagcttccataaggcgaaaaagggtatctgcaaatatatcatgccccatgcgttagggtattttgcagcataaatacggtagctttctttgatgctcccaagatcttcacccatgacaaagcgttttgcgaactcccctgttattttggggtcaaccatttcgtaattgtaataaagataacgcacaaacaatatctgcaatgcaagcaaaatcaggcagaaaaaagcaaatataagtctgacacgctttttagtaagcttcttttcacagcgtttcagagcaatatacaacactatcgccgccgcaaggaaaaatggtccaagacaaagcattcgtatgttactgcgttttatgtatgagataaacacagttgcagtgcaacagcagcacacgatcatgcttgtgaccgcaaaaaatcggccggttttcttcacaaacatttttatctccttattagggtgtatcctcataatatattttttacatgagttcgccctgtttttttattttgttctatatttctacatttgaattatatcatcaacggaaataagtttcaattattttaacaactgaaattgaaggaactttttaaagtttttttagtgaagtaaacaaaaaaatcgccgctctgttgcaaaatacagagcggcgagtattagtataagaccattattttgtgccgaagatcctgtcacctgcgtcgccaagaccgggaacgatataagcgtcctcgttaagcttttcatcaaggttgcctacataaatgtcgatatcagggtgagccgttctcagagcgtcaagaccctcaggagcagcgattatgcacatgaacttgatgttcttgcagcccttgtctttcaaaaagtcaacagcttgtatcgcagatccgcctgtcgcaagcattgggtcgcagacaataacaagtcgctcgtttattctatcaggaagcttgcagtaatactcgtgaggctcgtgtgtgacctcgtcacggtaaagaccgatatgacctacctttgcagacggaacgagtgcaagaagtccgcttaccatgccaagacctgctctcaggataggcacgatagcaagctttttgccgcagagcatagggagctttcttgtggttataggtgttttcacctcaacgtcctctgttggaagatctctcatagcctcatagcccatgagcattgcgacctcttccacaagtatacggaactctcttgttccggtcttttcgtcacgcataagtgttattttgtgctttacaagcgggtgattgatgatatttacgtttcccattttccgatttcctttcgtaatgatttataaattcgcatttttttgtgtgcagtgacgggcgaacactgttcacctctgcaattttgtcataattatttcttggctgcgttgccttttttctttgagagcataacgtttgcaagaatgccaaggataagtgctgccgctacttctgtgagtgttatatcaccgaacgtgagtgtcagaccgccgatacctgcaatgaggataacggacacaacaaagagatttctgttatcgtcaaggtttgcgtcctgtatcattttaagacctgaaactgcgataaagccgtaaagagcgatacaaacgccacccattacgcaggcagggatagaatcaacgaacgcaacaagcggagtgataaacgaaaacagcatacagcctattgctgccgcaaagatagttactacagaagcgtttcctgtgatagcaacgcaggcaacggactcaccgtatgttgtgttcggacagccaccgaacagtgcacctgcgatagaacctacaccgtcgccgagaagcgttcttgtaagaccaggctcttcaagaaggtcatggtcgataatagaagaaaggtttttatggtcagcaacgtgttctgcaaaaacaacaagtgcaaccggcacataggctacaaatatagtagcaaaatatgtgaagtcgaactccttaagacctttcagacctgaaacgaacgcaaagtcaggcaggctaacaaatgttttcagtgaaacgctgccgtctgtgagcatatagctgctgaaaacgctgaaatctactattttaagtgcgtcaatatcacatatattgccgataacagtgaagatcgctgcggctgcatagcctgcgaggataccgattataaaaggtataagtctgagtgttttcttgccatatgttgagcaaagcattaccactgcaagggtgataagtccgcagataagagccacatatgacgagcctacaggcacgttggatacagtttcgattatctcaggtgtgccgctgtcggtggagactgcatactctgttacctgctttgttacgtcgcctttgacgaggtcgccgatagcatttcctgcaagggaaagtccgattatagcaacggtcggtcctattaccaccgcaggcatgagcttattgagccagcctactccaacaaattttactactattgcgataacgacatatacaagtcctgcaaggaatgcaccgacgataagtccaagcataccaagctgcattgaaacgccgcctgcaaaagccgccgccattgagcctaaaaaagcaaaggacgagccaaggaacacagggctttttctttttgtaaaaaggatataaactatagttcccacacctgcaccaaacattgcagccgcaggagtaagacctttgccgataataagcggcacagcgatggtcgccgcaaggatagccaacatctgctgaagtgcgaacactaccagttgaccagcctttggcttgtctgaaacatcaaaaataagtttcaatataacacctcattcatataaattttctcacgttttccatttccgatataaacaggaaaacacttctttgcggtacgttttgacacaaaccgcctttttaattttaacttataacaatatttttgtcaatgagctaaatgccgtatttcagcaggattttttgtgcgtaattgcccattttctttgacaaataagccgttttgcgttataatagcaattgatatattgtattatgtgaggtaatgacatgaaaaattacagatatgttctttttgaccttgacggcacgcttactgagtcgggcgagggcataataaattcggctgtatacgcactgaaaaagttcagcatagagcctgagatgagcacgatgacaaagtttctcggtccgccgctgaaagactctttcagggatttttacggctttgatgatgaaaaatgcgagcaggctgttaaatactaccgtgaatactacaccaccaagggcattttcgagaaccgtgtttacgagggagtggaagattgccttaaaatgctgtcggaggctgggcttcaccttgcggtggcgacttctaagccgcaggtctttgcggtgaagatactggagcattttcaccttgcacagtattttgactacataggcggtgcggagcttgacggctccaggagcgtaaaggcggacgttatcgtgcacactttgaaaaactgcggtgttaatgaccgctcacaggtgataatggcaggcgacaggcatcatgacgtgcttggtgcaaaagctcttggtatagattgtatcggtatgctttacggctacggcacaagagaggagctttccaaggcaggtgcggtgtatatagccgaaacgcctctggaagccgcaaaatggcttctgggataaatttgacaggtgtataaaagagcgaaaacctattgcaaaagtcaaatgtttatgatataataaaataaattattatgtggcggcataagaaataagcttgtgatcctgccacgatcaagaggagttgttttctgtgataaagtttcgcaaccacattggaactataggtatatccactggatatctcagacagcttatctcggatactgccgaaagctgtttcggcgtggcaggacttaacgcctatggtgcaaaacagggcgtttctgcaatgctaaagaaagagaacaccacaaagggcgttataatccgtcaggacggggacgagcttatcgttgacctgcacattactgtgaactacggcataaatgtcggagctatcgttgacagcatcattcacaaggtaaattatgttctgacagagcaggcaggtgtcaacgttaaatctgtgaacgtttacgttgacgaaatgaaaggctgaacgtcctaggatatctataacagtataggaggaaaactatagtgataaacggaggcttgctgcgtgacgctgttataagtgccgcacacagcatatctaacaagaaaaaatcagttgacgagcttaacgtgttcccagtacctgacggagatacaggaactaatatgtcaatgactataacaaattccgtagcagagcttgaaaatctcagcgacgatgcagactgctcagttgtggcaagcacaacagcttctgcacttcttagaggtgcaagaggaaactcaggcgttatactttcgcttattttcagaggctttgcaaaaggacttgcaggcaaaaaggaaatgggtgcgaatgagcttgtggagtcgctggaacagggcgtttcaggagcatacaagagcgtaatgaagcctacagagggaactatcctgacagttgcaagagagtctgcggagaaagcaagagaaatgctccactccacaaacgatcctattattataatggaggaagtttgcaaacaggctgaactttcactgaacgaaacaccaaagctactccctgcacttgccaaggcaggcgttgttgacgcaggcggcaagggacttttcattatctttgaagcaatgagagatgtattcaagggcggcgaaatagtaaaggctgacgctcctgcaccgaaacagcaggtaacagtcgacacatttgcggctactgttggtcagtatgactgtgagatacacttcacatactgcactgaaatgataatcacaaagaaagctgacgctgacgattcatcaaagctgagagcttatcttgaaactataggtgactgcgttgtagttgtcgaggacgatgagataataaaggtacacgttcataccaacgaccctggtaaggctatccagaagggtcttgaatttggctacatcaatctgccaaagatagaaaacatgaagctccagcacaaggcaaggcagaaagaggctaaacaggagttcgttcctgcaaagcctgaaaagcagtacgggtttgttgcagttgcggcaggaaatggcattgagtcaatgttcagagatatcggtgttgactgcatcgttaagggcggacagaccatgaacccttctactgaggatatacttgcggcaataatgtcatgccccgctgaaacagtttttgttctgccaaacaataagaacatcatcatggcggctgagcaggctgttaagcttgcagacagaaaggtatgcgtgcttcagacaaggactataccgcagggaatgtcagcaatgctggcatttgaccctgacgctgatttcaatacgaaccgcattgaaatgaccaatgcacttgaaagagttgccacaggtcaggtaacatttgcggcaagggattctgactatgagggtcacgctatcaagcagggcgagatactctgcattgaaaacggcaagctgagctttgtggaaaaggacgtttcaaaggcagcttacaagctcacaaagaagcttgttaagggtgacagctcattcatcacgatcctttacggctcagacgttacagacgaggcggctgaggcactgcaaaagcaggtagctgcgaagttctcaaatcttgatgtaaaccttataaacggcggtcagcctgtttactactacatcatttctgtagaataagataacaaggcggacggcattgagctgtccgcttttttgtacaatggagaaatttttatgagtgatataacaaaggttcagtgcaggaaatgcctgttggaggatatggacgaaaatgattttctccgtgatatgcgttcgcacattgcggcatatcctgcggacaagaaagtatcagaggaagagtatcgtcagcgtttggcgttttgcaaggattgtgaaaagcttgtggacggaatgtgcgttttatgcggctgttatgttgagctgagggcgttgaagataggtatgcgttgtgcggatataaacaagaagtggtaaaggcatactgttcattcaggcaagttccttccaccgcaaaatcgctacgctctttgcgggttttactttgtttatttggatagaaaaagcggtgcagagatttgttctccgacaccgctttattgtttcttttactgttgtgtgctttttttacttttctgcaccgcttagtcggctgtcgccgaatgaggctctgcctcatactccgcaggggctttgccccttgaccccacaagccctctaacgccgggcttgagcctgcgttttatctctcgctacgctcggtgttgggggcacaactttggtcagctatgcccattcctcactcctcacttactccgccattgcttcttccatttcctttacaagctctccgaacattgcaagtgcctcattgataggctgagttgttgccatatctacacctgcacccttaagcaatgagatagggtcagttgagcagccacctttcaggaatcctatatagtcctttaccgcaggttcgccatacttcaatatcctctgtgaaagtgcgatagccgcagaatagcctgttgcatactgataaacataatagtcataatagaagtgaggtatccttgcccactccaattttatctcatcatcaagcactattccgtcaccgaaataaagcttgtttagctcgccgtaaagctcgttcagtccttcggctgtcagactctcccctgccgctaccatttcatttattttcagctcaaactctgcgaacattgtctggcggtaaagtgtggtacggaactgttcaaggaagtaatttataagatacgctctctgctttttatcctcggtgtttttcagcagatactgcataagaagggcttcgttgcaagttgaggctacctctgccacaaagataacgtaatctgaatataccacaggctgatttttatttgaaagatacgagtggatagcgtgacccatttcgtgcgccagcgtgaacatacagttaagtgtatccttatgattgagcagtacataagggtgaactcttgcacctgcggaatatgctccgcttgttttgccctcgttctcgtaaacgtctatccagcggttttcaaagccctctttgagtatcgcaaggtaatcctcgcccataggtgcaagggctttcaggacagtttccttagcctcctcaaaggttatcttcatatctgcgtcaggaacaacaggagtataaaggtcatagaaatgcagctcgtcaacgcccaaaagcttctttctcagtgcaacataatcgtacatatagtgcatattgtcatggacggcttcaataaggtttttgtacactgaaacaggcacttctgttccgtccaaagcggcttcaaggcttgaatcatatcttcttgcctttgcatagaagttcaccgcttttatctgtgccgacagtgttgccgcacaggtgttcctgaacttgtcaaatgtgccgtacatagactcgaaagccgactttctcagtactctgtcttcactctgcaccagtggtatataacttccgtgtgtgacctgatgagtcttgccgtccttatctacagcgtcagggaaacgcaggtctgcgtcagaaaacatagagtagatattctcaggggactgacccatttcaccagtcagagcaagtatcttctcctcagcctcagagaggatatgagcctttttacgacgtagcttatccagcgcacgcttataaagcttcaactcaggcttatcctcatagaatttctgaagcttatcctcctcgatagaaatgatctcaggtgtttcaaagcttcctgctgaatttactgcaacataagcgttcataagctgaccgagaaagccctgatactttgcatttgcagtatcctcgtcagaacgtctttgagcatagttgccaaggctgtcgcaaagaacagatatctcgtctgaaagctgcataaaatcataaagcgtgtcagcactctcgccaagcctgcccttgaacgccgctattctctcaggcatagccttaagcttctgcaagtcctccgcccacttttcgtcagtggcataaatatcctccagtgcccatttgaactgttcaggcacttcacttctcttaggtattctttcctcgctcattttcatgacctcgtttctataataataggtataggcttgtcttgtatggtattgcctataattaatttgcgtaacgctggttacattatactccattgacgtacttttgtcaaattagggcaggtgaactgtaaaataatacacgatacaaataaaaatacacccagcggcataaagctaggtgccaatctcctttgcgagctttattgcctgctttttaaactcttcatcatattgttttcctgttcccatttatgacacattcccttgtttttattatactttgattgttttgtatgtgtcaagttttattatacaggatcacaactacgatgtaggagattcaggactgatataatcacagcataaagaaaagggcaatgtccttcgtgagtggaaggcattgcccttttttcctttagaaaaaatcagttcaattgtttttgcagccattgaagacgatacagatcatcaaataaagtgtctgctttgtactgctccctaaaactataatttcatcatacgatacccaataccgatatgtgtttgtatcagcgcctgactgctgtcactcagcttttttcgcagggtagccataaatacacgcagggaggcttcgctgttatccgcaggagttccccatacactttggataatgtacttatgcgtcagcaccttgccgacattcttggcaagcaggcaaagcagcttgtattctatcggtgtcaagtgaatttcttcatcatcaaggtgaacacagcccgaaacatagtctatccgtagtctgccattgacaaactccgtgaccgagatgttttcggacttcataagccgcctttgtatcaccctgagccttgcgagaagttcgtcaacagagaaaggctttgtcaggtaatcatctgcacctttgtcaagggctgttatcttgtccctttcctcgctccttgcactgactatgatgataggaacatcgctccaagtgcgtatatgctctatcacctcaacgccgtcaatatcaggcagtccaaggtcaagtatgataatatcaggcttatgcgaagcgctgagcatgattgcttcattgcccctgacagcagtaataaagcgatagtcgttcattttaagagtagttgtaataagatttctgataggcttgtcgtcctccaccaccagaacaagatattcattcatttagatcgacctctcctattggcagagtaaagctgacaactgtaccgtttggtatgttgtcgctgacagatatagtaccgccgtgtgaagtaataattgacctgcacagtgcaagccccagccccagacttcttctgctgtctgaggaacggctgccgcccgtatagaacatatcaaataccttttctttttcttcatcggagataccagagccgtgatcggacacggatatcacaacagtatgcgcattttctcggcgcacactgacggtaacatcagaatcctcatcactgtacttaacagcattatccataagattgactatgacctgtacgataaggttcgcatctgccataacggggattatctcgtcatacatatcaacgatgatatttcgctttgggtgagtgcgtttggtgtgtttgacagcctcctgaacaatgtcatcaagtatctctaccgagatattgagctgcattctgccgtcctcaattcgtgtagcgtataaaagattttccaccatttcaataagccacattgattcggaataaatatccgtgtatatctgctgacgtgctgattcatcaagcgtatcgccgccggaaatgagcgtactggcattgcctgatatggaggtcagcggtgttctgagatcatgggatatggaacggagcatatcagctctaagctgttcattctgcgccagaagtgccgcctcctccttttcacgggcattctgctcagcgatcaggatattgcgtttcagcttattggcaagcgttcctgcaatgaacgctgtaataaacatcgtcacaaatgtgacaagatagcctgcatcgtgaactgaaagagaaaactcaggataggtgaagaagcagttgaaaagcatcactcctactaatgatgatatcaggcagaaatacatctttgatgtaaaaatggatatcacaagcacagcaataatatacagcatgataatgtccgcatcggcaagttgaaaggctttgaatgcgtatccggcaagtgttgcggctgtcagcaccacaatacatatagcggagtctttgaacacagaaaatgctttagaactttttatagaattagcagtcataaggatcacccttgttattataacatatcacttttgtgttcgtcaacatcatcttctgacaggtcgtgtccacgtctgctcttttgtatctcctcgatgaattcatctacttttttcataatataaaaaccgtagagaaatattgctccaacagatagtgcaagcagaacatttctcacacgatcatctcctagattctgaaacacttctggatatcccgaacctcacctatgacaaatgcgatgtcatcagtttcaattacagtgtccggtgaagggataaatacctcttctccgcgtttgatcgtcagaatattgatcttgaatttctttcgtatatcgatctgtgaaagcgactttccgaaccagtcctttggtactttcagttcgtagatcgagtaattgttatccaagtgaataaagtcgagtatgctgtctgatgcatattttgtagcgatgcgaagtgccatctgcttctcaggatagacaacctcatcggctccgtttttaagcaggaatttcatttgtacatcatttgtcgcacgggatatgactttctttgcccccagctccttgagcaaagacgttgtttccagagaggactgaaaccggctgccgagggcaacgatacaaacatcatagtttcctacaccaagcgaacggagaaattcctcattggtgctgtcaccgatccttgcgttggtcacataaggcaggatatcgttgatatgcttctcattttcatctactgccatgacctcacaccgaagctcctccatgcgtctggcaatgtgactgccgaattgacctactccgataattaaaactgttttcatatataagactccttatcctacggatattttttcaagcggtaagcgtgaattctgactgtccgccgacggcagagctgcataaatgagtgtcagtccgccgactctcccgaaaaacataagtatcatcagtatcacacgggatacagcagacagaccgcttgtaatgccgagtgacagccctacagtaccgatagctgagcttgtttcaaacagacaggtcagcagcggtagattttccactctgctgataatgacaccgcttgtaaagaacaatacaagatacataaacaaaacagcgcctgcactgcggacagtttcgtctgatattcttcttttgaagcactgcacatcatttctgcggctaaacactgtgatcgcagaaagtaacagaacagcaaaagtcgttgttttcataccgcccgcggtggaacctggagagccacctataagcataagaatgaccataatggctgtacctgattcatccatagcagcgagatcagttgtgttaaagcctgcggttcgtgttgtgacagactgaaacagtgaatggatcgtccggtcatggatagtcccatggtcatattcaaaaaagaagaaatacagcgcaggcagaacgatcaagacagcagatgtcatcagtacgaccttgctttgcagagagtagcgcctgatcctgtgcttgtgtgttccgatatcgccccagacgagaaagccgatgcctcccgtaataattagcagcataatgatgatattgagatagatgttgctgtggtaaaaggtcagcgatgagaacggttcttttatgccgaacagatcaaagcctgcattgcaaaaagccgatatgctgtgaaacaaggaataccacagtcccttagcgaaaccaagatcattgcagaaaacgggtgcaagcaaagccgcaccgatcatctctatgataagtgatgttttaaggataaagcctgtcagcttcacaataccgcctacctgcggtgcggagatggattcctgcatcgtactgcgctgccacagaccgattttccgccctgatgctctaatgatcgcaagcccgacggtgataacgcccatacctccgatctgaattagcatcagaatgaccgcctgcccgaacagagaccagtatgtagcagtatcctttacaacaagtccagtcacacaggtagctgaaacggctgtgaacattgcatcagggaatgaagtcacacaccgctgccttgatgaaataggcagcatcagaagcaacgaacctaccagaattaggcaaaagaaactgataatgatgacccgaaatgaagtcatatgagttctgttttttactctatttttatgtaacatcgtacacctctcgttcaaattatagctttattatatcacatgagcggttaaagtgctgttaagattacggttacggtgttaagatttcgttaaggcacaatattgatgtgtgccgcttgcccgtagtctattggaacacctgcaaaccgttccgcacaagtccatttcatcattatggcgcgcaccacaatgacagcataccctttttgaagctgaataactcacaaagaaccgagatttgctcacacaagcacttctcaggtcttttcaggcggttagttttccgctccgcaggctcggacggctctgaggggcgtttccgttcgtctgaggtggctttcaagcagaggtaggctcgccaacgctcttggtggtgaagcagagacagaaaagaatgaggacactaataaaaaaaacaggctcttgatacaagaacccgttttcatggtgccggtgaccggggtcgaaccggtacggtatcgctaccatcggattttgagtccgacacgtctgccaattccatcacaccggcacataacattatgattatagcatacttttttcattttgtcaagcaaactgcaagtaaattctgcatttactcgtttgtatattttcaacataaaacatatttgacggctcttgacttttggagatttttatgatataattaaaaaaaaggcagtagagaaattattttctccgtcatcggcaattacggaactgctgccgcaaaataatcgggagggatctatcgtgaatataaatgaaatgacagtgcttatatgcgacgattctatgttcgctcgcaaaaagctcagtatgtctatttctggatttggagtaaaagccgtttatgaagcagccgacggtgaggaggctgttagcaaatataaggagttcaagcctgacgtggttttcatggatatcatcatgccaaaggtaacaggtcttgaagccctcaaacagataatagcagaagaccctgacgctaaggtgataatggcttcctctgttggtactcagagccatttgaaagacgctcttaagtcgggagctgtggactttttgcagaaacctatagctgataatgacgctcttaaagtccttgagaacgttgcaaagggggtactgtaaatgtttgcgcagttttttggaggctacctctttaaccataagctttgtaccgctgaggatcttactcaggctttcgaggctaaaaagcatacaagacttcgccttggcgttctcgctataaacgccggtcttatgacagccgagcaggtggagcacgtcaatatcactcagcagagtgtcgataaacgttttggcgaccttgccgtggagcttggctatgttaccgctgacgacgttgaaaagcttctcgctcaacagcctacagattacctgctcctgggtcagacccttgttaataacggtgctcttaccaatgctgagtttgaaaaggcacttaaagactataaggctgaaaatcagataaccgacgatatttcagacaatcaaacagaaactctacataaccttatcaatgagttctatcattttgacaatgatgaaaatgctcgtatctgtactgattatgttactttgcttttcaaaaatcttatcagatttatcggtgacgatttcactcctatggaagcgtcagttataaagaattttgcagcagaacatatcgttatccaaaaaataaatggaaaatataacgctgaggcttgcattgccacagattcaaagacatatatggctttcgctgagaggtttgcaaaagagagcttcacggaggtcgatgactttgtaaacgctacagcaggcgaatttctgaacgtaaacgacggtctgttcgttgtaaatgagtcaaacgagcatggcgttgagcttacactcacaccgcaggaatttttggaaaatggtgagcttgccctgtcaggcactgcattctgtatccctgtgaactatccgttcggcaagctgaatttcatcattgccacctgatataattttacaagcacataatatccgccgctgtccagctttgttcagcggcgttgatgttctttgcctttttttataactttttttcaaaaacacttgaaatttcattggaagtatgttataatagtaaggtaacaaaagttagattgatatgattcagttattgttcctcatcaatccgagatataggtgtgcgggtcctgtgcaatgaaacgctgtgaaccatgtcaggcggggaaccgagcagcattaagcggtttgtttcgtgtgtcacagttccgcccgcacgcccatatgtcggattgatttttttattttcttgattggagtgagagttttgtatcaggcattgtacagaaaatggcgtccaatgtcatttgacgatgttgtttcacaaccgcatattacaactactctcaaaaatcagataaaaagcggcaagaccgctcatgcctatcttttcacaggctcgagaggtacgggaaagaccacctgcgcaagaatttttgcaaaggctatcaattgccttgacccacatgacggtgagccatgccttgaatgtgagatatgcaaagacgctgacaacggcactctttccgatattatcgagattgacgctgcttcaaattctaaagtagacgatatcagagaactgcgtgaaggcgttgtctatactcctgaaaggtgtaaatataaggtatatatcatagatgaggtgcatatgctttccgcgggcgcattcaatgccctgctgaaaactatggaagaacctcctccgcatgtgaagtttattcttgccactacggagatacataaagttcctgcaactatcgtgtcgagatgccagcatttcgactttcacaggataagaaacgaggatatcgtttcaaggcttatgtatattgcttctcaggagggctttaccctccacgaagatgccgcaggcatgatagcaaggctttctgacggtggtatgcgtgacgcactttctcttttagaccagtgcgttgcctatgaaaatgacatcacccttgacgttgtgtcctcagcttccggcattgcaggacgtgattatctttttgatattctcgaaaagatagccgaaaaggacgccgcaggcgcactcagggtcgttgacaagctttatgatatgtcaaaagatctgaaagtcctggcaggtgaactgctcgctcagatgagaaatgtcatgataatcaaaactatcgacaacaacaaggatctaataacttgtctgcctgacgagtatgaaagacttaaagcccttgcagaacgcatgaagcttgacgagatactcggggatataaatactttgcaggagtgcagcgagcgttttgcaaaaagcacatcaaagcgtatcgagcttgaaatgtgtatcataaagctgtgcggagctgctcaaaaagcaggtgcaactgtgccggctgcatcaggcaatgctgagatcacagtgcttcttaatagaataactcagcttgagaatgcactaaaaagtggtgccgttttgcagactcaaccgcagatcgccactccagttcagcaggaacaagctcccccacaaaagccttttgacccggatttcaagaaaatgaaagcaagcgacttcaagcttgtgcagacttgggacaacattgtggagcaggtcaagcagacaaatcctgccataggctgtttcttagtcaattcaaaggcttatatgtgtcagaatgtgttgcttatgatagtacacaatgacttttatctcaaaaagttcaaagcaagcggcgatgctacggtgcttaatgagatactgaaaaataatttcggacaaaacttcactatcaaagtcaaatcagccaaaaatgtcgcacctgaggatacggaaaatcctataaatcagttgcttgacaaagcgaaaaaacttgatattgaagttgatataaaaaaataattttgaatataaggagtttttaaaatgaaagcaagacttccacagggaatgggcaagggtccttccaataacatgaatcagatgctcaagcaggctcaaaaaatgcaggacgagatcacagctcttcaggcagaccttgagcagagagagtttacaggtacagcaggcggcggagttgttgaggtaactatcaacggcaagagaaacgtccttaagcttgacatcaagcctgaggtagttgatccagaggacgttgaaacacttcaggacctcgttatggcagctttcaatcaggctgttgctaacctcgatgaagtaagcgacactgaaatgcagaaactcacaggcggagtatcattcccaggtctgttttaatggctgagtcaaacgcactgcctttggtacttctggcagagcaatttgcaaagctccctggtataggcatgaagtccgcacagcgccttgcctactatgtcatgtccatgacagacgaggacgcatcggcttttgcagcggctatcactaatgcccacaaaagcgttcatctttgcagcgtttgccagaactttactgacaagccaaagtgtcctatttgtgccgacccaagacgtgaccacacaacggtctgcgtagtagaagacccaaaggatatagcagctttcgagcgtactaaggagtacaaaggtgtttaccatgttttgcatggacttctctcccctatggacaacatttcccctgataagcttaaaataaaagaactgcttgcgaggatagagcctgagaatgttaaagaagtcattatggctactaatcctacagttaatggcgaagctacggcaatttacatttcaaggctgctgaaaccccttggtgtaaaggtcacacgtttggcgttcggtctacccgttggcggagtgcttgaatatgctgatgaagtgacgctttacaaggctttggaaaatcgaaacgaaatataaggaaaacctccccgaactattcggagaggttttttttacgtctaagatttttgaaaaattccgtcagtgtatctgcacaccgctcttgcagtataccgcctgtgcaaagaggtttgtgattatagggtagctcaaaaagatttaccaccgacccgcaagaaccagccttttggtcatacgcaccaaaaaccacacgctcaattcgagaatttattatcgcacccgtacacataggacaaggctcgagagtaacaaaaagctcacaacccataagccgccagcccccaagattgcgactcgcttcctcaatagccacaagttcggcatgagtcaagggggaacgcccatactcacgacgattgaatcccctgccgattatttcaccgctagaacgcttcacaactatcgcacccacaggtacttccccctgctctgcggcaatttccgcaagctccaacgcttttttcatgtaaagctcatctcttgtcatattatcctcgcacacacaaacatggtcacaagaattgcagctatccacactgcgatcgagttagttgcaatgaaagatttaactcgctttgacatcgtcataaaggaattatcattttcaatgttgaatgtccagtcaccaaagcttgtaagcttcgagtacatcacaagtgatacaccaacgatcactgtacatattatgacttctgctattttggcataaggaagatcatagagaacaatgtaacttaatacaaaattcgtgatgtgggcgcaaatactcattgaaattgcagtaaaaaccgatcctgttcgtatagtaaaaagtccaagaaccgcagtacagcatacaacaaaaggcagatatgtaatatcatagtagcataaaccgttcacaacagcagtgatcataatagcgaaggtgtcgccaaattgacgaaaagtctgcaaaaaaactcctcgaaatactatctcttgcattataggaacaataatcgcaaagaaagcaaatgaaacaagagctacaacaggatcttcagagaatacaaaaatagaatatatcccgtctaaatgcacagctgaaaacagcagactaaggatatattgtccaactctgcccacaacgattatgaccatcataataaccacagcagttccacgcattttttcgtagccctttgaatttgcaaaaacgactttattagggatcttagtaacgatcttaaaaataagaccaggcacaacaaactttgcggcaaacaacagacctaaaataaaagtcattccaacaccatatctgccatatccgccatccgtttgagaaaaatacacaaatgtaccagttgtatccggcgcgtatttattcactataaaatagttaagaaaatcaatagcaagcattaccacaagacaaatgcccaacaaactacagcattttagcatagagatcctctctgcaacctctgccttatgaggcacaaaaccctcgccatcaatgtatgagtgttctcttgtatcatgtataaactggaatccaaaagaattctgaggatttgaacgccactttgcaaacgacttcttataatcatcactctgattttgataagtggtatcctgggcaacgtcaatcatataatctttagtatttgtatcgttcaaattctcacctccgatatactaattatagcatatcaccgtacttttttaaagcatgcaaatatcatttaacttattattcataatattttaagacaaaaaaagatcggatacatattgtacccgatctttatatagcgaactaaaaattagtctctaacagctgtaacgacgccagaacctactgttctaccaccctcacggatagcgaaacgaagtccctcttcgatagcgattggagtgataagctcaacatccatctctacgttatcgccaggcatgcacatttccttgtcagcaggaagtgtgataacgcctgtaacgtcagttgttctgaaatagaactgtggtctgtagttgttgaagaatggagtatgacggccgccctcttccttcttcagaacgtaaacctgacctgagaactttgtgtatgggtgaatggaacctggcttacaaagaacctggcctctctgaatgtcagatctctggataccacggagaagcgcaccgatgttatcgcctgcctcagcgtagtcaaggatctttctgaacatctcgatacctgttacaacagtctttggtctctcagttgaaagtccgaggatctcaacttcgtcaccagtcttgagctgacctctttcaactctaccagtagcaactgtaccacggcctgtgattgtgaatacgtcctcaacaggcatcaggaatgggagatcagactttctgtctggtgttgggatgaatgtgtcaacagcgtccataaggtcaaggattggcttgtaagctggatctgaaagatcatctggagcttcaagagctgcaagagctgaacccttaatgattggagtctcgtcgccagggaaatcgtacttgtcgaggagctctctgatatccatctcaacgagatcaagaagctcttcatcgtcaacctggtcagccttgttcatgaaaacaacgatagctggaacgcctacctgtctagcaaggagaaggtgctctcttgtctgagccataggaccgtcagaagcagcaactacgaggatagcgccgtccatctgagcagcaccagtgatcatgttctttacatagtcagcgtggcctgggcagtcaacgtgagcatagtgacggttctttgtctcatactcaacgtgagctgtgttgattgtaattcctctctctctctcctctggagctgagtcgatgttgttgtaatccttcttctcagcaagaccttcaagagcaagagtctttgtgatagcagcagtaagagttgtcttaccgtggtcaacgtgaccgattgtaccaatgttaacgtgtggtttggttctttcgaaatgtgcctttgccataggaattttcctccttaaaatttaatagtttccgatttaacataccgtagtataattatatcaaataaaatgcaaatttgcaatagaaaaagcagaaaattttccgcaaatttattagtccttgtttcttgaagccatgatcttctcagagatagactttggtacctgaatgtagctgtcaggctccattgtgtactgtccacgaccctgtgtcttagaacgcaggtcatttgagtaaccaaacatttcagacagtggaacgagagcatctacctgaacagcaccagttctctgctcctgaccgaggatctgtccacgacgggagttgaggtcgcctataactgttccgagataatcatcaggagcgataacgcaaaccttcatgataggctcaagaatgattggtgaagcctttctcatagcctccttgaacgccatagaaccggcgatcttaaatgccatttcagaagaatcgacttcgtgataagatccatcgtacagctcaaccttaacgtcaactacctggaagcctgcgagaacgccgttctccatagcacccctgatacctgcatcaactgctggaatgtattccttaggaatagcaccgccgacaaccttgttgataaactcatagcccttaccggactcatttggctcaacgttgatcttaacgtgaccgtactgacccttaccacctgactgcttagcgtacttgtaatcaacgcttgcaggagcagtgattgtttccttatatgaaacctgaggagcgccgacattagcctctaccttgaactcacggagaagtctgtctacgatgatctcaaggtgcagctcgcccattccggcgataattgtctgacctgtttcctcagaagtataagttctgaatgttgggtcctcttcagcaagctttgcaagagcgatacccatcttttcctgacctgccttagtcttaggctcaatagcgagctggataacaggctcagggaattccattgactcaagaagtacagggtgctcttcatcacaaagagtgtcacctgttgttgtgttcttcagaccgatagcggcaccgatatcaccagcgtagatagtatcgatatcctttctagcgttagagtgcatctgaacgattcttccgattctctcgtccttgtccttagtggagttataaactgtagaaccggctgtcagaacacctgaataaactctgaagtagcagagctttccaacgaatgggtctgtagcgatcttgaatgcgagagcagcaaatggctgatcgtcgcctgaaattctctcaacttcctcacctgtatttacgtcagtacccttgatgtgtggtacgtcgataggtgaaggcatataatctacaatagcgtcaagaagcttctgaacgcccttgtttctgtatgaagttccgcaggtaacaggtaccattgtgttagcgatagtactctttctgattaccttcttcatctcgtcgatagtgatctcttcgtctgcgaaatacttctcagcgagatcgtcatcaacttctgcaagatgctcgataaggtcagcgtgatactgttcagccttttccttaaggtcctcaggaatctcttcctgacggatatcctttccaaggtcatcatagtatacataagccttcatttcgagcagatcgacgatacccttgaagtcgtcctcagcaccgatagggagctggataggaacggcgttacaatgaagtctttcatggagcatattcaaaacgttgtagaagtttgcacccatgatatccatcttgttgacatataccattcttggtacctgatagttatcagcctgtctccaaactgtttcagtctgaggctcaacaccacccttagcacaaagaactgttacagaaccgtcgagtacacgaagtgaacgctcaacctcaactgtaaagtcaacgtggcctggagtatctataatgttgagtctgtgacccttccagtagcaagtagtagcagcagaagtaattgtgatacctctctccttctcctgtgccatccagtccattgtagatgcaccgtcgtgtgtttcaccgatcttatagtttacaccggtataaaacaggatacgctctgtagtagtagtcttgccggcgtcaatgtgtgccatgataccgatattacggtaatcctgcaatttacattctcttgccatatatatcctcctttatacctcttaccatctgtaatgagcgaaagccttgttagcttcagccatcttatgagtttcgtcacgcttcttgcatgagccgccaacgccgttaagagcgtcgaggatctctgctgcgagtctctctctcattgtgtcctcgtttctttcacgagaatactttgttatccatctcagaccaagtgtctgtcttctgtcaggacgaacctccattggtacctggtaagtcgcaccgcctacacggcgagccttgacctccagctcaggcatgatgttatccatagcctcctggaatacttcaagagcaggtctgcctgtcttttcttcgacaatttcaaatgctccgtaaacgatcttctgggcaacacccttcttaccgtcaagcatgatgttgtttacaagacgtgtaacaagcttagaattgtatactggatcctgaagcacgtctctctttgtaactctacctcttcttggcactttaattccctccttcacaaataatgaattcacaggtactcgctctgtaaccacggcatacagccgttttacagccccgtcagttccttgtagagtcaactaatatatattaatcactccacataaactgtggtcttcgcaatatgcgacaatgagttattaccttgttactaaaatgagcttttcagtttttgattacttggctgctcctgcctttggcttcttagcgccatacttggatctcgcctgcattctcttagcaacgccctgagcgtcaagagtgcctctgatgatgtgatatcttacaccagggaggtccttaacacgtccgcctctgataagaacaacggagtgctcctgaagattgtgtccgataccaggaatgtaagctgtaacttcgtttccgtttgtgagcttaactctggcaacctttctcatagctgagtttggctttttaggtgtagcagttcttactactgtgcaaacgccacgcttctgtgggcagctctgatcgataactaccttcttctttgagttgaaacccttctgaagagcaggagctgtagacttgtctgcaaggacatttcttccttttcttactaactggttaaaggttggcatattttctctcctttcatagatttgatactatacgctgatatacaatacatcagcataccttgatattatacactattctccgtctcttgtcaagcactttttcttgacttttttaactttttgaaaatttcagttaaattttctgtcaaaagctataaaaagcacagggcagcggcttttcacgccctgccctgcaaatatattccctcattccgtcttgctgtctgtatctaaaatttctcctttatccgccacttcgacctctgtctcgctgaatctatgataagttataacacaatcgctgtcgtcagtcttgtccgaataggttatatcgttttgtacttcgttgatataaagtttcagatcatcactaaaataggtgtttgcacccgttgcaaatttaattgcaacgagccattcattttcatcaaagaagtaatttctgttgttctttaccgtcgcactttcggaaccgtaccattcattattagtatcgtcctgctccacaatatccttataattggaagttatactgaaatatcttccgtccaccttgataattatgccttcctttgaccctcctgctgtggaaacgtttatggctttacccttttcaattggtgttattatcatcggatagataatatccctttcgtaattgtcagcatcataattgatatgcttaacagaatttaccagcgtatcaattttaaatccccagtccttttcaacaggatttagcacaatgctgaagtcgtcagcttgcagtatcatatcttcgtatatatgctgtacactatcaagaatgagcttatcaagcttttccttgcctgtatcctttgaactgtcgatatcataagcataggctattgatgatctaagtgaataatagaagtctgttccaaagctgtcgccaccgaccgtttcgccaagacctgttgcgatctcatccgagttccaattactcagattatcgcagtttgtgccgactgcgattttttcgcccactttcagttcgtccgcataaacaaacttccctgtggtaacatctttcgctctgaaatcaagtttaaacgcagcgtaatagtggtatttcaggtattcatattcattcacagtaacatagtcgatcaatccgcccttttcagaggtgtatttctcaacatatatcttatcgacaaaaagatatcccgttccgtccgagccgcagccggcatacgttccgaccgccgttatctctttgtctttaacgacctgcttaagcgcattttgtgcctgttctaaatcagccgtaagctcagtgctgtcaaggctttccgaactgtctatacttggctgctgcataccgacattgatcttatgctcatcaccgctgcgataaagggtcagcgcaccgcccaccaccagaagcaaagccgcaagcaccgcacctgcaagctgaaagcctgtaagttttgttttatttttctctgtaggcttgtcatacataagcacactctccttccaatccgaaggagtttttatacagtaaaaagcatttatctttttcatttgctgcccctttctgtgatatcctcattgcaaactataccttcagtcaatgttatgctgaaagtccagccccaacataatagtttttacctcttttgtaggggagcggctcaatttctgtttcacagaaatgcgacgtcccaatgccctagttttttattgacattcatatagttcacaacattatcatatccttcagttgttctcttccacgtttgagatgtgtttttatcgtgttttccttgatatttgtcagcttagctatctcctgcactgacagctcctcaaagtaataaagataaatactatcccgatatttcgggggaagtctgaaaataaggtcaagtatctctatgtcgctgccgtcctttgagaaagacgttatgctgttcaaatcgactgtgtttttcctcaaacgataccgcaaaacactccggcattcgttgagagccactctgatgagccacgctttcgggtttggcagactgccttttttcatctgcttgaaaagcttgaagaacacgttctgatagcagtcctcagcgtcggaaaaatttcccgtgtgcaccacgcaaagccttgttaccatatccgaatactcctctacaagttggcggtattcgctttcggtcatattcttcatgctttcacttcccttcatatactaaaacgccgtggcaggcaaaaaggtttcacgcaaaataaaaaaatcagcccgcatgaatgaaccatgcaggctgatataaaagtcattagtacaacggtgtttctgcggtgttatggttagccgcactctcattcttgaccacctgaacgttgttgtaaacgtccataccggtgccggcaggaatgagcttaccgataataacattttccttaagacccatgagcttatcggtcttgcctctgatagctgcgtctgtaagagccttagttgtctcctggaatgaagcagccgacaggaatgaatccgagtagcttgaagcctttgtgataccctgaagaacaggaacagttgtgataagtcttgcgttctcgtcgccagcgtcgatctgagcctgtatctcctcgttgagtcttgcgacctctcctctgtcgataagtgaaccagggagcagatagcttgaaccggagtcgtcgatcttgacctttctcatcatctgacgaacgataacttcgatgtgcttatcgttgatatcaacaccctgcagacggtaaaccttctgaacttcggtgatgatgtagttctgaacagccttaggaccactaactgcaaggatatcagctgggttgatagaaccctctgtgagcggctcaccggctgtaacagcctgtccctcacgaactcttatcttgtagccgtatgggatagcataagactcctgctcaggattttcagtgtcctcgcttgtaacagtgatctgcttggtcttcttgacttcctcgatcctaactacgccgtcgatccttgtgatgatagcagcaccctttggacgtctgctctcaaacagttcctcgactctaggaagaccctgtgtgatatcttccgcagaagcgataccacctgtgtggaaggttctcattgtaagctgtgtaccaggctcaccgatagactgagcggagattacaccgacagcctcaccgacctgaacgatatttccgtttgcaaggttagcgccgtagcacttagcgcaaacgccatgcttagcctgacactgaagaactgatctgatagagatagaatccttgccctcagcttcaagtgcagcaactattctttcagcgtcatgaacgtttatgagcttgtttcttgagcatatcatctcgcctgtcttaggatccttgagatcctcaacaaggtatctacccacaagtctctcgctgagaggctcgatcatttcgtttccgttctttatgtcgaatatctcgataccaacgtgagtaccgcagtcctcctgacgaatgataacgtcctgagaaacgtcaacaagacgtcttgtaaggtaacctgagtcagcagtacgcagagctgtatcggcaagtccctttctcgcacctctggaagaaatgaagtattccagaatgttaagaccttcacggtagttagctctgataggcatctcgattgttgaacctgatgtgttggcgataagtccacgcatacctgccagctgcctgatctggttgatagaaccacgggcacctgagtcagccatcatgttgattgggttatatgggtcaaggttagctttcagagcctctgtaacttcgtctgtagcgttgttccagatctcgatgaacttctttgacttctcttctcttgaaatataacctctcttgtactgcttgtctatcttgtcaacaagtccgtcagcctttgcaaggatatccttcttagcctcagggatagaagcgtcgcaaacagcaactgtgatagcagactttgtagaatacttataaccaaggctcttaatgttgtcgagaacttcggaagtagtagtagtaccgtgcttctggatacatttatcaatgatatcagaaagctgcttcttctttacaaggaagcttatctcaagatcgaactgcttttctgaatttgttctgtcaacaaagccaaggttctgaggaatgatagagttgaagataagtcttccgactgtagcgtctatcacctttgatacctgcttgtcgcctatctgcttggtaattcttaccttgatagcagcatgaagtgaaacgatgtgctgatcgtaagccataagagcctcgttcacatctctgaacaccttgccctcgccaggctcgccgtccttcttcagtgtcaggtagtaagaaccaagtatcatatcctgtgtaggaactgcaacagggcgtccgtctgaaggcttcaacaggttgttggcagccagcataaggaatcttgcctcagcctgagcctctgctgaaatcggcaggtgaacagccatctggtcgccgtcgaagtcagcgttgaacgctgtacaaaccagtgggtgaagcttgatagctctgccctctacaaggataggctcgaatgcctgaataccaagtctgtgaagtgtaggcgcacggttgagcattacagggtgaccctgaataacgttttcaagtgcgtcccaaacctctggctcagctctgtctacctttttccttgcagacttgatgttgatagtaggattggtgtcaacaagtcttttcataacgaaaggcttgaacagctcaagagccatttcctttggcagaccgcactgatacatcttaagctcagggcctacgacgataacagaacgtcctgaatagtcaacacgcttaccaagaaggttctgtctgaaacgtccctgcttacctttgagcatatctgaaagtgacttgtatgctctgttgttaggacctgtaacaggtctgccgtgtctgccgttgtcgataagtgcgtcaacagcttcctgaagcattctcttttcgtttctaacgatgatgtccggtgcttcaagctccagcattttcttaagacggttatttctgttgataacacgtctgtaaaggtcattaaggtcgctggttgcgtatcttccgccgtccagcagtaccataggtctgatatcaggtggtataacaggtatagcctccagtatcatccactcaggtctgttgcctgatgttctgaaagcctcaacgatctccagtcttttcagaagcttgatacgcttctgacccgcaggaagatccttaagctcagttttaagctcttctgaaagcttatcgaggtcgatctcttcaagaagctccttgatagcctcagcgcccatgccggctctgaactcgtcctcgtcatacttttcctgcatttcgctataatccttttcagtaaggagctgacccttgataagctcagtgttacctggatctataacgatgtattttgtgaagtaaagaacttcttcaagtcttttctgtgatatttcaagcatctgtcctattcttgacggagttcccttgaaataccaaatgtgagaaacaggtgcagcaagctcgatgtgacccattctctctctacgaaccttggctcttgttacctcaacgccgcagcgctcgcagactttgcctttaaagcgaattttcttatatttaccgcagtgacactcccagtcctttgaaggtccgaatatcttttcgcagaacaatccgtccttttccggcttctgagtacgatagtttattgtttcaggtctggtaacaacgccgtaagaccactcacggatcttctgaggcgaagcaagaccgatcttgattgatgcaaactcattgaattccaacagcagtaccctcttcctgtttagtttgaagcacggcaacagccgacttctatatgaaacggtcgcaggggcggagccttccgccctttgacctcagcttatttagttactgtgcaaaattattcaccgtcattaaggaacagatcagactcgtcggaagctgcgctgccctccagttcggaagtgccgttctcgtcttcagccatgaagccctcgtcgagatcgccctcgtcaacgccgaaatcgatatgatcttcgatagcaggctgtggaacaagctcctcgtcctcatcaaacgactgcttaagatctatttcctcgttattgatgttgagtaccttgagatccagaccaagtgactgaagctccttaacaagtaccttgaacgcctcaggaacaccaggcttaggaacattctgtcccttaacgatagcctcgtatgtcttgactcttcccacagtatcgtcagacttaactgtaaggatctcctgaagtgtgtaagcagcaccgtaagcttcgagcgcccaaacttccatttctccgaatctctgaccaccgaactgagccttaccgccgagtggctgctgtgttaccagtgaataaggaccaactgaacgtgcgtgtatcttatcgtctacgaggtggtggagcttcaggtagtacatataaccgactgtaactctgttatcgaacttctcgcctgttcttccgtcataaacagtgaacttgccgtcctcgctcatgctcagagcgttagggttgatgacctcgtccattgtgtggagagtgaactcatcgtccttatgctccagataattctgctgagccattttgaagcattctctgatgtctgcctcgtgagcaccgtcgaatacaggggtcattatcttccagccaagagcctttgctgccataccaagatgaacctcaagcacctgaccgatgttcatacgagaaggtacgcccaatgggttaagacagatatcaagcggagtaccgtcctcaaggaatggcatatcctcctgtgggagtattcttgaaacgacacccttgttaccgtgacgacccgccatcttatcgcccacggagatctttctcttctgtgcgatgtagcatctgacgagcatatttactccaggagaaagctcgtcgcagttctctcttgtgaatatcttaacatcaatgatagtaccggcctcgccgtgaggtaccttaagagaattatctctaacttctctagccttttcgccgaagatagctctcagaagtctttcttctgctgtcagctcagtttcacccttaggtgttaccttaccaacaagtatatctcctgagcgaacctctgcgcctattctgatgataccgttctcgtccagatccttaagagcgtcctcgccaacgttagggatatctcttgtgatctcctcaggtccgagcttagtatctctggcttctgtctcatactcttcaatatggatagaagtgtacttatcctgctttacaaggttttcgttcagaagaacggcgtcctcgtagttgtaaccttcccaagtcatgaagccgataagagcgttcttaccaagtgaaagctcgccgtttgaggtagcagggccgtcaccgattatctgattagcttcaattctctcgcccttgttgacgataggtctctggtttgtgcaagtacctgcgtttgaacgcttgaacttagtcagctcataagttctgagcataccgctgtcctcacggataacgatcttgtcagcgtcaacgctctcaacaacacctgcgttcttagaaacaacagcaacgcctgaatcaagacaagccttgtattccataccagtaccgacgataggagactcagtcttgagcagcggcacagcctgtctctgcatgtttgaacccatgagcgcacggttagcgtcatcgttctcaaggaacgggatacaagcagtagccacagaaactaccattttaggtgaaacgtccatgaagtcgatcttctctctctctatctcgaggatctgatctctgtatctgccgtttaccttaggtctggcaaacttgttatcctcagtaagaggctcgtttgcctgagcgaccatgtagttatcttcaacgtcagccgtcatataaacaacttcgtcagttacaacgcctgtttccttgttaacacgtctgtaaggagcttcgataaagccgtactcgtttatccttgcgaaagaagcaaggtaagagataagtccgatgttaggaccttcaggcgtctcgataggacacattctgccgtagtgagtatagtgaacgtcacggacctcaaatccggcacggtctcttgaaagaccgccagggccgagggctgaaagtcttctcttatgagtaagctcagccagagggttgttctgatccatgaactgtgacagtggagaagaaccgaagaactctctgatagccgcagtgataggtcttatattgataagagctgtaggagtaacgacctcagtgccctgtgactgaatgttcattctctcacggataactctttccattcttgtgaaaccgatcctgaactggttctgaagaagctcgcctactgaacggattcttctgttgccaagatggtcgatatcgtcaacagtaccaacgccctcgcaaaggttgaggaagtaagaaaccgtagcgataatatcatcgatagtgatgtgctttggaacgaggtcgtcagccttaagtctgatgttctccttaagctcttcctcattctcagaatcttcaagaatttctttgagagccttgaaagataccttttcgttgatgccaagctcagtgcagtcaaaatcaacataagcgttgatgtctaccatgccgttgcctatgatcttaacttcgcactcttcaagctttgtaacagcctcgcctgttgcggaagtaagatgctcctttacctcaacgtcaacgtaagcctccataacacctgcggtctcgatctccatagccttatcaaagctgataagatcgccagcctcagccattacctcgcctgtcataggatttacaacaggtcttgaaagtctgtgacctgaaagtcttgaaccaacgccaagcttcttgttgtacttatatctgccaaatcttgaaagatcatatctcttagcgtcaaagaacaggttattcaggtgagtaacagcagaatctactgtaggaggctcgcccggacggagcttcttgtaaacttcaagaagagcttcctctctgttagcagtctgatccttctgcatgatagtctgagtaagtctttcatcaggaccgaaaacttcctcgatctcctcgttagtaccaatacccagcgatctcaggaaagtagtaagagggatctttctgtttttatcgattctgacataaaccacgtcgttagaatccatttcatattcaagccaagcacctctgttagggataacagttgtcttgaacagatccttaccggtcttgtccttatcaaaagcgtaataaacacctggtgaacgcaccaactgagaaacgataacacgctctgcaccgttgataacaaaagttccgctgtcggtcattttagggaagtcacccataaatacctcggactccttgatctcgccggtctcggtattgttaagtcttgcagtaactctcagtggcactgcataagttacatctctcgccttgcactctgcaacagaatacttagcctcttcatcaaaatggtatccaacaaaagtcagctccagcgtaccattataatcagtaatagctgaaacatctctgaagacctccttcagaccttcatcgaggaaccactgataagagttcttctgcacttcaataaggttaggcatctccagaacctcattgatcttggcaaagctctttctcgtgttcttaccaagttttacgtccttgacattcaccataggctcaatcactccttaatttatttggaaaatacatttatataatactatataacaatcgtattcgccagtggttttggcggtgttttccatgattttctgctctcaaaaacgcatgaaataggtggaaaactccattatgatacagtatactattatataatattagcaagcccttgtcaagcattttagcttacacatctcgccgattttcctattttctccgatttgaacaaaaatcgcacaattcgacgcagaaacttctactattaccaatgtgttatcagactgtaaatttttcgctttcttacctgcttttatcaccctccgcctcattacctccgccctaacctaccctttatttcatcactatctgcaccaacttgtctgccattacataataattccgatttacttgtcatatccaacaaaaaatcacttaacaaattgtgcaaacaaatgatttatattttaatttggcaacatttttgcaattgttgcattttttatgcaacaaaaagggtacttttcgtgtataagtagaaagcgttttgatacttgcgggcacgtacaagccctgcgacttagtgaatacgatgagagattctggaacaggctgtagagaacttgtgtcaaagcgtgggtgtgcattgcggtattttgtgtatacgcaaccaagggcattatactcggtgacacacgccgaacgcaacttgaaaattgaatatagattggacaaaattacggcaacaaatctgtaggggcgacctctggtcgcctgacaagccttgcgttatccgtacaacatacgtcaacaatgtgtgttatccccaacaacatttatgttttcacaaaccatgtaggggacggcgcccccgacgtcccgacccctcaacgtttcgcattgcattattgtttatcccacaaaccatgacaacccctacagttatttgggatagtttattcctccgcaaaatcgcttcgctctttgcgtatctacgttttgctatgggatagaaatgcggtgcagatttaattctccgatatcactttcatctaatatctgacttctatatgctatttttcattaaatctgcacctaatcggcttgcgccgaatgaggctctgcctcaaactccgctaggggctttgcccctagaccccacaagccctctagcgccgggcttgagcgtgcgctttatctctcgcttcgctcggtgctttattttactttatgcttgcaattaactttggtctgctttgcccattcctcattcctcattcctcattcctcactcctcacttaaactccgctcctattaaaaacttacccttgattattcccccaaaaagtgctatactattgataagtaaaattgcatgaaatcctaaccctaaggaggtaaatttctatgaattgtactcatttcaaaagctactatccgtccgctgacggacttcataagatcgcgtattacgttcgtttccctatcggcacagtaagaggtgtcgttcagatatcccacggtatgtgcgaatatttcagacgttatgacgacctcgctgagtttctcacaggcttaggcttcgcagtatgcggaaacgaccacctcggtcatggcgacagtgtgaacgacagctccgagcttggctacttctcccctgaacatggctgggaaaacgctgtcgaggatatgtatactctcacaaaaatgatgaaacacaactaccctgacaaaccgtattttcttctcggtcacagcatgggaagcttccttgcaagagcttttgtcaccaagcatggcagaaacctcacagcggctatcttctgcggaacgagcggcggcatggagggtatccctgctttgctcacccttgttgacagcctgaaaatactccatggtgataaatataggagcaacgctgtaaataagcttgctttcggtgcttatacaagaaaaattaccgataaggtcagcgaatatgattggatatcccgtgaccctgaaatagtttccacctacgaaaaagaccctaaatgcaactttattttcaccctaaacggctttgaaaatcttgcaaagcttttgtggtatgtttcaaacgaaaagtggttctccacctatccgaaaactttgcctacctatcttatagcaggcagtgccgaccctgtgggaaactacggaaaaggcgtactaagcgtgttcaacaggctgtccctcaacggctgtgacgttgagatgaagatatacgaaaatgcacgtcacgagcttgtgaatgaaaccaaccgccgtgaggtgtataatgatattgcagattttctgctcgatatcataagctctgaaatgtgttcagattaagctgtaagggagagaattcaacgtgtttgctgtagtaaacagtgtaggtctgctggggcttaacgcctttgcggtcaaggtggagatagaagcttcaaagggtctgccatctttcgatattgtagggcttgcagacgcatctgtaaaagaaagccgtgaacgtgtgcgttctgcactgcgttcaagcgagataacattgcctctgagaaaaataatcataaatcttgcacctgccgatgtgagaaaaacaggctcggtctatgacttagccgtggcagttgcactcttgcgaatggctgaccttgttgatgacagtatgctttctacctccgcttttatcggagagctttctctcagcggagaagtaagacctgttcagggcgttttgcctatgaccataatggcgcagaaaatgggactttctgagatatatgttcctgccgacaatgttcgtgaagcttccgttgtggagggtataaaagcctatggcgtaaggtctttgcgggagcttgtttttcactttgagaaaaaggcggcaatagttcctgcggcacattataagcccaccgctgaaagctatttcggaagtcttgattttgccgacgtaaaaggacaatcagcggcaaaaaaagcattggaggtcgcagcggcaggcggtcacaacgttcttatgataggttcgcctggctcaggaaaatcaatgcttgcaaaacgtatgccgtcgatacttcctgccatgacctttgaggagtccatagaaaccacaaatatccattctgtggcaggacttttggacagcaacagtcctcttatcaccgccagacctttccgttcaccgcatcatacagtttcaccggcaggactttcaggcggaggctctgtgccaaagcctggtgagatatcccttgcacataacggcttgctttttcttgacgagcttgcagagttttcacgccctgcccttgagatcttacgtcagcctttggaggacaggcaggtgaccatatccagagtgtcaggttcgataacatacccatgttcgttcatgcttatcgctgcaatgaatccttgtccatgcggatattttggtcaccctacaagaaagtgcatatgctctccgaaacaagtttcaagctatctttccaaagtcagcggaccacttctcgaccgtttcgacattcatttggaggtcgcacctgttgagtttgcagatctttcttccaccgccaaagaggagtcctcagcgtccataagagagcgtgttcaaaaagcccgtgacatacaaaacgagcgtttcaaaagcactagcataacctgcaacgcacgaataacctctgatattcttcacgaggtctgccctgtgacagatgaggcttcaaagcttttggagaacgtttttgacaggctgggactttcagcaagagcctatgaccgcatacttaaagtcgcacgaactgttgcggatatggacggtgcaaaggtcatagacaaaaagcatatcgcaatggctgttcagtatcgaagccttgacagaaaatattggaatgggtgatatgtgcatcacataaaagctgacaggaaacgggcgaacactgttcgcccctactatggtgtattcaaatacatatgataattgcagacggtttttattccgtctgtttttttgtgcaaaaaagtacgggaacgcccgaaacattcccgtactgtccttatcacaattctataattatcccttaaaaattctattccaaaaaaatcaatctgccactgcgttctttgcgataacgtctgcaacaagatttgcaggaagcggctcgtaacgtgctttttcaaaagtgaacacgccctgaccctgtgtcatttgtctcagaagcagtgtgaagtctgccatttcagccattggaacttccgcaactatctcggtcatgcccttcttttccgcaggattcatgcccagaactctgcctcttctcttattaagctcgcccatcatgtcgccagtgttatcgtcaggtacgaaaacgctcaaggagccgatcggttcgaggagaacaggctctgcctgacgcataccctctttgtatgcgatagaagctgccattttgaatgccatttctgagctgtcaacagggtgatatgagccgtccacaaggatagctttcaaacctactacagggaatcctgcgagaacgcctttctttacgctttcctgcaagcccttttctacggctgggaagaagttctttggaactgctccgccaaacaccttttcttcaaatacaagatcgtcagatacgcatggctcaaattctatccaaacgtcaccatactgaccgtgaccgcctgactgcttcttatgtctgccctgcaccttgactttctttctgatagtttcacgataggagatcttaggcacagaagtttctacttcaacaccgaatgttcctgaaagtctgcccacaacagaatcaaggtgaagtccgcccaaagtgcttagtatcatctcgtttgttgacgggtcgagcttgtaatctatagtaaggtcttcttccataagtcttgtcattgcagcggatatcttgctttcatcgccctgctttttagctcttactgccattttatagcatggcttagggaaggtcataggtgcaaacttaacaactcttgcggagtcacagatagtatcgttggtgttcacgttcatcttcattgcaacaacgatatctccacagcctgcttcagcaacgtctatctgctttttgccctgaagcgtaacaagctttccgaccttttcggtgcttcctgtggtagcgttcacaacttccttgttaggtgtaagctttcctgaaaataccttcatgtatgacatcttgccaacaaatgggtcagcaactgtcttgaatacaaatgcgctcatagggtcgctttcaacgcaagcgacctcaacagcttcgccgtctgctgtttcgcctatcatagcgtccttttctgacggaggcggaagcagtaggtcaatctccttaagaagcatatctacgcctgacaggtcagtagaagacacgcaggtaacaggagttataacccctgagttcataccgttgtggataccgtcgataagctctttctgagtgaacgcctcgcctgagaagaacttttcaaaaagcgcctcgtcagtttctgcaacggcttcggacacggcttcgataagtccgtcgatacgataacccattttctctgatacatcagctgtaggcatatcagtttcaactgccttgccgtcttcatacttatatgctttcatctcaatgagatttacataagaaactatctttctgtctgcgataacaggcacaacgacagggcaaactgtaggtccgaactctgctttgagctgagtaagaacgttattgaagtttgcgttatcgtcatcaagctttgttacaacgaacattgtaggcttgcccattttctttgcaaggtcataagccttgtgagtacctacacgaacgcctgatttacctgatacagtgatgagcacacaaccgcttgcggcaatgccctcaacagcttcgccctcataatcgaacataccgggagtatcaagaagatttaccttgaactcgccagtttccaaagaagaaagagatgtgtaaacagaacattttctctttatctcatcaggggtataatcagaaacagtgtttccgtcagttatcttgccgagcctgtcagtagctccgcttttatatagcagtgcctcagtcagagaggtctttccagaacctgcctgacctgcaatagcaatattttttatttttgtgctgtcgtattttttcaagttgatcgctccaatctatgccgttggacggcttaatgtgatatgcagtataattatatgtatcatttacacaaaatatatcaaccgcataagataattatatactattttcacataaatagcaagggcggaaagaaaaatttctttcgtgaatgtgaacaaagtttagacttgttataaagcagattgcacaagggcggaagaagtgaggagtgaggaattaggaattaggaatgaggaatgaggaattagcatagcagaccaaagaaaattacaagcataaagtaaaataaagcaccgggcgaagcgaacaagcggtagaaactatcccgaatatctgtagggtgtggttatcagagatgtgtgaatgcaaaaaagctccccgagcgtttcggagagcttttggttattttacccttatgataggctgaagctgtatcccatcaagagccgactgaatagtttcgggtatgagttcaaactcagccactatggagtttggcttcttttcgcagttgtcctgcgcatatggtacgaaatagtagtttctcagattttgcagataacctatgtttttagcacaccctgccagtgcgtcatttgtcgatatggcgatgaccacgggacgagcatttctcaggtgactttttaccgccatggtggctggagtgtccgtcaagccaagagcaagctttgctgccgtgtttgaggtgcagggtgctgctaccatgatatcacacatctttttcggtccgatcggctcggcttcttctatggtgcgtatgaccttgcggcctgctatggtttcaaggcgtttgatgttttcttccgctgtgccaaaacgtgtagatatagatgcggcgttgaaagacattattggcacaagctttgcgccctgctgaacaagccgttctgcggcggcaaatgccttttcaaaggtgcagaaggagccggtcatgcaaaagcctattcgtatgccgtcaagtgacattctttgttcccctttcattcaaaatgtccgtgactgttcgggcgattatctctcctgcagtcataggtgcggctttggctggaagtcccaatgcccataccacacgcctgttcagctttgcggcagtttcatgatctactccgccaggtcgggaggcaaggtctatgataagagagtttttatccattacgcgcaaaagcttttcatcaagtatcatggcagggacagtgtttattattatagtataccccgaaatattgtccgcaagagctgtgataagctccgccttatagcctgcgccctcggcttctgcaagcgcagaaagctttcttgcggatatagtcacatctgcgccgacagcccgaaaaagcttagcgcaggctttcgctactctgccatagccaataactaggacggtggaaccgttcacggtgacagcaagctcctgcatggctatttgcaaagcgccctccgccgtggggatacaatttcttataacaagctcctctcgcttatagtaatccttaacatcgaagccgagagaggagaaatattctatttgatcacgacggagcagaccgcctgccacaagtgcatttttctttaaatgcgttgaaacgtcactgcatgatacctttacattacggctagaagagatatccagcccgtcagctttcatgagaggaagtacgagaacgtccgccttttcggtgagctgatcgagatgagcgagggggatagtgtcctcgcctttatcgtccatgccgtaagtatagaccctgccgattttagtgagagtctgagctgtatatgtttgtcttgcgtcaccgccgacgcagaggaaaactgtttttttcatatggatacctcctgtgggactatgcctgatagagttatatataattatatgtatcggtaggctaaatgttaccggcaaaacaaaacgccctatccctgcaaagcaagaattgcggcgctttgatatgatatcatatttctatcttgataaacttcggctcgtgctttttgaaataggtcagatatttaaagcctgccgcctgcgccatttctacgcctgcggaaatgtctctgccgatatctgcggtgcagtgggcgtctgaacctatggtcaatatctcgccgccgagggctttgtagagcttcacatagtcaaggtccggaaggggcttgccgtatttttgccttaatcccgacacatttatctctatgcccttgcctttttggataagtgtacaaaaaatttctcttattatctcatcatagggggcgaggtctatttgtataccgcaatctccttggatatatcgcagaggataggtgaggtgtcctaaaacgtctaacttgccccatttgcacatttcaagcatttctttgaaatagtcgtcaagaagagcatagatttgcgacaagtccatatttttgtactctatccaataaaaatcgtccttgcctttattctgatgatgtgagccgatgataaaatcaaggcgtttgtcggaggttatctcttcggcaaattctatatcctgcaaaggctgaccaagctctattccgcagagaaaatttaaaacctccagatgctgggaagcttcatactgggcgactatgcttgcgggagcatactcccccgagccgtacatcatgccgtctttcagggcttcaggatcaccgtaatggtcggctttatagcggaaattgcaatcgcaatggtcagttatggcaaatgctgccaagccaagctctttggcttttgctaaagactgttctacagttccctcaccatcgggggaaaagcctgtgtgggtgtgcatatctataagagttttcataggttctcctatctgtacagaaatttgtacttatatagaattataaagcttttcaagctgttttgccgcttctgccgcacgtcttacaaagctgtcaggtgcagcattttggtacatggtggactttgacatataaagctctaatgacaatggtagctggtggtcgaggtttttgagctttctgagaaaattctcaaagttcaggttgccgtcaaacggtatcatgtgtccgtcggtgttgccgtcgttatcgtggatatgcaggcaggcaagcttgcttccaaacttcgtcaggcaatcggtattctttgagaaacaattctcatgacctgtgtcatagcaaaatttcacgttatcatggtttccaaaccggtcaaaaagcacgtcaagaaactgcgggagctggatattctcaaaggcgatatcgacgccgttttcttctccgcactgtattatcttggcgaaattctctataccgaaacgagatacttctggcggaacaagcccgtcagtggggtggcatatcatggtttttatgccgttttcaccgcacactcttacacattcaagtgttcgttggaggatatattcgctctctgggcatattgtccaaagggcgttcatgcggtcaaactgtgaatggacgttttctatttccagtccaaaatttcgtacaatatcatactgtgtgtattttagtccgtcagaaaagccaagcattacaccgtcaaagccgttctcttttataagtcttatacgctcctcaaagggtattttaaaggtgaagtctgcaaacatacagcgtttcaatctgttttcctccttaccaaaaacagcggcagaattgctctgccgccgtgtaaatttagtttttgagagaatggagtggtgcaggtatctgtccgccacgattgatgaacttggaaggtgactcttttttgagcggcataacaggtccgcagccaaaaagtccgccccaatcaagttcttcgccaacgcccttgccaatagcagggataactcttacggcggtggtcttattgtttaccataccgatagcagcttcgtctgcgatgatagcggaaatagtatcggctggggtatcgcccggaatacatatcatatcaagaccaactgaacatacagcagtcatagcttcaagtttttcaatgcagagcgcaccgctctttgcggcatcgatcatgcctgcgtcctcagaaacagggataaatgcacctgaaagtccgcctattcttgagcaagccattacgccgccctttttaactgcgtcattgagcagggcgagggctgctgttgtgccatgtgtaccgcacttttcaagacctatttcctcgaggatatgggcaacagagtcgcctacggctggagttggtgcgagtgaaaggtcaacgataccgaatggaacgccaagacgcttggaagcgatagttccaacgagctgacctactcttgttatcttatatgagatctccttgataacatcggatatctttgtgatatcagcgtcaggatattttctcagggctgctcttacaacgccaggacctgatacgcccacgtttatcatgcaatcaggctcgccaactccgtggaaagcacctgccatgaacgggttatcctcaactgcgttacagaaaacaacgagttttgctgcgccaaagcaggcagagtcaactgttctttctgcacactctcttacaacgccacccatcattttgcaggcgtccagattgatacctgtttttgttgaaccgatatttacagaggaacatactctctcggtagtagcaagtgcctctgggatagacttgataagctcgatatcgcctgcggagaagccctttggaacgagggctgtatatccgccgataaggtttacgccaacgtcctttgcggctctgtccatagcgtgtgcgaatggaacaggtgaacacttgcaggcagcagacacgatagcgataggggtaacggaaattctcttatttatgatcgggattccaagctccttttctatctgctcgcccacctcaacaagtcttgcggcttttgcggttatcttcttatagacattctcgcaggcaacgtttatatcgctgtcgatacaatcaagcagagaaatgcccattgtgatagtacgaatatcaagacaatcgtcctgtatcattcgtatcgtttccaacacgtcatatgtattaatcattttacagaaatctcctctttagatatggtgcatacagttaaaaatatcctcgtgcatcgtatggatctttacacccattgtctgaccaagctctgtaagtccgtctgccatggtagcaaaatcggagttgagctttgtgatgtcaacaagcattatcatagcaaagaggtcctgcaaaactgactgagtgacctcgataacattcgcattatattctgcacactttgtgcttacctttgcaaggatacctacagcgtccttacctataaccgtaacaacagctctcattaataagaccagcctttccaaattcatttatatatcttctattataccacacagcggagattttgccaagagttttaattataaatattttattaacgttggaaaatccgtgttatgggccgacaatcaaggcaggtggtttgcggtgaacgaaacgggcgaacattgttcgcccctacccatatttgtacggattacaaaaaaattcgtaaaaaaatcaaaaacgttgaagtgcaaaaaaagcggggtgtcagatttctgcaaaacaaaaaaagtttgatgagcgggacgtcaatttctgtgagcttgcgagcagaaatttcgccgctcccctacaaaaaacgcccccatttaggggacgttcttgtattatttttctgttctgaatggtgcaagtggtatgcctgtttcgttgaagatagttacctcgcaatagttgaaccagttatatcttgcatagagaggtttttcaacggcgtctgacttgatgaaaattttgctgccgtttatggtgatatcggcttttacgaactcttcgtccttgcctgctatctcaaagccctgtgcttcgccctttactacaaagccgttttcggcatggtcaaagctaagctctataccgccgtttttatactccagcgacttatagataggtccgaatgcttttacgtccatgccgtagaaaagcttttctgcctgcaaacaaagtctttcgccaacgggtactttattctttgggtgaatctcgttgaactcaccgcaatctgagataacagctattcctgtatttttcactgttttatatgctctcatctgtgcttctcttattttacaccaatgcttataatcagggtcggcggcatatttgaacattgggagctggacgatgatgaaaggaagttcgtcgtcgccccacttctctctccaaagcctgataagagatgtgaggagggtataatagctatccggtttatggtcgtctgactcgccctgataatagaggaagccttttattgtataagggcaaactcttgacaccatggtctcaaaaagtcctgttgggcggaatgggtttacgcagtttattgggcccggccaattcttatcgccaaggatctcgttggctttctcccagctcattgttgggtctttttgcagaagctcgccgtattttttatcccacacacgctcaaatttctgataatctctgtattcttttatctgctcctcgacagttttgccctcaatacgtttttcatactcgtctatgtagcttcttatttcagcgttgttttcaagggtcggtctgtctacccatgcggaggctgatgtgccgccccagttacagccgataagtcctactgttataccaaggtctttggcaagctttcttccaaagaaaaagccgactgcactccatgcccttgaattatcctttgaagcctgcgaccatgcggtattgttttcgtcctcatagaacatttcgtcaagagtgccacgcttttgagtgtaataaaatcttacgttgcaatcaggggtgaggttttcgaggacttctttgccgccctttgcgttttgaagttcaagctccatatttgactgaccgccgcagaaccacacttcgcctatcatgatacggcagaattttttctctgtacatccgtctgaaactgtcatttcgtactctccgcctgcactcattggagggaggacggctgtccacctgccgtcgcagacctgcgtctggactgacacgccgttaagagtaactgtgacagttctttcctcgtccccaagtccccagactgttatgttcttgtcacgctggagcaccatatcgtttgaaaaaatatttgctacttttaacatacctttttcacctttcaatacctataaaaattcaatattcaaaaaaatatcatcgccgcaggcgataccttcattcctcactcctcactaatcaaagagtgtggtagaaaagaatgatatcctcaaaaatgccctctttgttttcaaaacccttcggtacagtgccgagcttaacaaagccgaggttttcgtaaagctttaccgccttgacgtttgatgcaacaacggcattgaactggagcaccttaaagcctttctgctttgctatgaaaagacaatgttcgactatgaccttacctgctccttttccacggcaggtgctttttacggcatagcttgcgtttgcgatatgcccgcatctgctaacgttattagggtggaggatatacattcctacagtttcgccctcatactctgcaacaccgcagaatgtttgtgatgcaaaaaactttttcgcaccctcatagtcgagggtctctttctgtggaaaggcattgccctcttttacaacttcgttccatatctctgccattgcaggaacgtcatcaatattgtaacctcttacggtcacgtttttcatttttgccattttggatacttctccataataaaattactctataaatgacttcatgccacgctcacgtcgccaatcaaggaactcctcatatgttccctgtctgtcgatacagccgtcgggggttatctcgattattctgttcgcaactgtctgaactatttcgtggtcatgagatgcgaaaattacgacgcctttgaaatctctaagtccgttatttacggctgtgatagactcaagatcgaggtggttggtaggtctgtcaagcattataacgtttgagccgaagagcatcatacggctgaacatacatcttaccttttcaccgcctgagaggacttttacaggcttatatatctcgtcccctgagaagagcattttgccgaggaaacctctgaggtaggtatctgttacctcggaagtggaatattttcttatccagtcaactatgctttcgtcattatcgttgaagtaggctgagttatctattgggaaatatgaacgtgatgtggaaacgccccacttaatgctgccctcgtccggctcttcttcctctgcaagtatcttgaaaagcattgtgatagcctgctcagactcgccgatgaaagcgaccttatcggtacggctgagggtaaaggaaacattattgaggagctttacgccgtcaactgttttggatatgccgttgactttgagtacgtctttgccaagctctctatccatattaaagcctatgaaaggatattttcttgatgaggcaggcatttcctcgactgtgagcttatcaaggagctttcttcttgctgttgcctgcttggactttgatttgtttgctgagaagcggttaatgaattcctgaagttccttgatcttctcctcggctttcttgttctggttctttatcattctctgcatgagctgtgaggactcataccagaactcgtagttaccaacatacatttttatctttgtatagtcgatatccacgatatgggtacaaacattattaaggaagtgtctgtcatgagatacaacgaggacagttccgaaatagtcggcaaggaagtcctcaagccagcttatagcgtcgatatcaaggtggtttgtaggctcgtccagcatgatgatatcaggattgccgaaaagtgcctgtgcaagaagcaccttgactttttcgttacctgagagggtggacatctgtgaatagaggatatcctcggaaagaccaagaccctgaatgagctttgaagcgtcagactcagcttcccagccgtttaattctgcgaactcgctttcaagctgacctgctctgtcgccgtcctcctcggtgaagtcctccttggcgtaaagctcgtccttttctttcattatctcataaagtcgcttattgcccattattacagtttcgagaactgtatactcgtcgaatgcaaagtgatcctgacgaagcactgaaagtctgtcctcttttgagataactacctcgcctgtggtaggctctatctcaccgcagaggatcttcagaaatgttgactttcctgcaccgtttgcaccgattatgccatagcagttgccgtttgtaaatttaaggtcaacgtccttgaaaagaagctgaccaccgaatgaaaggcttacgtttgatactgttatcattttaactctcctatatctgataattatactttgacactttattataccacacaaagaggcttatgtctacttttaattattaatttttcatcactgcgcttttatggtgcaaaagaggttttgctcttgacgttttcaacaaaaagtgttataattgttatgtacacattggcaatagcgataattattgccctgaaaattcaagaaattaagttggaaaggataacttgaatatgaaaaaagttttgtttgcttcttcggagtgtgttccgtttatcaagacaggcggtcttgctgacgttgttggctctctgcctaagtgctttgacaagaggtattatgatgtcagagtaattcttcctaaatattcctgcatgaaacagcagtggaaagacatgatgcagtacaaaacgcatttctacatggactttgcaggtcagagccaatatgtgggcgtgcttgaatgcgtttatgatggcgttacgttctattttatcgacaacgaacattatttcaccggtgacaagccttacactgagcatcactgggatatagaaaagttcatgtactttgacagggctgtgctttctgctctgcctcttcttgatttccgtcctgacgttatacactgtcacgactggcagacgggtcttatacctgtatatcttcatgacagctttgcagggggagatttcttccgcggcataaagaccgttatgactatacacaatctgaaatttcagggaaatgacggagttgagcagttcaagaggatatccggtctgtctgactactacttcactatcgacaagctgagaacgggcgttgacggcaatatgctcaagggcggtcttgtttatgctgacgctatcacaactgtcagcaacacatacgcagaggagataaagacgcagttctacggcgagggtcttgacggacttatgagggcaagggctaacgatctccgtggtatcgtaaatggtatcgactacgttgattacaaccctgacacggacaagaacattgttgtaagatacaattatgacaacgtgcttgagaagaagatacacaacaagagggcaattcaggctgagcttggtcttgcgcaggacgacaatcgctttatgataggcattgttagccgtttgacagatcagaagggctttgaccttattgcatacatgatggaaagaatgtgcgaacagggcatacagttcgttgtgcttggcacgggcgagcagaaatatgaggatatgttccgctggtttgcaggcaagtatcctgacagggtttccgctaacatttactacagtgaggaaatgagccaccgcatttacgcatctgctgacgcattccttatgccgtcacttttcgagccatgcggactttcacagcttatgtcactgcgttacggcacgctgcctatcgttcgtgaaactggcggtttgagagatactgttcagccgttcaatcagtttgataggaccggcactggtttcagctttgcaaactacaatgcacacgagatgtacaacactgtgatgttcgcaaagtacatatttgatgacagacgtgacgaatggaacggacttatcaaatctgcaatggcacaggatttctcatggcaggcttctgctaacaaatatcaggaaatgtatgactggcttatcggctaagatagatacaagaaaagctccgcaggaaaggcggagctttttttatgttataggttttgtggcaagcatatgatttgtcggagatcaggtggacgacctcaggtcgccgctacggaaacaaacataaaaagcggcacagtttaggctgcaccgcttttgttttgcatttatcagtcaccgaaagcaacgcccagagcctttgcggtcttgacgagctggtggtctgcagggacgaattttgttttgcctgcgacttctgaaagtgggttttctgacacaacttcatttatcattgccactgcatagccgtatttatcagctgcgataagctctgcggcatggacgccgaactttgtggcaagcactctgtcataggctgacggactgccgcctctgagcatatgaccaggaacgcaaactcttgtttctctgcctgtaagctcttctatctgctttgcaattctaggggtagcagttgtaagaccctgctctgcacggagtcttgctctttccttctttttaagctttgcctcttctttatcaaaagcaccctcagctacggcgaggatagaaaatccctttgattctctcttttcgcaggcagcggcaagcttttcgatatcatatggtatttcaggaatgactatcatatctgcaccgcctgcgatacctgaatagagggtgagccagccggctttattgcccattatttctgcaacaagtattcttccgtgggaattggctgtggaatgaagtctgtcgataacgtctgtggctgtgtcaacagcggtatggaagccgaatgttacgcttgtgccccagatatcgttgtcgatagtttttggcaggccgataacgttaagtccctcggttgaaaggaggttagcggtcttatgagtgccgtttccgcccaaggtgagcaggcaatcgagcttctgctttttataggtttctttcatagcctttactttatccacgttatcttcttcgatgacctgcattttcttgaaaggcgttctctttgtgccgaaaatagttccgcctgtggtaaggataccagaaaagtcagactgtttcatttctttgcacatattattgataagtccgtaatagccgtcctcgatacctactatctgaacgtcctcgccgaacttttcatagcaagcctttgcaacgcctctgatagttgcgttaagtcccggacaatctcctccgcttgtgagtatgcctattcttttcttcattttaccaagtcctttcaatgaaattctatcattatcaacgatatcaatacttatcgcttgtgctgaaatcttctatatcggcttcgtcggaaggagtgatatcctgctgagtttcctcaggggtggcctcgctttccggctcatcgtcaatatatgtgaaccttgaagtctgatgctctttcttatccttttcactgttctcgctgagtttgaaacgtgctatcatattctttagtatgagcgactggcttgaaagctcttcacttgcggaagctgaaccgactgcagttgaggtattggctgatacaacggctgatatctggtctactcccgtatttacctgaacgatagcttctgcctgcgcctcagaagcgtctgagatattctttacgagatcctttatagtatttgaattgcttacgatattgttcagtgaatcagcagtttcttcggctatcttagagccctttgaaacagcggcagactggttttcgataagtgaagcggtctgctttgcggcttcggctgatcttgatgccagacgtcttacctcgtctgctaccacgccaaagccctttgaaccctctcttgcggcctctacggcggcgttaagggcaaggatatttgtttggaatgcgatctcgtcaatgaccttgattatctttgagatctcgtcagaagcagtatggatagcattcatggcatttaccatgttgcccatatcgctgttgcagttgtcaacggcttcggtattcttaagtacgatattataagcgttcttagagtcctcagagttctgagttatctgctttgaaacatcactgagggtagcggaaagctcctcgatcgcggaagcctgctgtgtagaaccctgtgatacagactgtgcgatatttgacacctgaaccgctcctgagttcacctgctcggctgacatattgatagaagcaaaggtatcagacagagagtcgagtatctcgttaaacgtactctttatcttatagaagtcgcccttaaaagtaccttccattctatggcaaaggttaccctcggatatctgagtaagagccactgtgataaggttgatatactgtctgaggcagacgatagtttcttccagagagtttgaaaggacgccaagctcgtcctttgaataccacacgtcaacagggtcggtaaggttgccctgtgcgagagaacgaagtctgtttgtggtagaaatgataggctttgttatcctcttttcaaaaagcagagagaacagcaccgtcaggcacataagcacaacgcccattacaaatatattagtaagtgcgctggagcttgcagtggtgaagtcggcaacatttgtaaccatgacgacagtaccgtcaaaatatgacgaaccataatagcccacgatataattgttatccttaaatttatactctgttgtaccgctattatttgcaagtattttctcaacggcatttgtcacttccgtatattcttcatctttcttaccgatttcaagggcatttttacctatctgatctgtatccttatgaagaaggatctctccgtctttaccaacaagataaacatagccggattttccgaaggtatattcattaagagcattgacaagcatatcgctctgaatggtaatacaagcgactttttgttctgtgttgccagactttgttgaagcaagtatagaaaaataattcttaccgccaaaggtatatatatcggttatataagccgagcttctttcgcaagcgcttatgatgtgcttcttttcaactgatgacgataccatttcattatctgttgcaagcacaatgccgttgctgtcaaaaaccgtaaaattcagatagaagcctgtgttgtctgcaaagccactttttaccgcctttagtctgtcagcgtcagtttttgcccctaaaaaagaatcagactttacggtcgaaactatattattcgtataagagctgatagtcgagtcaaaattcttagccgcctgaacagccagtggttcagcggtgcttttgagcgtatcctttgcagaaacgtttataaaatacacggaaaccaagctaagcagcaccgtgatgataagtgcgattgaaagcattgccaaaagcagctttgaacgcaacgttttcatatacagttcccccttatgaacttgtttttaacgcagcacacaacactgcgatattacgtgtttattatatcataattgcacaattatttcaagtaccacaagcatattttttgtgaacttatgatgcaattaatgatatggaggtgaataagaataggtaaaaaagggggtaaataaaatatgtacataagtctaaggataagaaaaagggtgatgctttgcgttatagctgtgctttctatgctggcggcggtggctgttatgccgacctttgcaaaagaagaaaaaacagatgggataaagcttccgatcataatgtatcacagcatcgtaaaaaacgaagatcgcagcggtgaatatgtcataacgcctatcgagcttgaaaaggatctgctttatctgaagcagaacggctacactactgtttttgtaaatgacgttataagatatgtaaagcgtgggggcgaactgcctgagaagcctatcatactgtcctttgatgacggcacttacaactacagagaatatcttctgcctcttcttgaaaaatacgatatgaaagccactgtatctattgtgggggcttacactgacgctgcctgcgaggaggctgagcctgatcctgcttactcttatcttgactggcaggacgtttcggtgcttcgtgacagcggtcatgtggagatatgcaatcactcttacgatatgcacaatcttgaaggcaggcgtggagtcggtcagctagagggggaaagctacgaggattaccgaaaggtatttcttaacgacaccacgaagcttcaaacgctttgcgatgaacactgtggttttcagccaaacgtttacacctatcctttcggcataacctgcgaaagtgcaagtcggctcgtaaagaacatggggtttgaggctagtcttggagtagaggaaaaaatcaatataataaaaaaagaagatgagcgctgcctttttggtctttacagatacaatcgcagcgggatcatctccacagaagaattcatgaaaaaagtttttggagcataaaaaaagcagcccctattggagccactctctaaactgaatcaccatcagcatgtttacattatactctggcaggtgtcgaaattatacttgtttttgtgtgatttttgtaaaaaaaatgtgtattcgtgtaagcagagtgaaaaatgctgtcacaaacagccaaaagcacgttgatacgccacttttggctgtttatcatctctttacacagaacttatttatcctttttgccgcctttgatctttcctcttatccagataattattactacaagtgcaataacaaggacaataaggacgatagcaagggcggtattgagcatctttttatactggtccataacatttgcgtttttggacacggcagatgaagtatcggagccgtctttcttttggacggtctgggtctgctgttcatctccgcctgcggctcttattatggtgacagtataggtggcggcattgccgtcaacgtctgtgacggttatggttcgtacattttcgcccacctgacactcgcttgtgcctgtataccatacataatcagaggggcttgctgttgttccctctatctcaacattggtaacggaattgtcaacgttcactgtatagttatagacattataggcaaaggcaggagaaagctcgccgttatccactgtcaggtctgtaagaacgcctttatcgggtatgccgtttgaaggtgcggtcttagtggcagtggtggtagtggtggtcttttcggtggtggtcgtggtttctgtttcggtcttggtttccaccttatcgcctccaactgttatgacacaataggcggtaggcgagccgataagctctgaatcaggggaatatatctgacagctttgcaggcttatatttgcatttcctgccgacagacctttgaacgtaaagctgaaatccacttctgaagagggggtatcaggaaatccgtttactgtaaggactcctccaccgcctgaggcattgtcgcttgacacaaattctataacggaatcatcataggcgatatttgcctgaacgcttcctatctctgaatctgcagaaaatgtcacggaaacttcaaactgctgatcggtcatgacggggtttttaggcggatagaagaaagcctcccctgtagcatgggcagtgagagccgtcattggaactgcaagtgcggctgtcaagagcgatgagaatattctttttacaagctttgtttttgtgatcattgctatccctcccgataacatggataattatttggtataaactttggctatatcagaccactgtccgaaataggtcttgttccctgtggctgtatagcttctcacacggacaaaatatgtcttttggcttttaagatctgttacggtctttttgtcggtcttttttgaggtcaccttaactgtctttgcaccgctgaaagatatattttcagcgtaggatatctcatagcctgtagcagagcctttctgtgcatagtctatataaaagccttttttcactggcatgagcttttgtatggtctgccttgcgggggtgatgacaaaagacttcgttatcactccgccatacgagccttttcctgttactgctaccttagctgtgcctatattcttattgcaggaatatttcactatatagtctgtgccgtttttaagggtcttgcccgaatatgtgactgttatgctttgggtgatgttcctgcctgtgaaagacttgttttttatgcctgcgaccttagctttggcaatatcatattttgcggtggtcacgctctttgtatcagaccatgcgccgttataacgcttgccgctgactattgtatacgaacgcactcttacataatatttcttccctgccgtcaggtttgaaacggtctttttatccgttttgtttgaggatatgatcaaggtttttgcacctgcgaagtcagagcgtgtactgtactgcaattcatatcctgtggctgaacctttctgagcaaagtcgataaaaaagcctttatatcttgtttgcagagattgtatctcctgttttgcaggacaaatggtaaatgtttttgttatagtaccctgatagttgcccatgaagcttatgattatttttccaacgcctatttttgtatttgagctataggaaacagtataatcatgttcaggaagaagaaattttcctccgtccgttaccataacgtcaggtcttataggcttgcctgtataggagagcgtatcaacataatagacgcttgtcaattgggcggactttggaagaatgtcgaatgctttggctatagtgccgctgtatccgccaatgcctgttattatcattttgcccttgcctgcggctatattatcggcatagtcaatggtatagtctttattatttgtcaaagtggtatcgccataggaaagcgttatactgctttgagcaagctcatagcctgtgaatgtcatatgtgttttaaagcctgatatctcgcagtcttttataagctttctgtcggtatagaccgcctgcactgtcatatgggatgtgacttttgaaaagtctttatcccagcctgtaaagcgtttgccttttatggtcggtgctttgggcggatcggcacttttgccgtattctacggtctgagatgacaaaactgtgccgtttatatcggtgaaatcgaccttgcaggtattgactttccagcctgcataaagcgtctttgagccgtctgaaaagctcacggacgttataggctcgctctcaagctgtgagtcggcataccagcctgtgaactgtgcgccctcttttgtgggggcggaaagctgtgcggtttcgccctcaccaagctcataagtgttgagggggctgttttcgccaccgttaaggatataatctatcttcgctttgtcacttggggtgacttttgcggaaactgtggtgttttctgtgaaaactgtgttgctgttcacaggttcacctttacgataccagccgagagtgtagccctgctgaacgttcacattcgggaacacggctttgcctgcatagtcggtgcagacttctatggtctgtgccacagcggagaatgttatcttatgggaagcctgctcgctatatgaggtctggcgcacaagagtgccgtccattgtccactttgcgctgtctttgaacttttcaccgtaggtgttcattgcatatgccccttgagaaagtgcattttttgcagagaggcttgaaaccaggctgtcgctgtcattgctgtaacagccgtatgcgttcacaacggaaacggcaatatccctgcctcctataaaggcatttgtaatggcggagctgttttcccttaggtttgaagagcactctgttatgataccgcaggattgtcttcctatgacgccacctgaatagacttctcctgacactgtgccgtcaaaggtgcaggcttttatggctgttccttgataaaaacccactattccacctgcgtaatcgcctttcactatacagtttttcagggaaatgttatttatctctgcaccattttttatgtatgcgaaaagccctgaatactctcctgaggagataactgcgttttttataaggtgtccgttgccgtcaaaatagcccatgaatgggttttcagaatcgcctacgggtgagatagtttttccgtcaaagtcaaggtcgccttcaagggtgactagcttgccctcgaagctttcgccactgctgacacgctttgcaaagctttcccactgggcttcggttgttataacaagggcttcgtcctgttcttctgcggcggagataaggagcttttgtgcgtttgagatatcatttttagaagcgttctcgtctgcaagcaccgttcgggcattgtttgcttccctttcacagcctgaaagagtgccgtacttcgcaagggtggtttcaagtgaacttttatcgggctttgcagtatcgtcagtataagcatagataaaaaggcttcctatggagtcggtcttgtccgctccaacgtcagaccaatatttgccgttaagagaaacatagctttgccctgactgtgcatttgatgttcggtcgctttctgcaaggagatatcccctgccgctgtcgccgctgaattttactgaaatggaatatttctcgccctcttcaaggaggatatcctcgggaaagtcaactgtataaaagccgtttgcggacactgagccgcttatctgcgtttcaaggacgcctatagggtcgctgtcggaaacgtcggtatagacgcttagggtgtaatccgcactgcccgttttgcccacatacataaagcctgctttatcaagcttttcatcggctttagctgtgaaaacatttgcaccgtaaacagagccgtcattactggcgttcacaacataacctgtcattttgctatagtgatatgtattatcacagctttcttcaaagtcatagcagcaaaactgtccgaactctgcttcgtcataggacacccaatagaagccgtcattgtcctgatctgcgccccacgagcctttcacaagccatgcgccgttattggcaggcttgtatctgaaattatccttactgtagttatcgtcccagcccaccactgtgacggaatgatttatgatagtgttttttgaggcgtcgggatcatagtaggcagtattgttatgattcatatagccatttcctgcaaaatagcttgcggaaactgctccaagctccattattttacgcttcacctgcgtggtgcttgaaagctccatgacataattcagcctgtattcgctgacgcttttcttattttcggaaactatcatattctctgtgccggattctaaaaacggctcgtaatcctcatagcatagtccctgaccatttgcaagggcggaggccgcaaagagccagtttcctcctgatgagaaatcgtctttacctgtggctgtgcctgaatttgaggacaggaccaaggcaggcacggaaaattctgcggaggggttttcaagcccctttttgataagatcctgttctgcacaggcaagggctgaaaatgcccagcaagcacctgttgaagcctgatcttttactgttgtgatctctcctgagcttcttgggtcataggtggatgggagctttcgggcggctagtcttgcaggggactttatctgatagtcgccgtctgtgcttttggccacgccctctatctcatagctatagccgttatgggtaaagtttacgggaacgacttttatgccgttatcctcgttggcaagtgcaaaagtctgcgccgaaagctgaaaagccaagagcaaagctgtcaaaagccccgccgcacctttcattcttctcatgttccgccctcctgtttatctcaggttatggttatctttcttgtatactcgtttgaaatacatcttccgtatgccgctgtttctctaagtcttactgcgttcttttcaaggaaagcaacacgctttgcatagtcggagatatcctcaagctttttcagcgaggtatcatactcaagagttctgttctcagcctgcgcaagtatgcgtgtgcctgtgcggttaaaggcaagtatcctgccgtatggcacttgtctgatatcgtcctttctgatgccgagaacaaggtgcaggaccattcttcttactcttgccatggtgatattctttgactttatacgctgttcaaagatatccatagtttcagggcaggagcttacgacagacataaatctgttggcaaggtgttcgtcgcagtcaggtagggctagaaaatcttctcttgaagctgtgcagagcttgaaaagcatttctctgcctgcctgccgggtaaaggacggcttacagccctcaaaatcatatggaacaaatttctgccactcaccgccctcttttataagctctcttatatgagaagccgaagcaaaatcaccagactctgcctgagaatcatgtgcgacagcttcacgctttacggcataaggcactagccatggggctatacgctttgccgcctttatatactccactgcaagaacgttatttggtgtggagaatatctcttcggcggttctgccataaagacctatggaggcttcatacatagcctgcgggtaggactttccctgagataaaagttctcttacctgctgtgaattttcaagcattgcggatatttcagctgcctgttcaagggcgttcctatcaccgctttcacagccgaaagacaaggtcgttaccacgtcctccccaagacctgcaagaagccttactgcacttcttgcaaagacctcactgtttgaacatgagaacgggcatggcagttctataacaaggtctgcaccgtttcttatagcagcctgcgctctgtcatattttgagaaaacagccgctgagccacgctgcacacaatcgccgctcattacttcgacgataccctctgcgccagcctgtcttgtggcttgtatctgatatttgtgtccgttatggaacggattatattccgcaactattcccgcaattttcattttttactcctctttctaccctatgcatattttattcagtctttcaaaagcttactgcgaattatgatactaatatgttaagccctagtaaaaaaattgtgcaatatgtatatttatgaaaaaagctcttgaaatttatcattaatattgatatactataagtatatgatattatgggcttaaagtcaagcccgttatctgacatattataatcgggaggagattttttccaatgaaaatcttagttgtaaacgcaggttcatcatcacttaaatatcagcttctggatatgaaggacgagtctgttatcgcaaagggcaactgcgaccgtatcggtatcgacggccatgtgagcgcaaagacaggcgacggcagacacatcgaggaggattgcaatttccctactcacactgaggcttttgaaaagctcgttgaggtactcacatcaggcgaaacaaaggtcatcgactctatgtctgagatatcagccgttggtcacagaatagttcagggtgctgaggtattcaaggagacctgccttgtaacagacgaagttatcgaccagatcgacgcactggctgagcttgcacctgtacataaccacccacacgctcttgcactgagagcctgcaaggcagttatcccagcaggcacaccacaggtagtcgtattcgacactgctttccactcaacaatgccaagaaaggcttatctctacggtctgccatacgagtgctacactgatcttcatgtaagaaaatacggcttccacggaacatcacacagatttgtttcaggcgagcttgcaagagtaatgggcaagcctatcgaggagcttaagatagtttcatgccaccttggaaatggttcttctatcacagctatcaacggcggcaagtctgttgacacatcaatgggcttcactcctcttgacggtcttgtaatgggcacacgctgcggttctgttgacccttctgctgttgactatgttgaaaagaaaatgggctttacacctgaccagatgacagaatacatgaacaagaagtcaggcttccttggtctgtctggtatcggctctgacaacagagatattcaggctgctgcaagtgagggcaatgagagagcgcttatcgtaagcgagatattcgcttatcagatcaagaagttcataggttcatacgctgctgcaatgaacggccttgacgctgttatcttcacaggcggtatcggtgagaacgcacctgaggtaagagcggctgcttgctcaaatctcgatatcctcggtatccacattgatgctgagaagaatctctgccgtggaatacttaaagagatctccacagacgattctaagacaaaggtttacgttatcccaacaaacgaagagcttctcattgcaagagatactctggcacttgttacaaagtaatatttcagataacattaaggacggctttcttatgagagccgtctttttttggcgcataaaaaaggcacaggagaggttttcctgtgccttgatttgtttgaacgtacgatattggctatatacgttttccaaacaccattgtatcaggtcttaacgcctgagaactgcgtctgataaagtctgtagtaacagcccttggcggcgataagctcctcatggctaccctgctctgcaacacgtccaccgtcgataacgactatcttatcggcgtcacggatagtggaaagtcggtgagcgatgataagggacgttctgtttttcataagagccaccattgcggactgaatgtgcatctcagttctggtatcaactgaggaagtggcttcgtcaagaataagtatcttcgggtctgcaagcactgctcttgctatggagagaagctgacgctgaccttgcgaaaggtttgagccgccctcagcaagcactgtgtcgtaaccctcgggaagtctttctatgaactcgtctgcgttcgcaaactttgccgccgcctttatttcatcaatggtagcattttctctgccgtagcggatattctcctctatggtgtccttaaaaagcactgtgtcctgcaaaactatagctatggaacgtctgagcttgtctttcgggatatcgtaaatgctctgaccgtctatggttatctcaccgctgtcaacgggataaaatcttgtgagaagatttactatggtggtcttgccagagcctgttgcaccgactatggctattttctgacctgcttttacttcaagatcgaggtctttcagcacctgcttttcaggaacgtacgagaagtcgatatgcttgaagtcgatatcgcctttgacgttttccacctcaaagtcagccttgccctcgtcagtttccttatcggcgtccatgacctcaaagatacgctctgcgcctgctattgcggtctggatatttgcaaactgatttgcaatctcattgataggacgtgagaactgctttgaatagagtataaaagcctgaatggttcccactgttataaagccttttattgcgaaccagccgccgaaggctgcgataaggataaagccgaaattggatattaagttcatgcaaggacccattacaccaccgaatatctgagcttttatgccacattttttcagattgttgctcattttctcgaacttgtcaacagcgtcctgctctttgccataggaaacgaccgttctatagccaacgaccatttcttccacttcaccgtttatctcgccaagaagcacctgctgtttgatgaagtatttcttcatatactttgtgagtacgcctgaaacgaatatggtaaggaacactgtagacagtgagataagggtaagaagcggtgaatacagaagcattatgacaactgttcccacaattgtaagcacgcctgagatgagcgagcctatagactgagagatagttgtggagatattctcgacgtcgtttgtcatacggctcattatatcgccgtggctgtgggtatcgagatactttataggaagtcttacaaggcttgagaacaagtctttacgcatggtctttactgtgtactgtgaaagctttgcagagaatattccctgcatataggtgaaaacagaggacaggagataaactgccccaagacctatgagcgttttgccaagcgcaccgaagtcaacgcttgttttctttttggtgagagtaatgcagtctatggctatctgctggatagacggtgcggcaagattgagcagagttatgatgagcattacaccgataagagcgaaaaacagatatctgtttctgcctatatagcctatgagctttttaagggtgttctttgcgtcctttggcttttccattgtgagccttgcaccgtgaggtccgcccggttttcttccaccgggtcccattggaggcattggaggcattacacttcacctcctgacgtttttacctgtgaagcgtaaatatcctgatatacctcgcaggtctttaatagattttcatgagtatcgcaggcacaaagcttgccgtggtcaaggacggctatcctgtcgcatgattttacgctctggatacgctgtgcaattatgataagggtagtgccgttcattttgcggtctatctccgcacggagctttgcttctgtgccaaggtcgagggcggaggtggaatcatcaagaatgaggatctcaggttttttaagtaccgctcttgagatagaaagcctttgcttctgaccgcctgatagtgaagcacccttttcagctataataccctcatagcctgcaggtatcttctgaatgaactcgtcagcctgggctgcctgtgcggcggagatgacctcctcatgggtagcgtttttgtcgccccattttatgttgtcctcaactgtgcctgaaaacaactcgcttttttgcaggactatgccaactttctttctaagctcgtcaagcttgcagtccttgacgtttacgccgtcaacaaggacttcccctgctgtgcagtcataaaatcttggaataagatttacaagggaggattttcctgaacctgttgcacctagtatggcgacgctctcacctgactttatatcaagggtaaggtctgagataacaggtctgcccttggtttcaggataggagaatgaaacgtttttaaagctcactgtgccccctgttttatctgaaagggaaacgctgccgctttttataacagggtcagtttcaaggacttctctcaatctgtttgcagatgcggaagcctttgcgagggtctggaacatcatagacatcatcattacgccatgcaagacctgagtaagatatgtgatagccgccatgacctcgccgaccttcatagcttgtgcctgcacctgccagccgcctataactataacggcaataacagacagattgagtattatcataagaagcggctgaaggatagccataagggtctgaacacggaggtttgattccataaggcttatatttgcatcgtcaaaacgcttttcttctgtatcctctctcacataggcttttactactcttgcgcctgtgacgttctcctgaaccacagagtttacgctgtcaagacgttttgcaacgatagaatagtatgggtttgcctttttgagaattactatcatcatgattatctcgataggcaatgcacagagaattatgataccaaacctgacgttcagagtgagcatcatgattattccgccgaagaacagcaggctgtcacgcaccaacatcctcagcatgaagtctaccatttgctgaatagcggttatatccgctgtaagacgtgttaccaatgagcctgtggtgaacttgtcggtctgttcaaatgaaagacccatgacacgcttgaaaacgtccacacgcagatctcttgaaaagctttgggaagctattccgccgaacgcagaagccgcaattccgcaagctccgccgcctataagaacaaggagcatgagaagtcccgttcttatgataaggttcatatcctgacccagcacgccgtcgtcaactatttttgacataagctttggctgaagcaggtcgcccagcacttctcccaccatggatagaggtgtcagcaccgcaaaaagtgcataaggctttaagtatttgcttagttttactttcaaagcagttcctcctaaaattttatttcaggctacttatacgcaggggaacattgacggaagatagcaaatgcagagcagtgggctgtcaaggacgccagccactacaaaatgtgtgatataactttttatgtagtggcgaacagcgttcgcccgcattgcttttgttttgctaatgatcgcatcgacttttcactgctggtgacaaggcagagcctttgaaatcacagccctaattgtgcattatctcaagctccccggacagctcctgcgctgtcatttttctgctgagggaggctttgtctatcattatggtaacaggctcttttccgtggatatcgaaccagttgtcagagaacacgcaatctgcggtctttaggctgagacagacgcttttggcgtaattctcagcacagaatgtcagggcgaatttatcctcgctttctgatatgccgtaggttatctttggctctaagaatgtaaattctttcgggcgcacaaagagcgttgtgccaaagcttaacaccttgccgttttccataatggaatattcgagatatttttcacgagggtcggtacggtttttaagatcgtctgaaaggtcgatagtaagaacgttctgtgctgtgagagccggaacgttcacggatttttctccgctttgcagaatttcagctttattgtttctaagcgtccattttaccacgccctcaaaggctgtcattcgctcgttggatatgttaaggacaggcttttttctatgggtatcgtcgcaggagataaggcatggagcgtaaaaacgccttgcataataatgcagacctttccacctgccgaaatagtcgatacttgaccatgagataacagggtttgaatcgttcacctgccaataggcagaacccatacatctgccccttgctcttctcatatgctcaacattcgagcgtatgcaatccgcctgaacgagctgtgaggaatagatgagctgtttgaaatcatatggatatcttaccatttgagcgagatagtacattatcttctcgttgccctgaacacacttctgatgtgccgccataactggtgagcaaaggtcaaagtcaccctttgtttcatcagcaaaggcacggcaggtctttatatcaggcaggctttcaaagccgtattctgagcagaagcggtaataaaattctctgaacgcttcgataggcttgaagttgtgccaaacgtcccaatagtgcatatcccctgcatggtttgaggaagcgtccttgaagcctccccctgatgaaggtgatgacggccaatagaaggtgttttcgcatgggtcataggctttaagcacctgtgggataatatcctcaaaaatgataagatagtcacgctttgcttcctcgtcctcgggaagaccccaatattcccatgcggattctatctcgttgttgccgcaccacagaccaagagaggggtggtttctcaggcggataacgttgtcacgaacttcccctcggacagtttcttcaaactcctctgtgagcagatatgcagagcaggcgaacataaagtcctgccatactatgataccattctcgtcgcagtagtcatagaaatactcgtcaggataataaccgcctccccacactcttataaagttatagtttgcggccttgcaatctgcaaggagctttcttgttttcacttcgttacagcgtgtgactatctggtcttcggggatatagtttgcgcccatggcaaatatcttcacgccattgtttataaagcagaactcctcgccccactgatctttttcacggctgacagttaaagttctaagacctatgcgctgtgtatttttatctgtgcaagcgtcattttcatcatacaaagtcactgcacagctataaagtggctgttcgccatagccgttcacccaccaaagctgagggtcgcttatcacaagctctgtttcataatactctgcacttccctctaggcttatgtcggcttttgcggtgatattgccctgcgggtcggatattttcaccatagcttttttacagccgtggttttctatatgcaaaagggctttcaaagtcactttgttatcggtgtgcttttggctgtagtaaacgtcaagtatacgtccgtcctgtgggataacaagagataccgaacgccatattcccatgtcagggagcattgggccccaatcccagccgaacatacaatgggcttttcttatatgtgtatagcctgtcatggtggagtcaacgccccaaaggtgacgtttttcgtccatttcttttatgtatctgtttggcgaggttattttcactgtgagagtgttgtccccctctttgataataccatggacaggaaactcccacactctgtgcatattgttcactctgccaaggtgaatgccgttgagacagacgtttgctatggtatcaatgccgtcaaagtgcaggacagtatgcttgcactccactgcggccttgtctgcggtgaatgtagtttcaaaatcgtaatcatcatcacatatctgtgttgagatatactcgttctcacgataatatgggtcgggtatctttttatagtcaagcagggtcttatatacagagcatggaactttgcagtcaaaactctcctgcgagcctgcttttttcattttccagttatcgttaaggcttactgttatactcattatttttctccttatttatcatgaatgcagaaaaggtttgtttcccatgcggggtagtatctttcctgacgtatatagaatttgtatcctttgcaaaggctgtttatatacagaggcagggtgatgtaatcatatggtctgtgatacaacgcactgcatatttttggggcatagcgtgaaatggtatattcactgcctttgagagcttctaggtctgctccctcaacgtcatattttatataggtgcattttttgcctgcaaggacgctgtccagacttcttgcacgaaccttttttcctgcggcatctactctgccctgtctgcctgcgcctcctgcgaaataaagctcggtatcaatgctccatgcggcggcattgtaaaggcttatattgtcattggcttttagatttttcaggcatttctgaaagttttttctctcaggttcgagggcatatattctctcatactttccccctgtgcgtgagataagctctgcggcagtgtcgcctgtgtatgctcccaagtcgcagtatatctcgttttctccaaggggaagtatctcggttatcttgtccttatccgtaaatatctcacgaagataagaaagcttgcctgttatcttgaacgctgtcagcttttcaaaggtaagctttgaaatatcgtcatcaaaaaggcggtaagctttttcagcctgagaatacattgagagaagcttttccttgctgaaattttcatcgcctgcaacgcacatttccggcactatgacctcgcagcttttttcaatattgtcgatacgctccattatctcaggcaggctcgtgccaaagccaagcacaactgtgatatttccaaactgcgcttgcacctgtgagaaagtctgcaccttaaaccctctgaagctttgtccacggacaaaatcgtcgcttgcaaaaacacctgtgcattttatgccaagtctatcaaattcatcaagaagcttttccgctccatcgcccatgccgtatatgaatatcggcttttcgcaggtcttgagcctgtcccacgagctttcaagggactgaaaatattcttttgaaaacattcacactttcctctccaaaaaaggctctcacagaaagatctgcgaaagccccttattcttatagaactttatatgatatcgtcattgatatcaaaatcatcatgatcgtggcaatgaccgccgtcaccaccgaccatatctctgccccttacacggtatctatcacgatttatattgatatacttatcaagctgtgcaagcacatctcttggcgcttttatggacttgacttccttaataggcgtatcaacgtctttgacattcattactattgtgccacagccgaacattctttgtccgaacggcaggacaagctttttgtcgatgaccctataaaggtcaagctcgtcttcctctatgctgagaaaacccttgcgtgttataaacttatcttctgtgagaaaatatcttgtaaatgatataggcagaccaaaaatcgttcttttcttatctgtccaaatgtaattgataacgtcttttttcataaaacgacgtcgcctccctcaagatgatctataattttttacaaagacatcattgcaaactggtggcacaaaaaagttgctgaccatgtttttgcaacgatcctcccgtatattttaccacgcaataaagcttttgtcaagaaattatcttttgtaaaagctatgtaaaaatgccattcatttatatatttctatatcatttcgtaaatattaataaatgtaaaatcacacatttatcttaatatttttttaattatttagcaatctttgctggcgttttcgacttttttctacataaaataagctttcataacaatgtaaagttgatgtaaaatatagcgaatcgtcaatttattcatataatgtattgatttaaacgacacaaaagcatattttctctgtgtaaattacaatatttgcacaattatctcatttaaaatttggtcataaccgacatttgtttatttactatgtatagattgttgcgtgtttcttaaaacatagtacaaaaagtaagaaaattaagtaaaaaacttgaaattatatcgtaaaaatgttatactgcaagtgtagtataaagttaaaaaaataaaaaaaccggaggaagatttaaaatgtgtaaaaaagacgtgatcaaaatccttgtcggaagcctcaatcaggccggcatgaaggtggcagactatctgaaaaaacaggggtacaatgttgcgcagtcagactacaatccactggagatacagcttgaggtgcttaaaagcaaacctgattttctgataatttcagaaataactgaatttccctacgaactgtgcaaaaatctcaaaggggcttgtcctaagctgaaaataatcatgctttccgacagaaaaaccaacaatggacttgcaaaatacgcagacatgataataaaaagtcctctaagctgtgcggatatcaaaaacgcactcagagcgcttcagtgtcctgacgattctgcagatctgaacatcacaataacgcgaagctctgacgaggggtacaccaatggcgacatacaatctgctatatccaccgtgatgaagcggttgtgcataactccgaattataacggctatggctacatcaaagaggcaataaaaatggctcttacgacagacaaagccaacagacgtgttacaaaggtcatttatccagagatagcggcggcacatggagtaaccacagtaagcgttgaaagaaacatgcgcaccgccataaggatcggttgggaaaaggctcatgacaaagacaaagccgagatattcggtaatttcgccataagacctgaccactaccccacgaacagcgaatttattttcgttgccgccgaatacataaacagcaaatatccagcggaaaaggcattatcagccaccgctgaacatactagcgaaagtaatttatttatctgacaagaagaaagccgttatgcccacaggcacagcggcttttttctatataaacgaaacgtcctgcagtaaatgacaacgggctgccctgcggacgcagatcttctgctgcgtcacccactgtcatacgatcactgcagacgctccgttatctcattttatgccgacatggtttttatgacacaaaaaagcgtaccgaaaaatcggtacgctcagtgtttaagtaaaagccgccttgccgtcgcacagccgataaacccgctataaaagcagggtgggtaaaacagcctgaaagcttcacgctcccttcgtccgtttacgaaacggcaaatgcggtttcgttcgggaggtctgcaatccctttccagagtctgaatccctttttagaagtgttggatttataataactgtgcttgttcgcacaaggcaggaaactttttctgttatttagtatatcacaacatatccataatatcaataggtaatttcagcaaatcaaagtacataaaattgtacattttacatattgacaagcctatatgctgagatatctttcttatgacaggtggtcgtgatcgtgacaaccgcagccacagccgcaatcatcgtcttcgtcctcatcgtcaaactcgaacatttcatcgatacgctccatgaacatctgaccgatcttctcatattcgtcatcatcttcgatagaagcaagtatctcgtcattgttctcgtcatactcagccttgagtatcacaacgtcgcctgaatcttcaagggcttcgtcaccgttctcataataaggagtgagagcataatacttctcgtcaccatattccattgcgtccaacagctcaaaagtctgcttatcaccattttcgtcctccagctcgtagaggtccggcagaaactcgttatccataattatcctcctaacatgatcttgtgcggtatatcggcactttctgagtgggatatatcgaaaaaatcagaacagaaagactgtttctgaccaccgcaacactttaattatactacactgcaaaatcaaagtcaagcgcattttgtaaaagtaatattaaatataaaaatcacaaaaaagttgagaaaaactattgacaagtaacaaaagatgtggtatagtatagtcaaggaaaaacaaagagccaaacaaaagcagacaacagggttcgctgaaacggtcaacggtctgacgatacagtaacgatttcagagggcacggcaaagcgaagtaaggcgagaggttttccttatatatcacaggcagatcgatggacacagcatatacccgacactaggtacactacagttcagcaggcgggcaggctcatcggatacctaataagatatgaaaggagcgagtccaatggacgcatcagagatccaggagagtatccataggctcggcaatttcttaaagtaaaaaaggatcaagacgcagacgaatgagctgacaggaatccagacatatatgatttacacaggaagaaattgcagagtctcatggattaatcacagcacagagttactgcaatttaaggatactctcaaatttacaattgaatattttgcaacttttatataaggagtgatcgacatgatcggttacagaaggtttgcaaataaaatttagacaggagtgtttccaatgcacaatttcagcttttcagaggtaaagaaataaactgaaagagtgattccaatgtaaaatttagcttctgaacataaaaagctcacagagctataaaaatcaaataaatttcgaggagtggtgcatatgaaaatgcacaaaaggaacttgaacatgaaatagaatggagtgagtccgccaagaaatttacgagcttaatgctcttactgatttgatttactgactaagatttttctaaagatcatataaaatactgaaggagtggtgcgttatgaaaatgcactcaaggcttttgaacatctgatatttggaggtgaatccgccagttacttcagcaaggcttatctgatatggtaagcgtaggatcttgaaattatgcgaaaggcgataattccaatggaaatgtaataagtttcattgacaataaattttcacgaaaggtgttaagtccgatggcacgttaagttttatccactgaggcataacttaatattttgaaaggaaataaatccaatggaaaggtaatttgcacttagagattatttttaccgaaaggaaatagatccaatggaatagcttatattatgcggacagaattttactgaaaggcgtgagtccaaagtacaatttagcatgagtttacgactagaattttcagaagggcgtaataccaatggcataatcaatatgaacgtacatacttaactatgtggtgtattcagatatcacatagttaagtttttttgtgtaaggggttggacgtcgaggacgccgtcccctacaatattcaaaaaaacaagaaagcaccctgcggttcaatgcagagtgcttttattttatatcatattttcaaggaaagccactgtctttggatcgtatgtaagatcctgcgcttccatatcctcgtcaagctgccacagctttgttactgcaaaaactgacgatacaaaaaacggctggctgttcagatagccgagggttatctttgccggagtgtcccccgtctgctcgctgagctgttttacctttgcaagtcttgcaagattagcagggcctgcatactgtccctcagggagattgtttgcagcgtcgccctttgcaagctttgcaaaaaagccctttgcctgcggggagaacgccataacaggaaaatcatgcttcttgtaccagcggaactcctttgtatccatacaaacaagggtattgtcaccgaaagtttcaacgctcgaatgtgcaaggctgtagtttatctgactgatcctgataggctccataccgtttttctctgcaaacttattcgcttcctctatcctctgagttgtccagtttgaaacgcctatgaaatgtatctttccgctctcatagaaatcattgagtaccggcattatctcttcaacaggtatcttcgggtcgtcacggtggagaaaataaatgtccacatagtcaacgcccaagaccttcaggctttcttcaagatcctttgtaagctcttccctgctaagacggctttcgtccatatgacccatttcagggtgaccgccctttgtggcaatacaaattttatcacgattgtttctagctttgagccatctacctattacgccctcgctggaatcgtgaccattctccagccagtcgcagtaaactcttgcggtatcgatacaccagccgccaagctctacatatttgtcgagaaactcaaaatacacatcgtcacaatcgtttctctcaaaacctgccgcaccaaaagtcagggcagggactttcatttcatatctgtcgtttttcaacacatagcttatcatacactcttcccccttggcatacaatttcctatactatttatcataactatgtctagcaatatattattataccatataaaaaggactttttccacagaattttgttaaattttattttttcataaaaacctcttgacaagtcggtaaacttgatatataattgtaaaggtttatgactttacagaaatccattaggaggtaagcggtatgagtaaaaatttgcaaaacagcgttttgctcgacttgtatggctgcctgctcaccgataaacaaaacgagatcatggatctttattacaatgacgatctgtcgttgggagagatcgccgctcagctagatatctcaaggcagggcgttcatgacgctataaaaaaatgtgaaactgcaatggctgattatgaagaaaagctaggtctgctaaaacagcaggaagcttatctggcagagcttaaagagttcaaggctcaggctatggacgtttttaacgagtgcaaaaaaaagaattatgcgagagatatcgccgaaaaggtgatagtgcttcttgaaaatctcgattctaagcttgatgaatttgacaacgcagaatataccgaagaagaatagatatagataaaaaaattatacggaggacagcttatggcgtttgaaggactttcagaaaaactaaacggcgtgttcaagcgtcttaaatcaagaggtaaacttagcgaagccgatgtaaaagaggcaatgcgtgaagttaaaatggctctgcttgaggctgacgttagctacaaggtagtaaaagattttattgccaaggtaacagagagaagcgttggcgaggaagtgctgaagagcctaactcctggtcagcaggtcataaagatagttaatgacgagcttataaagctcatgggcgaggctaactcgaagataaacttccctaacaagccgccttgcatcataatgatgtgcggtcttcagggttcaggtaaaacaacacacgctgcaaagcttgcgaagatgttcaagaaagagggcaagcgtcctctgcttatagcagccgacgtttacagacctgcggctatcgaacagctgaaagttgtgggagagagagccgaagtcgcagtatttgaaatgggtcagatagacccacgaaagatagtaaaagagggtatcaagcacgccaaggattacggcaatgaccttgttatcatagatacagcaggacgtcttcacattgatgaggagcttatgaacgagcttaaagacatcaagaagatcgctgagccgaacgagataatgctcgttgttgacgctatgatcggtcaggacgctgtaaaggtagcttcaagctttgacgaggctcttggtatcgacagcgttatccttacaaagctcgactctgacacaagaggcggtgcggcgctttcagtgcttgctgtaacaggtaagcctatcaagttcgttggtatgggcgaaaagcttgacgagtttgaggctttccaccctgagagaatggcttcaagaatacttggcatgggcgatatgctcacacttatcgagaaagctactcagacagttgacgaaaaggacgccaaaaaacttgcagaaaaaatgcaggaaaagggctttgaccttaacgacttgctggagcagatgaagcagatacagaaaatgggttctatgaagtctattatcagaatgcttccaggcgcaaacaaggtaacagacgagcaggtggagcagggcgaggttcagctgaaaaagactgaggctatgataaattcaatgacaagggctgaaagagaaaagcctgcgatcattgaccctaagagaaaaagacgtatcgctgccggaagcggcacgcaggtatctgacgtaaatcagcttcttaagcagtttgaacagatgcaaaaaatgatgaagcagttcggtatcggcggaaatcttcacggaaagaaatccagaagaaacagagcggcgcttctcaaaggtcttggcggcggaatgccacaatagttgataagctatcagcaatcaagtgattgatttgatatatgaagttttttatggaggtgaaaatacaatggcagtaaagatcagactcagaagaatgggtgctaagaaggctcctttctacagaatcgtagttgctgattcaagatatccaagagacggacgtttcatcgaagagctgggctactatgacccaactaaggaaccttctgtactcaaggttgacgacgaaaaggcaaagtcttggatcgctaacggtgcacagccaactgatacagttaaggctcttctcaagaagaacggcactatctaatagctgacaagacaattcagacggtgagccacctatcccaccacttcgcttgccgttttcggcggggaaaacgcttccctgccgcattttcgtgggagaatggagatatttttatgaaagaattactcgaaactatagtttctgagcttgttgaaaacaaggacgctgttgaggtcgttgttgacgagcctaacgcagagggtatcgtggtttaccatcttcacgttgctccggacgatatgggcagagttatcggcaagcagggcaggatcgcaaaggctataagagttgtaatgcgtgccggtgcttcccgtttggatcagaaaataatggtagagatagactgatagttcagtgaataaatcatcaccccgtacagataatagtatggggtgatttttttgcgtgtaaataaaaaatgcttcaatgcgttcacaggtatagccgtggggatatgcaacggttttttcggttcaggcggcggaatgatagcagtgcctatgcttgaaaaaggcggcagtgaggcgaaaaaagctcatgccacgtccattgctataacgcttccattgtctattataagcggacttgtatatttcaagggcggaagtcttgatttttcgcaggcagtgaaattcataccacttgggatagttggtgcggcagtgggtgcaatgctcatgaaaaagctttcaaacagtctgctgaaacgtattttcggactgcttatgataatagcaggcgtgcggatatttatgaaatagggtgatattacggcttggtatacaatatgtgcggtggcttttctcaccggtatctttgcctccatgggtcttgggggaggaatggtgcttatagtttatctgacggtctttgcaggcttttcgcaactagcggcgcaggggataaaccttgtgttttttatccctatcgcaataataagccttgtgcttcacacgaaaaacaagcttgtggaatggaaaaaagccgttcccgcagttttgtggggaacggctgctgttatcatatcagcatggcttgcaaacaggatagagcaaagcctgctttcaaaagctttcagtattttccttatcctaatgggactgaaagagttatttttcaagagtgaaaagcacaagttcaaaagggtctgagaaacgctgtgtccagccactattgcctactcctcttgacaccacaagcgttgtatcgttcacgctgtaagtgccgtcggtgtatttcgggaaaagaccctgaccaggtgcataaagaccattcacaaggggtagccttataagtccgccatgtgcgtgacctgtgaagtctatgtctatatgcgttccatactgcactgcggtcttactgaaatagttgcaatcctcgggatagtggtttagcagtatgacaaaatcctctgtgacctgagaaaaagcctcgctgtcattttccatattgtcaaagcccaacaggcttatagtatcaccatttcgtgtgagtgtggtatgctcgttgtagaggacgtttacaccatagctttcacagcctgcaacaaactgttccctttcctcctgagaaagattatattcatggttgcccataacaagatagacaggacatatgtcaggaagctttttcataaactcaagggaacggtcaacatcggggaagatctggtcaacactgtcccctgtaacaaagatatagtcaggctcacagtctttgaccttttccgtcagcctatctatgtagcccttgccccactcgttgtggaagtcagatatctgaactatcttacagccctcgaagccctcaggtaagttatcaaaatgcgctgacagctttttgacctcgatataggtattagaccacacgaagtcggctaataccattaccgcaagcactattatcactatgatgatatttcttttctgctttttagtcagcctgctttgctttttttcttctgtattcaagatagccctccaaaattatcgttgcggcaactgtatctacaacagcctttcttgcctttcccctgacgtttgtttcgttaaggatattgtgtgctgtgacagttgtagaacgctcgtcccacattctcaccggcaggtcggtacgctctttcaaaagctcggcaaacgccctgcacttctctgctcttggtccctctgtgccgttcatgtttataggcagacctactattatctcacctgcaccatattcagcagctgtctgagccgccttatctgcaagcctttcgacgtttctctcagggacagtgccgataggggaagcaagaaactcagagcggtcgcttattgcgaaacctgttcttgcgtcaccataatctattgccattattttcattttgtgcacctctatatcaagacttttcttatcattatatcataacactgtctgtaaaacaagtcctaaagcaggattttggaaattaaactgcaaaaacgcaatgtagaagagctctctgcataccatttgcttaaaaaagtaaaatagttccttaaatactgtgattatttgtgcattatggttattgatttttacttttaattatgttataatgctttattatcagagggtatgcacaaatgtcagggttaagttttgtgcaaaattatattatataagaatttgaaaggaaaaagaaaaatgaagaaatttttatcagtagcaatgtctgctatcatcgcctgcgcttcaatattctcatgcacactgacagcttttgccgaaaacgcagaaacagaagacgttactatcgactgctcttccgcaacgacttgtagcaattgggaacagtctatcactgtcgatcaggcaactttcaacgcaacaagacttacaaaggattcagagataatcgtcacattcaagagcgaggaaataaacgaaaaggcaggaaacaaatacaatgctgagcttattttccagagctgggacaacaccactacaccagccgctcaggacggtgcggtatgggcaaaggtagcacctgtgaagtttgacgattcatcagctacatatgattttgaatctatcgcaactgcatacggcacggacgatttcagtcaggtatacaacatcataatcggtgcgactgacagggcaaagataacagtaacaggcataacggtaacgaactgcaagacaaagacttatgcagaaaaggaagaaaaagactcaaagggaacaaaccctattatcatagttattgcggtcattgcaggaattgctatcgcagttgtggtaattgtgataatcatgaacaagaagtcaagcgaagcctttgacgtaagcaccggcaagttcgttgataagaaaaatctttttgatgagcctaagaacgatgaggacgagaagaaataaaaaaataacgctatcagcaggaggacgagcagttcgttctcctgctttttttataccagaaatattgacttatagacggagttatggtattatattaaaaggtatatttaataattggaggctatataaaatgtcaatatttaaacttgatccagcatttaaggactacatctggggcggtaccagacttagagatgagtacggcaaaaagtgcgattatgataaggtcgcagaaagctgggagctttcttgtcataaggacggtccaagcgttgtggctgacggcgaatacaagggtctgacactcaatgagtatatcgaaaaggcaggcaagggcgttcttggcaagaactgcgaaagatttgagaacttccctatccttattaagctcattgacgctaaggacaatctttctgtacaggtacaccctgacaacgattatgcaatgagagttgaaggcgaatacggcaagacagaaatgtggtatgttgttgactgtgacgagggtgcaactcttctctacggtttcaagcacgagataacaaaggaagaatttgcaagaaggatcgctgacaacacgcttcttgaagtaacaaacgctgtacctgttaagaagggcgacgttttcttcatcaagtcaggcacgctccatgctatcggcaagggtatccttattgctgagatacagcagaactcaaacactacatacagaatttatgactatggcagagttggcaaggacggcaagcctagagagcttcacgttaacaaggctcttgacgtaacaaagcttgctcctgctgagcagtatcctgagacacctgttgagaagaaagacggctatgacataaagcttctttcaaaatgcgaatacttcacaacatacagggtgaacgttgaaacaaaggctgagcttgacgctgacgaaaacagcttcaacagtattctcgttctcgagggtgagcctgttatcagcggtggcgaaactgtttctgcaaagaagggcgaaagcgtattcatttcagcaggcactggcaagtatactgttgagggcaaatgcacattcgtgcttacaaagatagactaaggtgagataaatgcttaaacttgacctaaaaaaagagataggtgagcttggcgcacttgtgatcgcttttattatcggatttgtggcaagctcattttggataggtcttatcagctttgtggtgctggagcttgtgtatcttctggtatatgacgccatagcaaaaaaggctgaagcccaaaagccaaaagaggaaaaggaagagataaactttcacgaatatgacgatgacactgagagcgataacgctcagtaagctcagaaaataaaagggagaaaaaattatgaagtattacattggtattgatcttggcggaactaacatcaaagcaggtgttgtaaatgaagaatttgagataatcgcaaaggctacctgcaagaccaatctgccaagacctgcggaggagatctgcgaagatatggctaaggtcgctttggaagctgtaaagaacgcagggctggagatagagcagatagagtctgtaggtatcggcacacctggcactgcaaattctgacacgggcgttattgagtattcaaacaaccttggtttccttaacttccacgttgttgaccttatgaagaagtttatcaacaagccttgctatgttgagaacgacgctaacgctgcggcatacggcgagtatgttgcaggtgcagcaaagggtgcgaacgacgctgtttgcatcactctcggcacaggcgttggcggaggaataatcattaacggaaagatatattcaggcttcaactttgcaggtgctgagataggtcacactgttatcgaccctaacggtccgcagtgtacttgcggcagacacggctgctttgaggtattctcttctgcaacaggtcttgtaagaatgacaaaagaggctatgttcgaggacaaggactctatcatgtggaaaatgaacgaagaggacggcaaggtctcagcaagaactgcgttcaacgccatgagagccggcgataaggcaggcaaggaagttgttgacaaatacataaagtatcttgcctgcggaatcacaaacacaataaacatcttccagcctgatattctctgtatcggcggcggcgtatgcaacgagggcgaccctctgcttttgccgctgaaagagcttgtggctaaggaaatttacacaaagaattcagcaaagaacactgagatagttattgcaaagctcggaaatgacgcaggcattataggtgcggcattccttggactttcacacaaaaagtaataaagatataaaggggaattcaaaatgggacttttcgacaagatattaaaaggtgctgtagatgctatcgacaacgctgcggcaaagaacggcaatggtccgacaggacttaaagacctgttcaatcaggctatggataaaaagaatgaagctataaatggcacttcaagctccacggcttcaagcaaaccaaacactgccacttcaagcacaagttcaagcaagagaagcaattgtgcttatacaagaccgacatataccacaccgcaggaagttcttgacacagcgagcattcctgcaaagccgtcaaggaaaatagaatttgaggtttttgacggtgaaaacgctgagataagagtgaaggtaacattcaacctgagcggagattttcttgaaacggccggagatgtacactatctggcgtcatatcttccgaccattgatgatgattatgatgcagattactctgactcaaatactccgctttttggagttttagatgtagatgacgaaataatctataacatggcagagaaatttgataagggcggcgtacctgaaaatgcaatgatgttcctgcctgtcaatgacatgggtccaagagcacgcttcaaggcaaaagtcgaaaacagaggtaagattgaatatttctattattgtccgctttacgactatatgcctgacttcaagacctgtttcaccgtaagctacactcataatgttgtgggcactccacttgagaaaaagcttatggcggctgttgatgaggctgtccgcacaatgcagcgagaagtagtttcaacagaagacagaccattccgctaaggaggacaaaacaaaatgaagttcaatataggatttatacctactttgcttttgctgatacctgtgatattcgcctgcttcaagacacctgccgacaagcctgagcttgaggacgagaacattatcgtctttatcgcaaagtgtgtgggcagatttggctgcataggctatatgtgccttgctatcggagattacgaggtaggcttttcaagcaagctgcttttcctaatatgggctgttgttgcactgctcgttatcgcactttattgggtgctttggataaggcagtataaaaaaggcaatcattttgaagatatttacggcactgggatcccgcttttcattatccctgcggcattcgtgcttgtgacaggtatcttctcaatgaattttatgcttatcatattctcagtgctggatatcgtttgcgaatactgctctgcatacggtgtaagaaagcgtctgcaccctgcaaagacagaggaaagctcagacgaggctgaaacaaaagagaatgaggacggagaataataccgctctcagtaatatatttttcaaaagaggtaataaaaaatggcgtgtaattatttttgtgacggagtagacaaagctccacagagatcacttttcaatgctcttggcatgacaaaggaagaaatggacagacctctcgttggtatcgtatcttcatataatgagatagttcctggtcacatgaacattgacaagatagttgaagctgttaaaatgggcgttgcaatggcaggtggaacacctgttgtattccctgctatcgctgtttgcgacggtatcgctatgggtcacatgggaatgaaatattctctcgttacccgtgaccttatcgcagactcaacagagtgcatggctttggctcatcactttgacgctcttgttatgataccaaactgcgacaagaacgttcctggtctgctcatggcagccgcaagagtaaacgttcctactattttcgtatcaggcggtccaatgctggctggtcacgttaagggcaaaaagacttccctttcaagtatgttcgaggctgttggtacttacaacgcaggcaagttcactcttgatgacgttgaggaatttgagaacaaagcctgtccgacttgcggaagctgttcaggtatgtacactgcaaactctatgaactgccttacagaagttcttggcatgggtcttagaggaaacggcactatccctgctgtatattctgaaagactcaagcttgcaaagcacgcaggtatgcaggtaatggagctttacaagaagaacatcaaaccaagagatatcatgacaaaggacgctttcatcaacgctatcacagctgatatggcgcttggctgttcaacaaactcaatgctccacctccctgctatcgctcacgagtgcggagtagagcttgaccttgactttgtaaacgaaatatcaaagagaacgccaaacctctgtcaccttgctcctgccggtcacacatacatggaagacctcaacgaagcaggcggagtttatgcagttctcagtgagcttaacaagaaaaaccttatcaacacagactgcatgacttgcacaggcaaaactgtcggtgagaacatcagcggcgttgtaaacaagaaccctgagcttatcagaccaatagacaacccatattctcagacaggcggaatcgcagttctcagaggaaatcttgctcctgacacctgcgttgttaagcgttcagccgttgcgcctgaaatgcttgcccacgagggtcctgcaagagtgtttgactgcgaggaggacgctatcgctgctatcagaggcggcaagatagttgagggcgacgttgtcgttatccgttacgagggaccaaagggcggtcctggaatgagagagatgctcaatcctacatctgctatcgcaggcatgggtcttggctcaactgttgcgcttatcactgacggacgtttcagcggtgcttcaagaggtgcttctatcggtcacgtttcacctgaggcagccgtaggcggtcctatcgcacttgttgaagaaggagatatgatagcaatagatatcgacaactgctctatcacacttaaagtatctgacgaggagcttgctgaaaggagaaagaactggaagccaagacagccaaaggtaacaacaggctatcttgcaagatacgcttcacttgtaacttctgcaaacaggggtgctatacttcagataaaggactaatatccgatacaaaataataagggagaaaggcggaataatatgaaaaaattcatttcaggcttgcttggaatactctttgtagttcttgtagtagtaggtgttttcatctgtacatatgtattcaatcagccgtcaagatcaggcgattcaagagagcttatctctggaacatggacagataaggacgcaaacatcacttttgagttctctgacgagggtgatttcactatcactcacactgataacaaatcagttatcgcaaagggctggtttaaaattcaggaggacgggggaagcggaaagatacagcttcttgtaaatccgtctgacagagatacaactgttgacatcggtctgagaatgaagttcttctcgactatttcctacaaaaacctttctgtaccgtctgaggacgagggcgacaaggtcgctacctgcaagttcattttccagaactctgacggagtttactcatgcgagagaaaagactctgacggctcgttctacgacggcaaataacgaattttcaagggctacggctgaacgatatgtttagccgcagcttttgtgcagtaaagacttgattaagataaaaaaggagtaaaaatggagctactgatcaaaaatatccgtgcctgcgacccgcagacagggcttgacggtataacggacataggcattgacggagaaaagatagtcagccttggaaaaactgacgagcaggctcagagagttatcgacgcaaagggcaagctttgtgcattgcctgggcttttcgatatgcacgttcactttcgtgacccaggtcttacctacaaggaggacatcatcacaggtgcgaacgccgcaaaggcaggcggtttcacgggcgtcgcttgtatgccgaacacaaagccgcctatcgactcccctgagggcgtgaaatacgtttttgaaaaagcaaagaaaacaggtatcgacgttttccctattgcctgcgttacaaagggcatgaaaggtcaggagctttgcgactatgacgcactcaaagccgcaggagttaccgccatttcagatgacggcagacctgttgagaacgctgagcttatgcgtcaggctatcgaaaagactaacgagaacggtcttatcgtgacttctcactgcgaggacttgaagataataaacggtggtatcatcaacaagggcgatatatccgaaaagcttggagtaaagggcatggacagagcctctgaggactatatcacagcccgtgagatatgccttgcaatgagctgcaatgcgagagttcacatatgccacgtttccaccaaaggctctgtgaacatcataagagcggcgaaaaaggacggcgttaaggtcacctgtgaaactgcgccgcactatttcacattcacagacgaaaagcttttagcccgtgacgcagatttcagaatgtcgcctccacttagaactgaggaggacagggcggctgttgaggaagctgttcttgacggcactatcgactgcatcatcaccgaccatgctccacactccgcagaggaaaaggctgactttgaaaaagctccaaatggtgttgtgggacttgaaacttcccttgcagctacgcttacaaagctttatcacagcggcaaatgcggtcttgacaagatagcagaggtaatgtcggtaaatccgagaaagataatgggacttgagcctatcaagatagcagttggcgaaagatgcgatctttgtatctttgaccctgactatgaatgggaagttatccctgcggagcttaattcaaagagcaaaaacagcgtgttcaaaggcacaaggctcaaaggcaaggtaatgtacacaatatgcagaggaaagctcgtttttgagctttaatataaaaatatccgaaaggaagataaaaatggcatttgacagacttattgaaaatatcgtaaagacacagaacccatcagtagtggggcttgacccaaagcttgactatgttcctgaatacatcaaggaaaagaagttcaagaaatatggcaagacgctcaagggtgcggctaaggctatatgggagttcaacaagactatcatcgacgagatacatgacatctgccctgctatcaagccgcaggctgcatactatgaaatgtacggctatgagggcgtaaaaacgctttacaagactatccagtatgcaaaggaaaaaggtatgttcgtcatgacagacggcaagagaaacgatatcggcgcaactatggaagcttacgcaaccgcacatcttggtcttactgacgttggcggtgagcttgtggaagctttcggcgcagacgctctcactgtaaacggctatcttggttcagacggtataaacccgcttcttgaccagtgcagaaaatatgacaagggcattttcgttcttgtaaagacatcaaacaagtcaagcggtgaacttcaggatcttatgataggcaacaagacagtttatgccacaatgggctcaatgtgtgagctgtggggcaaggacgttatgggcaagtatggctacagcggtgttggcgcagttgtgggtgcgacttatcctgagcagcttgctgagatgagaaaggctctgccgcacacattcttccttgtaccgggctacggtgcacagggcggcggtgctgagggcgtatcaaaagcatttgacgatcacggacttggtgctatcgtaaactcctcccgtggcgtaatgtgtgcatacaagaaagaggataactgcgacgagcatgattttgcaaaggctgcaagacgtgaagttatcagaatgaaagaggatataatctcatatctgccaaagatcacacttgaataaacactaaaggagtgactgagtatgacagcaaagggcgttatattgtttacagcgacggtgggagcattgcttttatgctcctgcgcaaagaacgaggatacaagctctttgacggaaagtcagcaggagcaaagcgattttccaagatgtatcgtaggcgagtggaaatgccacgaaacgccccttgacaacagcgagctttattcgggctatctcagccttattatccgttcagacggcaactatctcatgtatgacgcagaagcaggcaatccctgcttaaaaggcactatcgaaatggacggcgacgatcttgatcttatctttgttgatgacagcggagtggattttgcgccacctgccggttgggagaatatgtccaaaaggcaggagataggctattttgctgacgcttacacgctaaaacttacttatactgatgatgataactcggtcactctcgtttttgatgcagtgaacgctccgaatgaagtaaagaactaagtacagggaggatttttaatgtacaagcagggtaaatacccaatagtttcaaaaaagacccttgcaaaaggaatttttgacattgagatatactgtccgcacattgcaaaggcggcaaaggcaggacagtttgcacaggtgcaggcagagggctttttcctacgcagacctatctctatttgcgatatcaacaaggacaagggtactatccgccttgtttttgaggtaagaggtcacggcactgacaagataagcgagcttaacaagggcgatcttgtcgacattatcgcaccgctgggtaacggcttcaaggtgcttgaaaagggcaaaaaagctgtctgtatcggcggcggcataggcacgcctccaatggtgggcattgcaaaggaatacggcgagaacgccactgttataagcggtttcagaaacgctgcggctgttattttgcaggaggacttcaaagctatgggctgtgacgttcagctttgcactgacgacggctcggcaggaagaaagggctttgttactgacgcacttcttgacgtgctgaaaagcgaaaagcctgatatcgtttatgcctgcggtccaatgataatgctgaaaaatatcacaaagatatgtgaggaaaacgacatttactgtcaggtatctcttgagcagagaatggcttgcggcgtgggtgcgtgtcttgtatgcgtatgccgcactgtcaaggacggtcaggagttcaattctcacgtttgcaaggacggtcctgtattcgacagcgaggaggtagtgtttgatgaataggataaatgtgaatttctgcggagttgagttcaaaaaccctgttatccctgcaagcggaacatttggctacggcagagagtacgagcagttctatcccctttcaaagctgggcggaatatccgtaaaaggcactacgcttcaccgccgtgagggcaaccccggtccgagagttgcggaaactccaagcggtatgctcaattctgttggacttcaaaacggcggcgttgacaagttcataaactacgagcttccaaaccttgtgacaaaggacacaaggataatagccaacatagcaggctcaactatcgaagaatgtgcagagcttgcagaaaagctcaacggcacggctgttgacatgatagagcttaacatatcctgcccgaacgtaaaacagggcggagcggctttcggcactgactgcaacgttgcaggtgcggtcacaaaggctgtaaaggacgttacggaaaagcctcttatggtaaagctttcaccgaacgttacaagcattgtggacattgcaaagtctgttgaggcaaacggtgcggacgctgtttcgctgataaacacgcttctcggtatgcgtatcgacataaagacacgccgtccgatactgaaaaacaacgtgggcggactttcaggtcctgcggtgttccctgttgccgtaagaatggtatggcaggtggcaaacgctgttaaaatacctgttatgggcatgggcggtatcgccacatgggaagacgccattgaaatgatgatggcaggcgcaggagctgttcaggtaggtgcggcaatatttgctgacccttatgcacctgtgaagatagccgagggtatgcagaaattctgcgaagacaacggcattgacaacatctctgagatagtcggcactgttaacccttggtaataacatagtaaaatatccgtctttttacagggcggatatttttatggtattttttcttatgaatttcttaaatccattgaaaacagcttgcaaaagtgctataatttatgtcgtcaggaaaggctgacagagaaaggggaaagatatgtttcttagagtactttgcgtgataacatctgcacttacagttcttaccacgctttcaatgacatcatgcggagcagacaacaccatttcgtctgaggcttccgaaagtgctgttacatctacggcagacagcggtaaaactgcaaaggatatcctttcggcaatagagggcgaccacatggacgcttcaactttttacggtgaggacagcttcacaaagaataccgaaaagctttatggtatagaagccgacaagctcagcgatggaggaatactttactcctctgacggcaattatgctgacgagatatcaatgcttaaaatggctgacggaagcagtgcaaaaagccagcttgcagacaggctgaactacagacttaatcaatatgaaaactacaagcctgaagaaacaaagaaaatacaggcggcaaagatatttcaggccggagattactgggtgcttgttatctctgacaatgctgacgagatatctgacgagataacagacgtgataaattaaaaacggaggaaagaaaatgacaactgcgaaaaaaatacttacccttgcactttgtctgacctgccttacagcgagtatgacaggctgtgcaaaagataaaagcagttctgatactaaaattgctaaaaccacatcatcacaatcagaaagcagcgacagcgagaagataaaagagcttaacgacaagcttgaaaagctggaaaacaagctttctaacattctgggggaggatatatttgatcccgcagacggtgacggcaacgtaaacggtgagatacaccctatctatgatgatacggcagtggttgaagcttacaagtcgggtgatgattcaaagctcactgacgataaggacaaatacatactcaaagagctaaaaaaggctgttggcgagataatcaaagacggcatgagcgaatatgacaaggaaaaggctgtttatgattatgtgttctctcagacccactttaatgacgattctcttgtggcgatatctgatgatagtgaagatgacgagtcgtacaatccttacggatttttccacgaccactctactatctgtgtaggaaacgcaacaacaataaagcttttttttgatgttctaggtatcgacagcaagataatacactcaacagaaaacggcgaacacgcttggaacgttgtgaagatagatggcaaatggtatcaccttgatgtgacatttgacggtggcaacgaagctcctgactacgcatatttcaacgtacctgacactgcaaaggacgacggctcttatccttggaacaaagaggacttccctgaatgcaattcaactgacgattgctacatatgcaagaatgccaagaagcttgacagcgtttatgatatacctgagcgcataaaggaagcaatggcagataaagggaaaactgtatatatgtcactggacgtgccggagggagcaggcagcactgctgttgcggagcaggtcacaaacataatatcaaacttttacattgacgattacaacgtctcttccacacctgttattgacgcaggggacaaggtttgctttggaatttctttaaattcggcagatgatgacgattcggataattcttatgacacagacaatgcacttggcattgattacgacaagctttcaaaggctttctcagatgctctcggaatagattatgagtatgagcctgattattctgataataacataatgggttaaagcttataaggggattctttaataaaagccgcagggcatacagcgtaaaaactgtataccctgcggctttttatatcggatttgatcgaagaaagcttgttcattgggtcacacgtcagcttgcctgactgtctgcccttttccgattttgtatgtttgagaaattagctctcgaaaagtgctgttgaaagatatctctcacctgtatcagggagaagtgcaacgatagtcttgcccttgttctcaggtctctttgaaagtatctcggctgctttaagtgctgcgcctgatgaaataccaacaaggataccctctgttttagcgaacttgttgcctgtcttgaaagcgtcctcattctcgataggaaggatctcgtcataaacctttgtatcgaggacatcaggaacgaagcctgcgccgataccctgaattttgtgtggacctgatttgccctgtgaaagaacaggtgaagttgcaggctctactgctactatcttaacgtcagggttctttgatttgagatactgaccaacgcctgttactgttccgcctgtgccaacgcctgcgataaagatatctaccttaccgtctgtatcttcccagatctcaggacctgttgttgcaaagtgagcggctgggtttgctgggtttacgaactgaccaaggataactgagttctcgatctcgcccttaagctcgtcagccttcttgatagcacctgtcatgccctttgcaccttctgtgagaactatctgtgcgccatatgccttaagaagatttcttctttcgatactcattgtttcaggcattgtaagaattaccttgtagccctttgatacgcccacagccgcaagaccgatacctgtgtttcctgatgtaggctctataatagttgcgcctttcttgagaacgcccttcttctcagcttcctcgatcattgcaagtgcaactctgtccttaacgcttcctgccgggttgaaatattcaagctttgcaaggatagttgcgtcagcctctactgccttttcaaaattaactgcttcgattattggagtttttccgataagctccgaaacgcccttatagatctttgacattttaatctacctccgatatgaaaattattttatgcggttttctgtaccgcttatgtttgctatggttatactatatcactttattcctactatgtcaataggattaatatgctttctgcgttttatacaacaaagtcagcttattgcaagctccaatttgtgcattatgacctataatcatactcagtgatgcaatatggcttattattttcatcacaaagctccacaaattttctgccctcatgggtgtaaacaagagcctttatggctttaccacgcttcaagggatttttatattccacacggatacgcttcacagcagactcgttatccacaaactcgtctgttatgtcaagatatctcgcattgttgacgtgttcgttcatgtcgatatagcatttcaacaccgggatattctcatacacctgtggctcagtatcaggtagggctatctttcttggaagatactccatatcaagctttggatagagcttcaccctatcaacaagctcctgtggaacttttataggccgctgagaggtcttgtccatgaaagcgccagaagctatagacttcacgcagatatcaccgttttcatcatatataactgtgtttctgtagccatacattctttttagctcatatgtccatgttttgacggtgagcttttcgttttgctcaggtctgcggactatatcgagctgtcttgacacaagaaacatcacgcagttttctttctcaaaaaaaggcgacataacagggtgagtgtcaaggtggataacagagcaatcctgcaaaaggtcaacaaggcagctatttcttattatgccatgcgaacctatctggctgcaatttacagtgcgtttcatttcatacatattgctttcctccattctgctatatgataattatacaacttattgtcgcttttttcaacagcacataggtacaaatgttaacagaggtaaagaaatgttaaaaaaaacttgttgaaattagtccgctttgctacttataatgatattacagcaattttacaggaggcaaaatatgtttttatggttaatgatagctattcttgtggcggtctgctctgtggctggctttatttatctcacaagaagaatatcagcttttggctttataaaaaagctttcaaaggataaaaaggtacttaaatacgccataagtgcaggtcttatagtactcacaggcggcataatatggcttatatgggactggataaatgcgataatctgtttgttgcatcttgttatattctggcttttgtgcgacttgtttgtgttcattggaaagaagatatcaaagaaacaggcaagcaaatgccttgcaggctttatcgccgtgccgctgacggtggtttatcttgcggtgggctggtatctttgcagcaatgtgtgggaaactgactacactctcaagacagacaagaagtcgggggatataagaatagttcaatttgcagactctcacgttggcacaacgttccatggggacggcttcgcaaagtacatggaagagatacagaagcttgaccccgatgtggtgcttataacaggcgactttgttgatgatgacacatcaaaagaggacatgatacagtgctgtgaagctcttggcaagctgaaaacaaactacggcgtttatttctcatttggcaaccatgacaagggatactatgacccttcgtatcgtggctatagcggtgacgatcttattgcggagcttgaaaagaacaatgtcaacgtattacaggacgacaccgtgcttatcgacgatcgtttctacataataggcagacaggacaggtctgaggaaatggaaaagggcggtcacagagcatctatggaagagctcacaaaggatcttgacagcttgaagttcacagttgtaatggatcaccagccttgtgattatgacgctcaggcggcgtcaaaagtagaccttgttttgtcaggtcacacacacggcggtcagctcataccaataaacttccttggcactctcatcggcggcaatgaccgcacatacggctatgaaaagcgtgaggacaccaactttatcgtgacatcaggcatttcagactgggcgataaaattcaaaacaggctgcaagtctgagtatgttgttattgatgtttcggagaattaaatagcaggacaaagcaaaagggtcagcgaaaatgctgacccttcagtctgtatcagggctttgaatgcttttctatcgtgatttttttccaaaatgttcatctgcctttcgggcgttcgctgtgtcgaaaaacgctgtgtataaaagtttagcacaatgtttacctgtagtcaagcaccgaaccattgacaaattgcacttgtggatatataatttaccatgaaactacactttgaaaaggaggtgtggcagtgacaaaggtcatatatcctgttatcggcaggcagacttccctgcccttttatctcaccggaataggcatttccgaccctgaatatcatgtcacaagggacaaagggcttgtttcacatcaacttctttttacctcaggtggcgagggcaggctaattgtcgggggagaagaatttgtgcagactaaaggctcggcattttatctgccccctagcgttccgcatgaatattatccctcaaatggaaattggataacaaactggatagttttccgtggtgaatttgcggggcaaatgcttgcaaaccttggctttgacagctttagattctcccctgagataaacacccaaaaacccgctcagctttttgagcgaatttttgttgccgctgccgaccctgtgaattgtggcgaaaaaacttccgcacttgtgtatgaatatatcctcgccatgaggactgcaatgcttttccccgacagccgaaacaacgtgggaagcattacaaggcaggcgcttttgtatattgacagccgatacatggaggatatcaccgcagaaacacttgcaggactttcgggagtgtcagtacaacatttctgccgtgtttttaaatcagaaacttcaatgcgtccccttgaatatattgcaaaacgacgtatctctcaggcaaaatctctgcttcttaacaccgactctgacataggcgacataggcaagcaggtgggctatgaggacagaaactatttcagcatcatttttaaaaagctggagggcgtttcgccaagagaataccgtcgttcaagaggaacaggtttgtaataatattttaagctttattagaattttcttagcatatttcaaagcaaaatgttcgtatcttaataatatgcaaaatatttcagattgaccatacactcctttaagcttataattgtcataagaaagcaataagccatgctttatgcaaggaggataacttatgacgatactaaaaaggagcgcgtcaatggtgtcagcattggtcatgatgatatctagcgcaggcgcttacaattgcagtgcggagggaacaacggtgaacgatagcaatacaaataatacaagagagatagttattgacggaactacggctcagctcaaagaaaatatgcgctacagaggggcaggcatggtgagtgcaaacaactcatcaaggcttctgttggattacaaggctgaacaccctgatgtatatgagcagataatgaagtatatgtttggcaaagagggtatcggcattactcaccttaagttggaaatgggtgcggatataaactcatcatcaggcacagaaccgtctgtaatgagaacagaggacgaaaaggctgacgtaacaagaggtgcggcataccagcttgccgctgacgcaaagaagataaatcctgacctcaccttggatatgctttggtggagtgaaccaaagtgggtatctgacgcttccgacgtttatgctgcaagatacaaatggtataaaaacacccttgacgccgcttatgaaacatatgggcttgaatttgactatgtaagtgctgtgcagaatgagcgtggagcagaccttgaatgggtgaaatatctttcctctcatctcaaaagtgaaaaagacaccccttatgactactcaaagataaagatagtcggtggagaagaggtctgcacatggggctttgctgacagaatgtatgaggacagcgaacttatgaacgttgttgacgtggtgggaagccattacacaagcgagtccaccgagaacgcacagaagcttgcttataaagaaaacaaagaactttggttcagcgaagcaagctcgccaatggcatatgcgcagggtacatacagatatgacggctcaggtctggcaggcataaacggcacccttgatattgcaaacagaataatcggaatgtatccaaacggcaaaatgacactttatgagtatcagcctgttgtatcggcatactatgacggcgcttgctactgtcagaaacagcttatctcagcctgcgacccttggagcggttattatatgcttgacagcggtttttatatgtcactgcatttttcgcagttcattgaaaaaggctgggcattcgttgacagcggatgctacagcgacggcaaaaaaggcggtgacggccacgctatcgtcgattcagtttacagctatatgaccgccacagacacagaaacaggcgattacagcactgttatcacaaacactacaagcgagcctatacagtatgacctcaaggtatcaggacttgacaaggcgtcaagcaacgtgagcgtatgggaaacaagaggtcctgacagtattgacggcagctatgacgagaattatttcaagaaaactgaggatataacccctacagagaacggcggagcttatacatactctgtgacagtgaagccaaattctattgtgacaatttctactgttacacctgagcgcacagaatacaaaaacgctgacgagagcgaacgcactgttttgaagcttccatattcggacgattttgagtatgcaggctatactgagaattatctttcatcaaggggcaatgcgccaagatacacaacagatcagggcggtgctttcgaggtggaaaagaccgacaagggcaatatgctagttcagcagataacggctgatatgaaagccaacgagtggggctacacccccgaacctgtgactacatttggtgacgacaggtggtataactactctgtgaacgttgacgctgcttttgcgacttcgcaggacgcagaatcaaactatgtgggtgttggtctgagatacacgcttggctgcaattcatacagtggctattggataaagctttatgagaacggaagctgggagcttaaagcaaatgacggcactcttagcagtggaagcatagacggctttgacggcacagcttctcacaagcttaaagtcgaggctgtaaacaacgttatccgtggatatgttgacggaaacatggtggctgaatacactgtgaacgagggtgaatctcttataagtgcaggcagagcgtcacttttcagctcatacaacaaaaacagctttgacaacttctatgctgaacctgtggatggcagtgacacatatgtaactcgctttgacgaaacagactcttgcttcacctttgagggcaactgggaacacaaccttatgagcagcttcaaaaactacaaacgaaccatatcagatggcacagagggcgactctttcacagtaagctttgagggaacaggctttgcgctttcaggtgaaacaagtgaaaacgctatactcggggtatcaatagacggaggtgatgaacagctcgtgacagtttcaaggacaggtcagcgtgagatatcatgccattttgaaggcttgtctgagggcgctcacaccgcaaaggtaaccataaaatcaggcaaatatacaattgacgctatgcaggtaacaggcggaaagataccattcgagaagaaaaagcctgcgaagtctgaaagcactaaatcaggcaaaagcaagcttcctatagctgttggggcaggcgtttgcgctgctacggcagttggtgcagtgatatacggcatagccagaaagaagcgtaaggaaaataatgactaaaataagcagaacaacagacatgacacaaggcagtgaaatgcggcacataataatgttttcactgcccttgcttgcagggaatcttttgcagcagacatacaatatagtggacactatggtggtggggcgttatctgggcgatgacgcccttgccgctgttggtgctacaggctctatcacttatcttttttacaccctttgcatagggctgtcggtgggtgcaggaataattgtcgcacagtatttcggtgcaggcaagaaaaaagccctgcagtcggcagtgttcaattcggcacttgtcacggctattttcggcgttgtaataagccttttatccgtgcctgccgcaaaacctatactggagcttttgaaagttcccgacaagctcatcggagattctgcggcttatatgcagatagcctgcggcggaacgatagcggtggcagcatacaactggataaacgccataatgagggctttgggcgactcaaaaacaccgctgatattcttaggtgcagcaagtttgctgaacgccctccttgacctgctttttgtggtggtattcaaattcggcatagcaggtgcggcatgggcgacagtgcttacacaggcactttccgccatttcttgtattgtgtactgctttgcagtgagcggagagataaagctcaccgccgacgatctgcacaccgacaaggacatgatgagccgctgtgtgaaaacaggtgtgcctatcgccatacaaaacggacttatctcggtatcaatggtggctctacagcgtgtgacaaacggctttggcgaaacagtcatggcggcatacacagtttcaatgcgtattgagcagttcgttcaacagccgttttcttcacttaatgcggcggtttcaacattcacaggacagaatatcggtgcaggacaagaaaaacgtgcgcagaaaggtcttgcttgtgcaataaagatatcggtgatattctcggcagtggtgcttgtgctgttcacgctgttcggtggagcgataacatcttggtttgtcaagggcaagactgttataagcatatcggcaaaagcgcttatcataacctcacttttctactggtcgctgggtattatccacaccacaagaggatttttgaacggcgcaggcgatacaaactatgcccttgtaaacggcatggcggaggtaatatgcaggataggtctttcacttatcctcacaaggatagctttcataggctattggggcatatggtacaccaccgctgcaacgtggtttgtgactgctatggtgagccttataagatacaagggcggaaaatggaggcttcattcaattgtaaaatagattttcataactgctgtaccgatttggtgcggcagttttttttaagttgaaacagtttcacattatatatgaaatattcatatgaaaccatattgaaaattcatagtgcagtggtataatataataaaaggagtgacgagcaatgaacattaccgaatttgcaaaagccgcaggagtatcaaaatctgctgtgagcagatatttcaacgacggctatgtgagcgaagaaaagcgcaggcttattgaagccgccatagaagccacaggctatgccccaagcgttcaggcgcagaacgtaagaacaagggtgacaaagcttgtgggagttattataccgaagctttcaagtgagagctgtgcaagagaggtggagggaataagtcaggtactcagtgagcagggctatcagcttttgcttgtgaactctgccaacgacccaaagaaagaagtggaatatctggagcttttccgaagcaatcgtgttgacggagttatctttttggcttctgttttcacttcgctccatgacgctgtgctgaaaaaaatgcgtgtaccggtggtaattgtgggacaggaatacaagggtgcaaactgcgtttgtcatgacgattacaaagccgcctataccgcagagaagcttatgcttgacaaaggctgcaaaaagcccgcttttatcggtgttaccgagcaggacaaggcggcaggtcaggcaagaaaagacgggtttatccacgccctttctgataacggcatcaacattgaaaagtctgatatgcagacggctgaatttaaaatggactcaggctacaaaagggctttgacattactgagaagcggcagaaagtacgaccacattttctgtgccaccgacaatcttgccgcaggcgcgctccttgcctgccgtgagcagggattgaaagtaccagaggatataatgatagcaggtattggcgactctcagctttgtaaggtcacgtccactcccctgacctctgtgcattttcattatcgcaccgcaggcatagaagcggcacaaatgctgctcaattcactgaagcgagaaagctctataccaaggacactgacgctcggttttgagctggaagagcgtgagtctacagagaaaaaatgtgaaactgtgtgaaaccttgtaacaccgccttgtaagtttatattatttgtcaatagacaaatgcactgtcatgggttataatatagttaatgaaatcggtatcacataaatgatgaaactgataaaataacatagttcgggcaaaataataataaacaagcaaaggacgggatattatggatcacagaagttcagctcgtgagatactttctgctataggcggaaaggaaaatctggtcagtgccgcacactgtgccacaagattaagacttataatcgcagataactcaaagatacagaaagaaacattggagaacattgacgttgttaaaggcgtttttgaggcgtcaggtcagcttcagatcatcataggcaccggaacggtaaacaaggtctatgacgaatttatcgcagaggcaggcgtggaagcctcttcaaaggacgaagtcaaggctcaggtggctcagaagcagaactggttcaaaaggcttatcaaaactctcggcgacgtattcgtacctataatccctgctatcgttgcaggcggtcttatcatgggaataatggaagctttgaatttcatggcttcaaacggctttatctcccttgacacaaatggatatgttttcacaatattcaaactgctttcaaatgcagcattcacattcctgccgatacttattggctattctgcaactaaggtgttcggtggcaacccttatcttggtgcggtaataggaatgttccttatccaccctgacctgcaaaacgcttggacagtttccacaaacggatatgagcagacgttctccatatttggtctgttcaacgttcacatggtaggttatcagggtcatgtaatacctatcataatcgcttcgttcattcttgcaactatggagaaaaagcttcacaagaaagtgcctgacattgtcgaccttttcgttacacctcttgtgagccttacagtaacagcttttctcgtttacacctttatcggtcctgtattcgttgcccttgaaaatggcattatcacaggcgttcagaagcttatcactatcccattcggcattggttcgttcataatgggcggtttctattcaacaacagttgttggcggtatacaccatatgtacactgttatcgacattggtcagcttgctaaatatggtgcgacatattggctgcctctggcatctgccgcaaacatggctcagggagccgcctgccttgcagtggcagtaagaagcaagaacaataagataagatcaatggcttatccttctgctctgtcttgtatgcttggcatcacagagcctgcaatattcggtgtaaaccttagatttgtaaagcctttcatattcggttctatcggcggcgcttgcggagcaatggtcgcttctatcctacaccttggcgcaactgcaacaggtgtaacaggaatatttgcaatacttcttacactcaaccacccagtgaagtatataatatcaatggctgtagcaatgggcgttgcattcactcttacttggcttttcggcacgaacaacgagcagataaaaaacgagaacaagccttccaaaaacaagacagaaaaggctgaacagcctgcacaggctatggaaacaaaggctgaaaatgcagacgtagcagatgacggcattatcacagctccgcttagcggcaaggctgtaaagcttgaaaacgttcctgaccagacctttgcgcagggcatacttggtcttggtgcggcaatagaacctaccgagggcaaggtcgttgcacctggcgacggcaaggtcgaaacgctttttgacactttccatgcagttggtttgacacttgacaacggcaaggagcttcttatccacgttggaataaacactgttgagcttaaaggtgagggcttcaaggcttacgtttctgagggcgacagagtaacaaagggacagacgcttatcactttcgatatggactttataaagagtaagggctatcagactatcacacctgttcttgtgggcaattcagacgaatttgcctccgttgaggagcttgcagaagaaggcacagaagtgactataggagataagctaataaaggtaaacgcataaagtacagacaagccgtcaataattatagtcaacgcattaaaaggagaggatataaatggataacaaagaaaaactggaaaacagagaaagaataaagaacgcaaaatggcgtcagagatttcatatcgaaccgcctgacggctggctcaatgacccgaacggtctgagcttttacaaggacgaatatcatgtttattttcagtacagcccaattgccgctgacggtcacacgccaagaggctggggacattatcacggcagcgaccttatgcacatgacttatgacagagcagttatgatgcctgacattcctgaggacagccatggtgtttactcaggaagcgccattgaaaatgacggtgttctgcatattttctacacaggtaatgtgaagatgacaggcgattatgattatgtcaaagccggcagaggtgcgaacgttatccacgtcaccaccacagacggcagcaaaatgagtgaaaagcaggtacttctcagaaacagcgactaccctgatttctgctcatgccatgtgagagacccaaaggtgtggaaagatggcgacatatggaaaatggtgctcggtgcaagaactcttgacgacgagggctgtgtgcttgtatacgaatctgacgatcttataaactggaaatacaccggcaaggtatacaaagagggctacggctatatgtgggaatgccctgactatttcgagatagacggcaagggctttttaagcacctgcccgcagggtatgcctcactatgaaacaaagtggcagaaccttaacgaatcaggctacttccctgttcagggcaagcttgaggacagcgttctcggtgacttcaccgagtgggacatgggctttgacttctatgcaccgcagacatttcttgacccacagggcaggaggatactcataggctggcttggcatggataacaaggtctacggcaatgccacaactgagcttggctggcagcactgccttaccataccgagagttgtaactgttgcacccaacggcaagctcagacagcagcctatatctgaatttgacgagcttaaaagcaacgcacgccgtcagagcagcggtcaaactgcagaatatcctctgccatttgagcttgacggcgagcctgcggacagcttcagcatatctcttgacggcaagctggagcttagctttgataaagaaaagcagcttttttcaatgaaatttaccgatgaaaaatacggctgtggcagaacaacaagaaatgcagagatagacagcgtgagaaacataagagttatcgcagatatgtcaagcattgaggtatatatcaatgacggcgaaactgtaatgtcaacaagaatatatcccgataatgacagcgtaaagcttaaagtaaacggctttgaggcacaggtttgggacatctgagaggaggaactgcaatgggaaacacactttttgccataggcgaagcactgatagattttattcctgcacagacagggtgtgcctttgaagaagtaacggctttcagccctaaaagcggcggagcgcctgcaaacgtctgcggagcgttcactatccttggtggaagctcgaaatttatcactcagcttggtgatgacccattcggaagaaagatagcaggcgaccttgcaagggctggaatcgacacttcccttgtgagcttcaccgacaaggcgaacacagctttggcttttgtgagccttgaaaatgacggcaacaggacgttctcattctacaggaagccctccgcagatatgcttttttcagcggagcaggtaaaagaagaatggtttgaggacgcatacgcactgcatttttgcagtgtttcccttggagattttccgatgaaagacgcacacaaaaaggctatcgcctatgcacgtcaaaaaggcgcaatgataagctttgaccctaatctgcgctttcctctttggaacgacaagaaagctctgcatgataccgtgaatgagtttataccaatggctgacattgtgaaaatatcagacgaagagcttggatttatcacaggtgaaaacgacatcaaagccgctctgccaaagcttttcacaggcaatgtgaagcttgtgatatacacctgcggctcagagggagcatatgctttcacaaagaacgcacaggcatttgcagagagcgaaaaggtgaaagccgttgacacaacaggtgcaggagacggatttataggctcgttcctatatgcactaaaaactctcaatgtgaccgctgaaagcctttgtgaccttgacaatgcacagctagaacgctgtatagcgttttcaaataaattctgcggtgaaagcgttaaacatcagggtgctatcgactcctacagaaaaatagaatttatataaatttgcataataattatcctttaataatacatttccttaaaacaaagccttccccttttgggagggtttttgttttcggcaaatttcacaaaacacttttgcagtatatgtaggggacggcgccctcgacgtcccgcttttgcgtttttgaaaggctcgtttttaacacgttttagcatagtaatatgatactttgtgaaaatttgacaaaagccacgatatactatataataaagattgtatgactatttttacaggagaattattatgaacgaaaataaaaacagagcaacctttcaatcccgattgggatttatacttgtgtccgcagggtgtgccattggtcttggcaacgtgtggaaatttccatacatctgcggacaaaacggcggcggagcttttctgttcctataccttatctgccttgtgctgttgggtcttccaatactcatatgcgaatttgccataggcagaggaagcaaccgaagtctttctcaggctttcaaccgacttgaaaagccaggtagccgatatcactgcacaaaatacacaagcattgcaggaaactatctgctcatgatgttttacaccatggtcacaggctggatgttatactacgctttcaaatacgccactggctcgttggacgcttcaagcacagcggcaacggctgaagcttttaaggatatgcaggcttccccgtggctcatgctcatattctcggctatcgttatcatactttgtatcggtgtttgcgcactgggattgcaaaacggcattgaaaaggtaacgaaaattatgatgatactgcttatggcgctcatggtggtgctggcggtgaactctatcaggctgaaaggcgcttctgaagggcttaaattctttcttgtgccggactttgacgtctttaaagaaaaaggcttcacatcagtgcttttcgccgcaatgacgcaggcgtttttcacactaagcataggcataggcacaatggagatattcggaagctatttgaaaaaggaccgcactcttgtaggcgagtctgtgaacgttatcgttcttgacactgccgtggctgtcgttgcgggacttatcataatccctgcctgctttgcatacggaatcgagcctgactcaggtccgtcactgcttttcatcactctgcctaacgttttccaccatatggcttcaagccgtttgtggggaatattcttcttcatcttcatgtcatttgcggcgctttccactgttattgcagtgtttgagaacattatcacaatgtcagtggaactgtgggattggagcagaaaaaaatcacttattgtaaaccttgtgatgatacttgtgcttacaatgcctgctgtgtttggatttaacctgctgaaaaatatccagccaatgggcgcgggttcgactatcatggaccttgaagacttcttggtatcatcaaatcttctgccacttggctctcttgtgggagtgcttttctgcgttcgcaaaaatggctggggctgggagaacttcatcaaggaagccaacactggcaagggcaagcatatccctaactggcttcgcagctacatggcctacgttgtgcctgcacttatatgcttcatctatcttaaaggatactatgacacattctcaaacagaagtctgccggtccttataggctggatgtgctttgcggtgatacttcttgtgctgatattctgggcaactttctcaaaaagcaaaaaaaatttggaaaatcctattgacaaatagaaagtttggctatataataaaccttgcgtgatgtttcacgaaaattcgtataatgataaacgctataagaataaactgaaaggtggtgggtgaaatgagaaatattcttttcgatcgtctaaagactaacgagaatataagccttacaaataatgtaagttcaatgtgcctttcagatgtcattttgcctgcccttattaccaaaagctaatgagatttttatcagctttctggatattatactgcagatctattgcgacctctgatatcaggtatcagaggtctttttttgacctgttataggcagttacattatgcgaatttacagaattatatcggaagaatatgaaatttatcccgaaaaggagggaatacatgaagttttttgacgttttgccacagcttgcagaaaacgaactgctaaagcgtggagttatgactgacgagctgctttactgcgtaaaagctgaccttgacggtgagggcggatatgtggacgtatacataactttcacaaaagacaccctttgcatactccgtggctatgaagaatacggaaaaatgaagcgtgggcagaagagaaaaaatctcgtaagcttcacagtatcaggctatgatgaataccccatagacagcattgaagaaatgtatgttgaccgctatgcaaattccgcaagacttatgataaaggacaagtccggcaaggaattccctatagcgaggttctcacttggctttgctgacaaattcgagaaattcagccagcgtgtgaactgcacagccaagaacgagcctatcgacgaccgcctgttggaaggagtaaagacccactgtcctacctgcggtgagccttatcctgaccctaaccgccctgtctgtccgagatgtgtagacagacgctcggtgttcaaacgcctgctttctatgttcggtgaatttaagggttcggtatttctcatactgctcaccatagttttaagcaacgttttcgcagttctttcgccgatattcggctctcagatgctctatgatgatgtgcttgcggaaaacggaaaatactatggcaagatactcatgatagtaatgctcatcgtgggcataaacattgcaggaatgataatgcggataatttcaggcattataacctcaaaggtcgtgcctgttgttacgcaccggcttagggtgaagatattctcctcaatgcagcggctttcccttgactttttcacaagcaagcagacaggctcgcttatgtccagggtcgacagagatagtcagaacatctactggtttttcacggacatagtaccatacggacttacaaacgtggtaaagatagtgggcattgcggtgataatgctcacaatttcgccacttctgtcacttggtataatcctcactatctcggtgatagagatagttcagcaccaattttacaaaagccagcgcaagctctaccgcaaatatgacgttgcaatgcgttctgcaaactcggtgctgtctgacgttatgaacggtcagcgtgtggtaaaggctttcgcccgtgaggacagagagattgaccgctatagagtgaaaaacactgacgcatttttgataaactcaaggataaactcacgaatagcaaacactatccctgttatatggacgttctataggatagtgaacaagcttgttttctgccttggcgcagtgcttgtcataaaaggtcacatactattcggcgcactttctgcacttatctcatataccgaaatggcgatggatcctatcaactttttcacatggataggcgaccgctgggcaaaatgtatggacgccgcatcaagaatgtttgagataatggacgctctgcctactgtaaaagaggacgaacaccctgttcatatggaaaacatgaagggggatatcgagcttaaaaatgtatcctttgaatatgaagcaggacaccctatcataaaaaacgtttctttcaaggtgcaggctgggcatatgtttggaatcgttggtaaaacaggtgcaggaaaatccactatcataaaccttatggcaaggctttatgacgtaacaggcggtgagataaccattgacggtgtgcctatcaggaagatagcttttgacgatctgcgcagaaatatcggtatagtttctcaggaaactttccttttcatagggtcgatagctgacaatatccgctatgcaaaccctggcgccaccatggaagaagttatcgaagcggcaaagtccgcaaacgcacatgagtttataacaaagctccctgagggctataacactaaggttggcgagggcggaatatccttgtcaggcggtgaaaagcagagaatatctatcgcgagggctatcattcagaagcctaacatacttatccttgacgaggcgaccgcttccatggacacaaggacagagcgaaagatacaagccgctatcgacaatctgaaacagggcaggacgattatttctatcgcacaccgcctttccactctccgtgacgctgatatgctctgcgttatcgaaaacggagaacttaaagaaatgggtacacatgacaagctcataaaagaaaaaggcaaatatttcgagctttacaagctgcaatctgaagcattgcagttcataaacgaatagtaaggagatgaacataatggctgaaaatattaccgctgagcaggaggtctacgaggtcgataagctgaccttgcttgactgcaaaaagatacgccttgcaaaggaagaaagcggctttcttaccctcgattatgagggcaggacttatcacaaggtaaaccccacaaggctcataccattttactcaaagaccacctacataagcctttcatacgaaaattctgaaaaagaatttcgtgagataggcgttataaaagatatggcggagcttgacggtgagcaaaacaagcttcttgatagctatcttgaatacaaatactatatgcctgagataacaaaggtctacagcataaaggacaatatgcgtggtgcgatctttgtaaaggctgacaccacttcggggcagaaaactatctgtatccgtgactggtatcagaatttcagaatgataggctatgattatctctacgtcaacgacgcagacggcaacaaatatttttgccctgacattcacaagcttgacagaaagagccgtcaggtgcttgaaatgtacacctaaaaggtgttagaccacactgaaaggagtgtgaaaatatggatctaaaaacttccctgccacagaatgccccggcagacattgtttattccctgccagcgaacttcacctgtaagggcgacaaaatggacggacatttctgcgtgacaaaagaaaagatatacatttacaacggcagtgagataacacttgaatacagcatagacgatttctccgagtttgagtgcaaacagcagataggcacttcaatggctcagggaacgctgaaaagcggtgaaactatctgcttctgcggtttttcgcaggatcagtttctcagatacgccgagcttatgaagcttcttgaccactgtttgcgtacaggcgagcttatggagataactgacacggaagagcctgtatgcccaaaatgcggtctgccactggagggtgcaaaggaatgtatctactgcactggcaagggcaagacaatggtcaagctcataaaacgcattgcgccatacaagcaatattttgcgatcgcagttatatgcacgatactttccgaacttatatgggtgcttgcgccatatcttgacagagttataatcgacaagtatgttaccccgaaaaacacccattgggcaggacttgcaggagttatcatcactatcgtcaccctgctgcttttggcaggagtgtttgagtttttcaacatgaaaaacagcttcaaggtcgcactcaatctgggacgtgaccttaggcaggagatatttgaaaagtcacagcagctttccatgaactccatatcaaagcgaacagcaggcgagcttatcaaccgtgtttcaagcgacgccgcaaagcttgaggacttcatcactgcaaacggcaaggacgccatagtaaaaatactttcccttgtgataataggcatactgctttttataatggactggcggcttgcgcttatgacagttttgcctgtgccgatagttttcataatagtgcaaaagctttttgacgccatggcgatacgctacacaaaggtatggaaaaacggcgtttctcatggagaaactttgcatgatattttaaacggcataagggttgtaaaatcctacggcaacgaggtaagggagatacagcgttacacagaatgttccgaacgctgggcgaaaagctgcgttcgtgcggaaatgatgtggtatctcaccattcctgcctcagaatttatcctcaccattggtaacttcttcgtactgtatttcggtggaaacatgattctcgaccacaccatgacattaggtcagcttatacagttcaccacctatgttgcaatgctttacgagcctatacgctggcttatacagataccgagaaatcttgcggacacctcagtttccgcaggcaaggtctttgagatacttgacgaggacactgacgttagtgattgtgatgaccctattgaccttgacattcaaggcgatatcgaatttgacggcgtttattttggctacaaggtatacaatcctgtgctgaaagacataacctgcaagataaacaaaggcgaaatgataggcattgtgggacactcaggtgtgggaaaatccacaatgataaatcttattctcagactttatgactgcacgcagggagagatacgcattgatggtgttaacataaaagatattgcacagcacagcctgcgttcacaggtgggcgtggtgttgcaggaaactttcctttttgacggaaacgtacttgaaaatatagcatatgcaaagcctgacgctacctttgaggaagtaataagggcagcgaaaattgcgaatgcacatgactttatcacaaagctccctgacggctacaacacccgagtgggcaacaagggctatcagctttcgggtggcgaacgtcagagaattgccattgcaagagcgatactccatgaccctaagataataatacttgacgaggcgacggcttctcttgacactcagacggaaaagcagatacaagacgctttgggcaagctcacaaagggcaggacgacaattgccattgctcacagactttccaccctcagcaacgctgacaggcttatcgtccttgacaagggcagacttgcagagttcggcactcatgctgaacttatgcagaaaaaaggcgtatactacaagcttgttatggctcagcgccagaccacaaaaatgaaaaaagcccaaccacagacctgttaagcacttgacattatcacggcaatgtggtaaaatacaatagtaaaatctcatatcggggaatgatgttctcccctgggaaacctaaaccgcttattaagctgatgacttctgttttttacgcaggagttgtcagctttttttgatttttttggaggtataattatgttattttcactggctgtgatctttcttgttgggctgtcagccgccgccatttttcaggctatcggtctgccgaggataatcggtatgcttgcaacgggcattctcacaggcacttacgttctcgatctgctggatcctaagatacttggcatatcctcagagcttcggcagatagcccttatcattatccttatcaaagcagggctgtcactcaatttgtctgatctgaaaaaggtgggcagacctgcggtcatgatgtcatttctgcctgcaagctttgagatattgggatattttatccttgctccgctgcttcttgggataaaccacacggaagccgctgttatgggtgcggtgcttggtgcggtatcccctgcggtggtagtgccgagaatggtgaagcttatggaagaaaaatatggcactgaaaaaagcataccgcaaatgatacttgcgggagcttcatgcgatgatattttcgttatcgtgctgttctccacattcgtaacaatggcgcagggcggctctgcaaaggcgacagattttctcaatatccctgtgtcaataatcctcggagtgcttctcggctcgctgtcagggtttgtgcttttctatatttttgagatatcctacagcaaaggtaacaaaataagaaacagcacaaaggtcatcgctatcttgggcttggcattcctgctcatgtcagtggaaacatttttgaagccttatgtggctgtatcgggacttctcgcagttgtggcaatggcttgcgtgataaaaataaaggctgacaaaagcgtgtctgcaaggctttcagagaagttcggcaagctttggatagccgctgagactgtgctttttgtccttgttggtgcggcagtggacatacgctacacccttacggcaggtgtggcggctgtgcttcttattttcggagcgcttattttcagagccgtgggagtatggatatgtcttatcggcacgaagctgacccttaaagaaaagcttttctgtgtaacggcatatatgccaaaggcgacagttcaggcggctatcggctcagtgccgatgtcccttggtctgccctgcggaaagatagtgctttctgtggctgtgcttgcgatccttatcaccgcaccacttggggcaataggcattgaccgcagctataaaaggcttcttgcacatgaggagtaaaagggcgtaaaataggcgattgtggcactctctgcacattttatgagtgaataatttttgattacacacattttatgagtgaataatttttgatttcacacattttatgagggaataatttgagcatttgcacattttacgaaatattctgatgacattgcataaaaaaattggcatgaccaaatcaaggtcatgccgattttcatttccctacccaatctacagttgatgcaaggtggtaataagaatttgttacgatacgcatgttacgttgctggcaatgcgttgtcaaatgaggacttgaacctctgaaacctgcccgaagtttctgtccataatcagcacattctctgctgatagagatacatccaccctgtagatatcccacccatttcatcacaccagttctgttgtccagttcagctcctgaattttctcgtccacagttctcagttcttttgcaagaccgtcaaccgttttctgtatctctgtcacaggcacagtgctgactatttttatctctgttcttgtcattcttgtgacacggtcgcttgcggtattcagaaaatcccgcaatacccttaccttctttttcagacaatctctgtgtgcaagaagctctgtgatagtcttgccctcatatactgttccgctgttggtaagatttatccgtgccaccagatcttcaagacggactatcagcctgtcaagctcctccataagagcctttgggtcttccgcaggaacatcgccctcctgcacctttgcgttattgtcaagtctgactgagatcgtgtttattctgttctggatatcagaacgttcagccaatgcagttgcaagtttcatataaattacctcctatcctttgacaacgcccactgtgaaaagcttctttataggggtggtcaggtcactttgatttttcataacaacatctatatccttgtaagcaaagcggcactcctcagccacgtctttcttactggtctttccaagcaccacgtttctttgcctcaggtctaccataacagactcaacggagaatttctcctttgcgcctgtgcgtgaatagtttctgcctgcaccatgagatgaagtcaaaaagctttcagccttgcccatgcccctgactatatagctgtttgaacccatagagcctgggattatagcgacttcgccctctgccgcatggatagcgcctttgcggtgtacccacacgttctcaccgtagtgattttccagtgcggcatagttatggtgacagtttatctcgtcactatagttcggtgtgatacccgtatacttctcaacctgctctgtgaaaatatgcttcactttttcaagcattacctctctgttttcaaaagcaaagtccattgcaagcttcatccagttgagatatctctgaccctcgtctgtatccacagggagaaacggcaagttatactctgagggaacagttgaaaaatacttgtcattcatctcatgggctatcttgttgaaatactgccctatcatgttgccgaacattcggcttcccgaatggagcattatacaagccatgccgttttcgtcttcctgtatctcgataaaatggtttcctccacccagtgagccaacggaataatatccctgctcgataaatttcagcaattcgctgtcagcattgtatctttctatctcgctttgcgccttatcaagcacggcggaagtctgcggcttgccatagtgactaaagcccactgggatagtacggagtatatttcctactatcacctttataagctcgccgctccctgttacagtgtcacgaagaatgttcacagggatatctgtctgcacgaaagccattccacagccgatgtcaacgccaactgcatttgggattaccgtatttttgcaggctatcacaccgcctataggcattccctttcctgtatgagtatcaggcatcaatgcgatatggtcatgggcgaatggaagatttgcaaggtttatcgcctgttcaagacagctttcctcgatatcgtctatagactctgtccatatcttgatcggtactagcattttatctttatcgtaatattcaaacattttgtgtacctcctacttttgctgttgtatgtattatagcagatagatacaaaataatcatataaaaaaaggtgcgaggttttgttatgtattgcaatgggagtatagatttggtataatgttatcaaaggaggtgttctgaatggcggtatattctgaacttataaagaattttgaaaagataagagaatatgtgcgtgatttctatatctttggatttcacacaagagaaagctttgacgcaaaaagcaagcgcacctatgacaacgaaaagcgcaggatagaaagctggctttcagaccacgttcacacctctttggagggtcacaaaaagaaagtatctgtgcaggtggattcgggcaacatttttcataacccactgtatcagtgctatcgttcaaagacctttacggacaatgatatccgtctgcactttattttaatggacgctcttgaagataacgccatgtcagtgtcggagatagcagactatatttctgcaaactacggcatgataatagacgtgcagataatccgtatcaagctaaaggaatatgtaaaagagggcttggtgtcggaggtcaaaagcggaagaaatatcctatacacaaagaccaactgttatgctgacgatatcgtaagtcagtataaaggcttgggggatatgataaaattcttctctgaggaaaatccttttggcgtggtgggcagctttatcatggataagctgggtgcgaaaaataatatttttgtgcgtaagcacgcttacatggtgcatactcttgatgatgagatactcattgatatcatgggggcaatggagcagaaaaaggctgttctgctgtcctgcgtaagccgaaagaacgacaaaaagcacgagataacagccgttgtgctgaagatacattgctcggtgcagacaggaagaaattatcttatcatgtatttcacaaagcagaaacgtttgatgtctgtaagggtggattccatagtgaaagtgactccccttgatgtggtagctgactatgatacatattacagatattacgaagacaaccgcagatatttatggggaacgagctttggaaaatcacgcagatacggacaaaaagagcatatccacatggaaataacggtagacgaagcaaaagaaatgtatgttgtgaagcgtttggaacgtgaaaaaagaagcggtactgtaacaaagaaatccgacgggctttatgcctttgacattgacatttttgacgctaacgaagcctttccatggataaaaacgtttatcggcaggatagtggcatttgaaacaacaaatgaggaattgcaggataaatttgattcggatattgcaaggctttatgaaatatacggaggtgcttacgaatgaaactgttttcggaaatttacagcacctattacagcataacggagaaaattctgaaaaagcgcactgtcacaaaggctgagatagcagatatcatcaggcagaacggcttttctgaaagtgttcttttcctcgaacctaagcttacaggcgagggcggatatggtctgctgaaaaaagaggacagcgtatacagatctatcctgaaaaaagagcctcatatcccgctgacggcacttgaaaaagcatggctttgtgcggtgctaagcgacccgagaagcggtctgtttcttgacactgagcaaaagtcgcagttgacggaactgcttggtgcgaaaaagctatatcagagaaactttttggcctgctttgaccaatattctgacggtgatgattttcatgacccacaatacatacagcattttcgggatatactctcggctatccatggcaaaaagctaataaaaataagctttcagacaagaaaagataatcgtatcacacactattttctgcccacaaaaatcgaatactctgccaaaaacaacaagttcagggtttatgtgaaccgataccaaaagcgcagaatggtggacagtggcattataaatctgtcgcaggtcacgctaactaagctgacagatataacgcctgagagctttttagctgtcacagacaagaaaaagcaggcaaaaataaagatactcaacgaacgaaatgcggtaaatcgttttatgcttgaatttgcagagcttgaaaaagagtcggtctttgatgaggacagcggtgaatgtatggtatctattaaatatgatgagcagaatgaaaatgagataataatacgtttgttgtctttcggacctgtggtggaggtgctttcgccatatgattttcgcaggaaaatcaaggagagggttgacaggcagttggctttgatgaaaaaaacaaagtgtgaatagcgtttgacttagcacaacagagtgtgctatactgaaaatagctaataaataatttgtgaaatatatcagaaaagcactaaaaaaaattataggaggtgtcttatgacaaataaagcggacagaccattttcagaggttgctgcggctcctgaaaatgcaaattgggaaaaattaattgctcgtccctcagcgttatacaacagagcagatgatgtaagaagtccttttgcacgagattacacaaggatacttcattccacagcgtatagacggttgaagcataaaacccaagttttttataatatagataacgaccacatctgcacaagaatggaacacgttgctcatgttgaatctgtcagcagcactattgcaagtaatctcggtttaaatacggagcttacaaaggcgatagcaatggggcatgatctgggtcacgctccatttgggcatcatggtgaaactattctaacaaagctttgccagaattatatttctaaagatatgaaattctggcatgaaaaaaacggattatattttgtagataaagttgaactgctggctgacaattacaacgattacaaaaatcttgatctgacatatgcggtccgtgacggaataatctcgcattgcggtgaggtcgatgaaaacggaacaaagccaagaacagaatttatatcattagaagaagattttaaggaagcaggccagtatgcacctatgacatgggaggggtgcgttgtaaaattatctgacaaaatagcttatgtcggacgggatatcgaggacgcaattcagttaggatttattgacgacgaagcgaagcatactctgaaaaaaatggcacaggcaaacgatataaacgctatcaacacaacagtaataatgcataatcttattattgacgtatgccagaacagctctcccgaaaaaggtatatgccttagcaataaatttcttgcgcaattgaataccataaagcaattcaactacgataagatatataacaacgagcgttttgatgcgttcaaaaagtattctgagctggttttgtcgcagatctttgaaacgttgtacaaactatatgacggaaagcattcttttgaatcacttgatacggcaaaaagatattaccctttgcttatatcttcttttgaaaaatggcttgcaaaatattgtgttactgatattgtacccactggagaattaagatccgaagctttgaattgtgaaaacataaaaatatatggaagcctagaaacaaatttgatctatgcacaggcaataatagatttcattgcaggaatgacagacagatttgctgtaaagcttttcaatgagcttatatcttattaacattgcataaaaaaatgatgccttgatctaatgaccaaagcatcatttttattgatgttattaaaggaaaggcgcttatattctctttgcaagaaattcctttcctgccttatcggtatcaagtatcgccttgataaacttttcttctgtaggctcaccaggaacataagtccactcaacaacgcttgccgccttatgtgcaatggctgggacatcttcttctgtcagagctatctctcctaatgtgcatggcagacctatactgcggttgaactcaaaaatgcgctgacgttcttcaaactgctcgtcatatgtaagcaggcaaagcacgccgaatgaaactatctctccgtggaggtgatcatgctcgcactttggaaacagcgaagcgccatagtaaacgcagtgggcaagagatgaattataatagtaatcgtcctttggatcggggttgttctgatgaacagtaaaatttgaaacaagacctgttgtaatgatgatatcaagagctatctgctcgatattctttgaagaaacgttatttctgcaatcctcaagtgctttttttccgtaggatacaagcggttctgtgcatgcctctgcaagaactctaccaagcaaaggcgtatgggtcatatccttatcacggcaggcaaagaccacctcgtactctttgctgagagcgtcaccgataccagcccagaaaagcttttcaggtgattctgcgattatctttgtgttgatgaaagtatgaagtgcaggtgctttgaggtaagcatattccttgaaagtgccgtcagcgttgtagataacagatattgccgtgcaggaagcgcagtttgaagcaagggtcgggaaagtgaaaaacggcttgtcaattctgtcgcaaagggtctttacagtatcaacggcacgtccgccgccaacgccaaagaccacatctgcattttgcacttccggcatagctttaagcatttcaatgttctcataatttgagtcgccgccataccatatgaagtcggttatctcaaggtcagagcctttgagagccgcaagcagttcaggcttagccttttccatagcggtcttgccgccgataacaacagcggtttttccataacgtcgggtaacataaggtatttctttgtagcaatcgtcgccaatagagtagcttggtaaaaattcgttgtaagacatattctttcctccgttatttttaacggcattttctaccgtcataattatatgatttaataatacaactatttatagagtaattttatgacattctgttaataattattaaaaatatatcaaaaagcggcactgccactgttctgcctgcggcctcgtcacgaagcactttgagtatcaccgcttcattaaggctgtcaagattgcttgtcggttcgtcaagtgtagcgaacatcttgtcccttgccgccatgccgttcatagcaacgtgaaaaagaaagctgcctaaccttctcatttgtatgaaaaaacagccgagagcatcaaattacacggagcggcattgcccttaaaatattacttgaaaatatagcttaaatttattgttgtcataattccctttcaagtgtagttcagggaagtctaaacagcaacacacatttatgattccggcattgtcaagccgatcacttcactgcctctgcgatagttactgccacatttcctacttttgtgagatccgtgacgtccgatgaaagcccaccgctgagggtgagatctgtgcttattgtgagaatttcgtcatcgacagccttgttttcagctgttggtattgtgacttcatcatatgtaaattcgccctttacaacgctgtattcatcaagaggctggtatgtaaaatcaacgtcgattgccgcattggaatggtttgtaacgcttatatcattgccctttgcagaccattcgcacttggtatcaatgtcatattcgtgggttttagcgttccaagtctttgttccgttcacgctgtatgtgaactccatttcgccccacacaacgtcagcctggatagtttttgaggctttgatatcctccacatactttgcctttactctgatattctttttgatgtttccgtcatcagcctccgctgcaaacgcagccgtactgagtattgccgcaagtgctaatgccattatgatcgagatcgtctttttcataagtaattagtcctttacaaattatcattatttatgtatttggtgcgtcgcctattccgtcccacctgccgtcaagttcaatatatcgtccgtcaatagtggtgttccttgctattgaaccgtctcagtcaaaatagtaccaatcgtcattcactttgacccaatctgagtgcaattttccgtcattatcagaataataccaatcgtctccaccgtcattaaaccaacctctgacaagcttgccgtcttcatcggcataataccattcttctccgccgtccttaaaccaacctgtgaccaatttgccgttcttatcataatagtaccaatcgccggtttcctcatccttataccagcctgttatcgtactgtcgcctgcatctcccgaatcatcagtagtgacattcactgtaatagtgccaacggtcatgctttcaaaatgctctgtcggtttacctgacaaagtaagtttgctgtttcggctttctgagataggcactattagctcactgcttgaaaatctgccttttatctcctccatgcccgttgcgttggcatatgagaattttgcttcaacgcatacattaccattgtttttaacagtaaaatttccgccgctgtcagaccaaccgccacctttatatgagtgggtctcaggatcccactgcccgtctgtataggtaaactccaaagagtcccaagtgatgtcgatgctcacctgcacttttgagtcagaattatccgcagatgcagaaacaggcactaacaacgccgtggcaattcccatagctgcaaaaaaagcttttatctttttatccatatttcacctctcttcatctgacactatgaaagccgccatagtgtccgccattgctcactcaactgtttcagtatcataactcatcgtctgcacaagcacttttgctgagtttttctattattctcattttcattgtttaacaagcaactctaattaacagcatgaatatttataataattatccatgattcttaacaaaaagtcaataatatttgcacaaacggcaaaaaagttgcacaagcggtaggtgatttggtgtacggaaagcaaagcctcccacagaaacaattccgtgggaggcttattattatatcgaatatttaattatctcactcatcgccctctcccacagccgaaagctttttatatcggcggtgttcgattatctgctgtttgtgctgttcaaaatactcgtcatatctatttctgccaaactttgctatcagcttatgattataattcataagtttggccgtaaattcatcactatcagcgtaatacaaattaagaaaatcattatgatcatatctttgaccctttcggtcaaagtcaagcaagtcaagaagcattgcggcattaaaatctattttcagatccttatggctaaggttttctgctgtttcatcacccaccatataaacatgatataattctgagtcggcaataaatctgtattcatagccaccctctttattctttaatgaagcggtgataattgcttttttactcttgatatcattattgaaaagaccctttatacggctgagcaaacgatatgtttcataaaacttcttctcttttatatctccacgaagaatgttttcctcagaatcctccttgctgaaagacttatttccggcttcgctttcaaacaatgcctttgccgcaacagcgttccaataatttttcacatatacgccctgaccattgtcctgatcctgttctactctgaaatatccgccctcaggataaatagaaaaggtcgttttgtcaagcttttgcgagaggctgtgcctttttgcatcggcggcagcaccacggacgctgacgataataacatttccaactattcttataatgcctatggcaagattggcggctatcacaaaaggcaggataaagccccatgtaatagcaaaggtcgcacgcagagcaataaggattatccacaaaggcccccatatagtcatacctagatcgacctcatattcctcacgggtcatctcatcttcaaggagaacaacttttgaaaagttattatacacagaaccaaacacattgaagccctttcgccctatcctaaacggaaagcctgccgcaaatatccagcaaagcacgcctgagataagtgcagtgagccaataatattcaaaatattttgcctgcttgaagcttatttgcctgttcagaattttattcacaggcttttgcagcggagttactttactaaagatatttttcaggctgttgtcaatatcagtatatgaagccttttcaccgtctttgacaacgccaaaggcacttcccacagtgacggcttgctttgagttttcagctatgtacttatcatatctgtcatcgtttcctgcaatcttaggtatagcaaaggtcacaatgataagtgcgaccacaagtatcacaaactgcatcagggctgtaacaatgtttttcattttccatatgttcctttcaaatatgatcttctaaatacattataatatattggaagggatttggcaagaagtatcataagattttttcgccatcataaaacaaaaaggagcgactgaaaagatatcagttgccctttagtttacaggaaaaaacgatcattatcgaaatagcaattgcagtcccataactatcatccagatatatgcaccgcttttgtcaatgattcataatagcaggtgatcgttttatgcttatcccccaaaaaacatttactcttcactttctcattatcgttctattttgaaccattataacatattcttcattatatgtcagaaaaaaatcagcgaagaagcaataatggtttattaggtatcgcaaatttattaaagcgaaaaaatgctctgcggaatcacactctccgcagagcattttgttttagtataactttccgtttttcttgtaaccgccgtcagcctcagaatatttaaggcacataaactgccatttgtaattccattgcgggctgtcatagaccttttctccgacttccagcagataagtcactccgtctatctttatctcgccccagaagtgctgtcctccgccctggcggttgcccataacaaggtttgcgtcatagccgagataaaccatcatttccaccagtgcgccattgtaatcagaacattgaccttctttgtaaacaaagatattcttgctatgcgagcctgtcggtatcctgccatatttcaaattctttcttatccaatccgcagtatattcgaccttctttgccgccgaccaatctttcttgaaatgctttgaggcaaagtttttaagtatcttcttctcctctgctgtaagagtgtgcgtcgaggtctttgttttcttgccctgaacgttgtagatcttataagtgctgtggctcttttttgttgccgcattaagtcttgaaacagtgtttatcttgcattggatacccgtccagttgctgtaaaccacctttccgtttatggtcttataagccctcattttgaagtgataattctttgaacctgaaaggtttgattttgtataagaggtcgtgctgttctttgttatcttcttgagctgaacataatcgttatagcaatcctttggcatactatagtaatcgttatgtgggatagtccactcatcgcccttgcaccagtatatctgatatccatcagcctttgtgttcttcttccagcttattgtgactttcttattataagcctttactgtcattttcggagtggataactttgtgttgccttttactgttatataagggccggtcttagagttgtattcaagctttacggcataagtataactcgttgcctctgaaagcttcttgtcagtatagcttgtggaactcgtgaccgtcagacgcttgtaggtctttttctttggatcatagcgataaaccctgtatttgcaatttccgatcttgttccagctaagctttacagaagtggtagagtcagcggtagccttaaatcccgttggctttccaagaacgatcttgaatgttgtcgaaatagggtacctgctttcgtagtttccgccaagagtaacaacagctgtcgctgtgcctacatttgtgttattgtaatatgttacagtatagtcagaactcttgatcatatttccgtccgccttgacaaaaaggctcggtctgacagctttgccggtataatccacatcagctatctttagtatctcgacctcagaaacagctttcgggctgatagtgaaaggcactgtcacatatcctgtatagccgttcattcctgctatggtcatatagcctgttccggcattcacattgtttgtgtatgatacattataatcaacgccacatcttagcaccgcaccattaactgtaacaacaggtgcaggagtctgagcatagcccgtgtaggtgcagctagtatccacagaaatattctcgctggatatttcagcctctacaacgctatactcaaaggaatcggtcccattaaagttgccgatgcctttaatataagcataatgccagccaagctcgccacagtcgtcctcatattcgatctcatagtcaacgccctcagcaagcacaatatcattgtatgtaacaataggttttggctgaacaggtttaccggcacaatagctctgctcatactcgcagtcaatattcgcacggtaaatatcagttggcacaatattgaaattctttgtaaagcttcctgtgtaattacctataccagtgaaagtagccgtcgctgtacctacgtttatgttgttctcataagtaacaacatagtcctcgtcctcagtgagctggtaatagttgttgctgtccttaagagaatagccataaagcgtcttttccgtgccgtcatacgtctgatcgccttcataccaactgctatacatatcctctgtcaactgaatggcttcatcgttctccgacgtataaagaccgacttcctctccgccagcgggaatttgctcctctgcctcagctccaaagcataccactgcactttgcagtgcaaggcacactgccactgccgtcgtaagcgtccgcttaaataacttcatattattttttcctttccgctataattttctcacatattactaattttatcacaaagatgtgacaatgtcaagataaaatacaacatatagaaagcctcatgacattcagttagatcgtgaagtggaggatgtaaaatacggtgataccacacaagaataaggaggtctgattatgatctctgaatttgtacgagaacaaaaaaaagatatactctgacggcttgatagaatcaatataaaggaaattttatatcggtatatattctcaacgcagcgtatataccgatttttgtttcaaaaaagtttcttaattttctgaaatttaaaagcaaagttttgtgtacatacaacatattatactgcatatgtgataaaaattagtcatattgttcaattaatctacgaaaaattgtgctaaaatacgaaaattatttgtgtaaacgttttactcaaatatttaagttgacttattttacttttaataatataatgttttacgttgacagagttaaggcagcaacgcacaaggataatacagtgctgccttagaataccggtattaaaaaaataattgtataagaggagcttttttatggtacagaacaaaactttttctgcaaaggcattacagacttttgttgctgtaatgtttgccgtaataacctgcttcggttttatgacaacaccgaccgcagaggcggcatcaggattttatgtaagcggtactagtatctatgacgctagcgggaacaagttcgttatgcgtggcgtgaacattgctcatgcatggtacacagagaagactgaaacttctatcaagggcgctgcaaacaacggcgcaaataccgtaagagtcgtacttgcaaacggctcaaagtacacaaaaacaagcgcacaggaagtaaagaacatcataagctggtgcaagtcaaacaagctgatatgcattcttgaagtacatgacgcaacaggcagcgacagcacttatgatcttaacaagtgcgttgactactggaaggaaatgaagaacgttctcagcggtactgagaaatatgttatcgtaaacatcgcaaacgagtggtacggcacatggaacggaagcgcatgggctgacggctacaagtctgctatccgatctgtaagaaacgcaggcattacaaatatgcttatggtagactgtgcaggttggggacagtatcctgacagcatcaaggattacggtaagtctgttttcaacgcagactcacagaagaacaccgtattctccattcatatgtatgaatatgcaggcggaaacgcatcaactgtaagaaacaacattgataacgcactcaacatcggtgtgcctgttgttatcggcgagttcggcggtcagcacacaaacggcgacgttgatgaggctactatcatgagctactgcacaagcaagggcgtaggctatcttggctggtcatggaagggcaacaactctgacatgagctacctcgacattgcaaactcatgggacggctcaagcctttcttcatggggaaatacacttatcaacggctcaaacggaattaaggcaacttctaagacctgctcagtttacagcggttcaggaagctcttccggcggttcttcttcaggaacttcaacagattccaacggcggagttctcggacttgacggaacatattacatcaagagcgcactcagcggcaagtatcttgacgtatacaaggcaaaggctgacaacggcacaaacgttcagcagtacagaggtacaggcggaaacaatcagaaattcaagcttgtaagcgacggaaacggctattacactatttacacaggtgcatcaaattacaaaagctgtcttgacgtatacaactggagcagggacaatggtgctaacatcaaccagtggcagtatcacggcggtgactgtcagaaattccagcttgtaaagatcggcgacgcttatgctatcaagacaaagatctcagactgctactcatgccttgacgtttacgaacagaacacagctgacggagcaaacattaaccagtggagctactggggcggaaagtgccagctttggtatcttgaatcaacatcaggttcttcctcatcttcatcttcttcaagcagctcaggcagcaattacaaatcgatcttctggggttcttcaactgcttcagcatggggtcaggctgtttcagcaatgacttcaaagaatggcggaagcttcaacgcatatgacattcagtcaaacggctacttctacgttgaatactcaggaacacagaatcaggtagaatttgttcttcagagctggtcaggcggagcagagtgggcaaaggtttcaccaagcgaaacaggcacagcaaacggacactactacgcaaagtattcttacaacaactgcaagtcagcattcggcacttccgatttcggcggaaagctggatcagatccatgcaggtgcagcaaacggcacagtaacgatctactctgtatgctactgctggtgatctaagatttttttcagacttcatactgtttcacagcggtatgaagtctttttttatgcaaaaaagttttaactgtacctttgtttttcttcctaaaaaaaaatcagagcttactgttatttatgagttgcctgtacggattgttcgctttaaaatatcagatgacggctatgaagtaattgctacaaatttatctgaagatcttttttcttctgatgaccttaaatacaccgtggggcttagatattttcacgcaattttatttcttgattttattagcttaatgatattgatagaaagccatgggagtttttcttagattgtttggatctctatcacgaattttccttcggagttcaccttcaaacgcaatgtcttgacatatctattgcaaaagttctccatttctttcatggtagcggtcacttttgtggcttcatatatcttgtgagtaagctccagagggttttctccaatgagtgatggcaaatgcttttcaagctccgcaaagagtacggcacgtttcaactcctccgtgcctgcggtgcagaaatcatcaatggcacaataatagatgccgtgctgtgcgagggcgttcttgatcgccgttccacacttctcgtattcgtacataacgagaaactttgctttcggcaggctctcgataagtccccaaaagtccgaatcacttgacacaataataaaagatgttatcccgtcacggtagaagtccgtgactacgcttgcggtcattcgcacatcgaccagtgactttctgtctgtcactcggtcgatctctatatgttcaacgggtatctgcgtgaatttagagagccaatcccagcctgcggtagtgttcggatcgtcatatagcgtgatcttctcgatcttagcaagctcctcctgattcaagcctttcagaacactataaagcttgtatggatcagagttctcacaatcgacagctatagctgttttctcggtgctgtcgataaaattatagatattgtttcgtgtttcatcatctgcgtcccgatatttcgtataatcggtgaagctgtcattatgctgaccgtagatgatcttcaaaaacttacggtcggaatagatgatgctcccgacttcggcaggttgccagtgaatatacatttgaaatggataatgctcgatgttcgccatgtacttggtgaactcctgcttcatgacaccgttcttgttgtatttcggaacaaagaacagatctcggatatactcccaattcagccagtcgtagaatagttgagagcatttgtcgatattttcattgatgagccttgtaaactcctgcatatacttctctgaacggcaattcgcttggataatggtaaatccccatttttcaagctgtttgatattatccttatcgtaccattctatgttatgcaaatttttgagctgaaaccgcatcagatcatcggtctttttgaatttctgcatcagtactgttcgcagcttacataaatatcttattgtagtggcgtccttatcggcttggagcttctcgataagctcggaacattcaccgtaactcacggtcagagctgacattcggacgcctatcatataggctatagtagtaactacctcttttgtatcaacggtcaagtaaaaccctcctattcatttaatatgatcatcaattgccgtcattatcctgttgagccgattttatcatggtcttgctgatagatatttctgcgctctccacccgtttgattttcttgtataatacacagtttactaattcttcgttttcgttatccattgcgattcacctccgctctgccctatatcctgattatagcacaaatggcggtatattgcaacgctatttgtttgcaaaaggtttacagattgactttttcggggcggtttggtataataaagataaatgagaaagtgatatagctttctctgctaaatcggaatttagaggagttgtggcttatgaatttaaaaatgatacgtttatccaaaccaaatccggataacctgttttctaactatgaaaatcaattagaaccgcagtattttttcacatcctcggtttcaaagaccttatttgaaaatagccaaagaactttattgcagatttctgaagatgaaatacgggattatatcaacaatgatgatctgtgtaatgatgaagagggaatgttcccgaaacgatcggtgcttacaggtgagtggtatattaggtcagtatcatttgaagatgatattctttcgattgaaacagcactgcttggaactgatcttggatatccagacgattatttgggattagaattgatatttatttatgatgatgaatcgaaagaatttgcttttgacgggataaacagttctgcactgtaaattctcatttagcttagtaaccgaatacactcaaacacggatagaccgtcctcatcagacggctatccgtttcttattccgcataaccacaaaaaaaacgcaaaaacattacggcaaatatctgaagtcaagaaaaaacaaaagcctatcaaacaacgtagatacgctatttgatgggcttttttgcgtggcggaacttctgaattttgggtcatagcatatatggcgtaacaacgtctggaaaaatcagcaaataaggtttattctactgtatttcccctctctcctccacaaactccaccaaacacatatcctccacagctatcctagtcttgtccataaaaacaagctcattggtgtagccgtcataaattctcactatgcctgtcttggtctgatagctgccaccactttttctcttatcgggaacaaaatatgtcacccttatctcagggcgttcatcaagcatatcaagcagacggttgagatcgtcattgagcttgtttacctcgtcctctgtcagctcctccctgatttcggtgtatcttgcggtttcatcaacagcagcgtcatagcctgtcaaagctgcaaaagggctgaactgcgccgccctgtccgatatagacatttgcggatgatcgtcatagtgcggacgtgaaaactgctttatatcataataattgtcatacattgtaagccccacctttcatgccttgtgaccgcctatactgcggttacgctctcttgccgtagctccctcggtatagttcgtgcctttcaaaatggcatttttcccatatttgtgctttatcaagagcattgcttcctgcaatgccctttctttttcttctgcgttgttatcagcattcgccgcttccgccatatcaaacaagcttatctgctcatagctctcaacatcggggatatcctcttctcttatgacattacaggcggtcagattaagccgtcttgcaagcaaagtcttgtcgataattctgtcaaaaagagccatggttgcgtctattatttttttggtcgaggaagtgtgcctgcctagattttgagtcccatgggcgtgctttggtatcttcctgccatagtggtcgcaaaccacctcgcccgtatagtgaccgtccgccaagctttctttatcataccccacagtgagaacgatctgatttgttacaacgcccttatccacaaggtcaagggacagcatatcagccatttcccacagaataagccttgtgcgctcataattacacggctcttgcaagacctgcccagaggaaatgctgttgttcgaggggcggtatgacttcacgtcaggtatggcggtaggctcgataccccatgcgtggtcgataagaagctcggtatttttgccgaaaaccttgtaaagcttccctataagataatgatccagcgaccagcgtgagatatcccccatggtgtaaataccaagcttttcaaggcgactcgctgtgcctgcgcccacacgccaaaagtccgtgataggggtatgcccccacagcgtttctttgtaaagctgttcgttcagctctgcgatacggacgccgtttttatccgcagggatatgctttgccacaatatccattgccaccttgcacagatacatattcgttccaacgcctgctgtggcggttatacctgtagttttcagcacgtccaaaatgagcatttgtgcaaagccacgtccgtcaacgttataaagcccgagataccccgttgcgtcaataaagacctcgtcgatagaataggcgaaaatatcctctggtgacacatatttcagataaatcccgtatatttttgcactcacagccaaatatttcgccatttgcggagttgccacgatataatcaagctcacaggcagggtcagacagttcggaatagatatagcttttctttgcaaactgtcttttaggagctttctgcaatcgctccttattgacctgctccacacgctgaatgacctcaaaaagccttgccctgcctgaaataccaaagcttttcagtgacggtgacactgcaagacatatagttttctccgttcggctctcatcagccaccacaaggtttgtattcaatgggtcaagctgcctttccacgcactccaccgaagcataaaaagatttcaggtctattgcaacataggtcttttccatagcatcaccgcctttttcctttatgtataatagtataccacgaaactttctgttttacaatagaaaatcgaacaaaagttctgaatttttaattaactcttttcatggcagttgacaaagtaaaaaaacgtccccgaggaaaacttggggacgttagtcttatatttggttttaagacgacatacaatagtctaccaagcttcactgtcataaggctcaataggaatattgtaattctctgttactttataatacttatcagtgtcagtgtctaccataagaacatttatatctcctgtgctgagcacatctccgtcaatgtagtagtgactcgctccgtcatagtagatatcgttaaatctgcggtcgcctgctatactgctggtgtggacatgccctgccaccacctttttgtcaagtccgtgtatcttgccaagcctgtgagggtactgctctgtaaaaatataatcctcggtgcagtattcccaagcattgcccgaatcctcgtcaatgcctgcatggacaaagatagtgttgccctcaacatgatatctcggcagacgttcaaaccaatatctatacgagtcatcagagtcatcatattcgccgctgcctagcatttcattgaccgaagaaaaaccgctcatcaccatttcctcgtgattgccaagaagcgccaccaccttcctatgaccatatatattctgcaagcccataatctttttaagcacagctatattgtcctcgccgccgtggatataatctcccagaaagataagctttgtgtcaggctcgtcaaggtggtcaatgacaagctccaaagcgtcgcaaagtgctgaataacagccgtggatatcactcatgcagtatattttcatgcttttctccttttgtatcattagtttgcttgtattcgtttatcaggtcttccattttctttgttctcttttcaaccatatccctaactcgttcgagcatttcttttagctgtttttcgtcttcgatttctttgagaacgtttgtttgacgacgtggataatctgtttcaaaagcttttcccgtaagaatatttatcggtatatactcttttttactggttttacttatattctctacaaaatcattaaactcaaagaagtctacataatcttcaaagcttttaaaaaagccaaaccatgtttgagcgtcattgttcttacagctttgaaaaagaatatctccgccatatggcaacaatttttcccattttctaatttcatatatgtgttttatttctaacaaagtaaggtcaactctatcctcaatatagtttctaatgcctctacttttattatacgtactacacaaggacttaggccaaagaaaagagccgccaagtgttcttgttttgtaaacataatttgcaagaaattcagctattgcgtctgggtctttgtccaatttatttttctgcatttcaagatatcggctcaacggatatttggtgctaaaataaatccatggaactgcactgaaaccaagctggtctgattgaagtgaaaaatactttttttcgtcttttctacctttattatagtagacacttatcatctcatcaggggtttcataagcttcaaatgataatttattttttctatgagaatttgccgcattaagaaaatttgacagggctctataaaagtcttcatttttcttatagtcagggtctatgtatatattattacaaaccacgccacgtcccttaagtatatcatcaatccgatttttttctttttgggcagccttatcattcataacacactcatagtctgttgacagcaaacctaccaaatacgccttatagttttcctcaaagttttctggctcatacgattttatttcctcattagttttcatacaaattcctcctaaatattcacattatactttttacagagttcttcaacccgttcttttatgcttttgactacgctctcaggtcctagcacctccaccttgtctgaatactgcaaagcccaatttactatgccgtatgggcttgtccttacttcaactatctcaaaatccgtctgatttttagggagcttatgttccttcttatacttctccgttgttatcttataatcctcgccaaagctgtcatggatagtattcagattctctcttagcccatgagaatctgtattttcggtgttgtatatggggcaggtatactccttataatggcttgaagcaagctcggtttttatacgctcaattaggtcaggctttttatcctcgtctatcgcctttgacattttcacggcatttataagatctgtgacctcgctttttgaaaatgggtgattgtagtatatacctctcacagagtttattttctccgcaagggtcagttcgtcatcatcgtcatcaaaatactcgtcgctttcatattccttgataagtgcgtctatggagtcaaacatcaatctacagtcacgtctttcattcaaagtcacgccgtcagcggaatcaagggctatcgccatgtttaccattttgttgtgaaatgtactttttgtgccaagatattcgcttatttcctccaccttgcgcatttgcgtctgacttgtgggattgtccacatctgtattatttttcagataccccagaatcgcaaacagcgactctatgatatccttattgctctttctatgcccctctttcaggttttcaagcttatcttttatattttccttttctgccatagttcgccctcctataacaattatctctataattatattgtatcacagggaatatatccctgtcaatcagctatgccacacgaattatagtatttgaaattatcttgaaaaaaatatctcctttctcgcttgtttcaggagttatactgttatacacaaaggctgaaacacagccgtctatgccgtcgcctttcatatccaggcactcacgctcggctttccaatcgtttttgtacggactaacataaagcactgcattgccacctatgatagcatatggataacacttatcctcacgatacttctgaaactcatcaaacgccgccagagcctctgcttccgcttttgtgagcttctttctgtttattcttccactccccattctgtccgtcatgaatttcatgcgctttttgctttcttccacaagctcttttttagttgcaaggactagcttatcatcgcatgagtactgctcctcgccctgccatatcatagcctttttgtcatatgtaaaatctattggcaggacaaagaacaccagatttttacctctgtatgcaaatctgtctatctcagctatagccctttttcttgtaggataaacgcctccgcacatacacaatctatcatactttctgccgtccgtcctgttgtatgcctctactctccactttcttgcgtcagcgtcacagtacatagaataatcatcatatatcaccgtctttttgccctcctcgatcataatgacctgtgtaccctttctttgctcgtcaaatggcggaatgttatctgacaatgccaatctctcaatgacctcagtgttaaaaatctttgtgctctttttcatagccttacctccgtatcaactctgtcttgaccttatgcgcttattatagcacctttgaggttctgtttactgttccaaaatggtctgtggtgtgtttttttgattttattcccttttcaagcttctatatatattatagcacccacttagtacagtttaccgaaccaatttggcacaattatgatatattctttttttcttatattttttttgcgagatatttgatagtgtatttctcatacaataaacttttctgcaccttgtttttgctacagaaaaatgatataataaaaaaccgacaagaagagagaataaaatggatatttcaaagaaaggttgggacttatttaaaaaaattacttcccaaatggcaagagacatatatggaaagacttatcaaagaatatatttcactgctgaacgaagaaaagcttgcctctgaaaagttttgggagcttgaaaagcgtataaataaagataagcgtagtccaggggtgattgtgccataccgtaaatcagatgtaatgatgatacttcttaaactcataaatgatagtgtcataacatttgacgatcttgatgaattcagcgataatataaaaggtagtttaaaatttataactggtgcagatcaagcttatcaggaacagggagatgtgacaaaaagaacattgcgttgaaatgccttttttcaacaggggtacatgacagaggtcatgattatttcttaaatggtgctgtccatgatattaaatattccaacaacgagcttaaagccgttgtatcaggaagcaaagattatatcgtcaagatagttttttcagaagatgatgaaaatgagattttagatatggattatacttgtccatacgcttgcgacggatataactgcaagcatatggtggcagcactttataaatttgatgaatgtaggggaaatgggctttcattcaaaaatgcgaccgatattttgctcagacctgcatatacaaaagatgatcttgcggccagagaagttgcaataaaaaagcttattgcatatgctgataataaaactgttcgctcttttttagctgaggtgcttgcttctgatgacaagctttacatgcggttttataacattataactgagctatgggaaaactgatgtgagaacctattttaacaagttttgcttctaaaaatcgacttgctttccccgcagaaaaatggtataataggaataacaaatattttcaaggaggcaagacaaatgggcatttacgttaaccctgataatattgattttcagcgtgcaataaattcacagatatatgttgataaaagtggacttatagaacttacaaatgcaaaactttttaccgaacagcagtttatttgcgtaagccgaccacgtcgtttcggcaaatcaatggcagcaaatatgctcaccgcctattacagccgtggctgtgattctcgtaagatgttctctgagctaaagatcgcaaaatctgctgatttcgaaaagcatctgaacaagtataatgttattcatataaatatggtcgattttcttgaccgttctaaaactatggacgaaatgcttgactatctcaggcgcagattgcttcacgagctgaaaaagggcttttcagacgttgattgttttgactgggataatctgcaatctgtgttaggcgaaatatatactgacaaacgaattgcttttattttcataatcgacgaatgggactgcatattccgtatacacaaaaacgattctgacgctcagacaaaatatcttgactttctgcgaaatcttttgaaagaccaaagctatgttgcgctcgcatatatgacaggcattttgcccataaaaaagtacggcgaacattctgcattaaatatgtttacggaggtttcgatgacaaatccccgtgagtatgcagagtatacaggctttactgaggacgaagtcaaggggctttgtgaaaaatataatatgccttttgatgaaactaagcgttggtatgacggctataatttaaaaggcattgcaacatacaatcctcgttcggtggtaatgtcaatgacaggtcacgattttgacagctattggacttccacagaaacctatgaggcgctgaaagtctacattgatatgaattttgacgggcttaaagacaaagtgacacggcttgtggcaggcgagaaaataccgataaacccgacaaaatttcagaatgatatgactactctgcgcagtgcggacgatattttcacgctgcttgtccaccttggttatctgacttttgatttttacacaaagtgcgtgtggattccaaacagcgaagtcgctcaggagtttataaactctatcgaagacggcggctgggaagaagttatgaaagctatcaatgcttccgacaagcttttgcaggctactataaatggtgatgaacaggctgttgctgaccttatcaataaagcgcacagcgagaatacatctattctgaaatacaatgatgagaactctctttcctgcgttatttccattgcttattactctgcaaagaggacatatacagtggagcgtgaactgcctgcgggcaagggttatgctgatcttgttttcaagccaagaagaaataacagcaaccctgcgatgatagtcgaactgaaatacaacaaatctgctgagtcagcgatacagcagataaaggacaaaaattatcctggttgcttgaaagattattcgggcgaggtcttgcttgtggggatcagttatgatgataataagagacattgttgcaggatagaaaaaatagtttgccaaaaataatacaacatttgtatttgcatttttatgttaacaaaaactggaatcgaggtatgttttatgagtattatttcaatcatcaccgaaaagggcggcgtgggtaaaacaactaccgcaattaacgccggaagtgcgttggtcaaaaaaggctttaaagttctgcttatagatatggataagcaacggaatctcacctctactgcaaatatcactgctgatgggcaatatagagaaattcataggaccatagttgatattttttgtgaacttattaaaggcagaaaacccgactattcagaatttgtacatcataatgacatcaatggttttgactacatcgcttctgatatgtttgtggataatttaaactcaatgattgatgactatgccaaaacaaacggctataatgttttacaaagaatgtttaaagacccatttttccagtcctatgattatattattttcgactgcaaaaagtctacagatagtttttcaaaatgccagattgattcttcagactgtgcgataattcctgttgaaccatcagcatatgcttttgatgctgtcgatagaataattgataagatataccaaaataatcacacaaagataatgggcatattgataaacaaaacaggtcaaacagcgctggcaaaggatttcttgagcatatataatgatacgtataaggaacttgtattcaaaaccaaaatacctcaacgtgctgctcaggtcgagaaaacaccgtttgacggcatcgcttgcgtcaaccaatcgcataacactcttgcagaatattatatggctctcgcagatgaaattatagaaagaacttaaaggaactgaataaaatggtaagtaaacaaaatatacttctgcgatagcaaataggcgacaagtcaatcacgctaccgatgttcgaactcaaaacaatttctattctaggcttacccagagatataacaaatctgctgagtcagcgatacagcagataaaggacaagaattatcctgattgcttgaaagattattcaggcgaggtcttgtttgtggggatcagttatgatgataataagagtcattgttgcaggatagaaaaaatagtttgccaaaactaatatgacatttgaatttttgaagccacgtatttcagtgttgataatcgagacttgataattcagtttgagattgaatgtactgaaattgcaagagaatgtgatttatgaaaagaggtcaagtgcaatgccaaacatatggtacaaaaacaaagaaaccgatactatttggtggaaagatgaccctacagttatcggagcatggatattcagctttgacaaaaccactgaatttaatatgttccatgattatccttataaattaacaaaagagcagaaacagatttttgataaagaaaatcccgaatgggcggatttctttaaggatagaaaataacagatacaaggtattcattttgtaattagataaatctctgatatccaacataataaaaaagcccacagacccgatcacattgatcgcatctgtgggcttttgaaattttaccacacatcatatatcttagccttttcctcgttgaaatcatcaggaagcgttccgatatcccagccggagttggtagtttctatgtaaagataatggcttccgttgtaatcatagtacgtgccgggggcatcgtctgttgcctttactcctattgcaacgtgttcaggaagctcaataaaaatgcagccatagccaagctctttgagcaaagctcccaaaagtatggacgagtcctcacaatcaccgcactggtcataaagcgtttccagaggatattttggaaaatcagtatatcccgttgaggtcatgtcgtcaacatactctatgctctgcacgaaatttgcagtttctcttatagtctcagattcgccataaccgcattggtcgcaaaggctttttatttcgtctgcaagctgttttacgagcttatgattattgtcgtcacttacatagttatgataatctttcacatatgagtatctcaaaagactatgataatattcatacatatcatcctgaatattcattgatatttcaaaggtatatcgtttgtcatagctcgtccagttaaaagtccttttcgaccatgtggggtctgcaggctgaacatagtcaggctttcggtcgtcacgaggctcatatccgtcctcatcagtgactatgggtgtttgctgagtaactgcggtagtggtctgctgtgttgttgtggtgtatgtgtcgtatgtattcaatcccggtcttttctctggatacagaaattcatcaattgtattgctaaatgcaaaatatacgcccactgccacacaaatagagataagtaatttcttcatatattcgtcctgtttttagttggtttacgacttttgtcatatgtacattatactacaagacggtataaaatacaatactattagatatactttacgaatttgttcttatttttgctatggtttgatattttgctaaatagttgaaatttgtgaggcggtggatttcattctcacctttcgtgaatttctgttatattcatagcatctgacctaacggaacattttttgtgacaatgaagatctatgccattgtcgatagagtcctttatggctagtttgtgtatgaaaaaagcacccgttaaggtgcttagttccgatgtttgggtataaaaataccgcccgaccttagtcaagcggtaaaattatttatgccgtttctctttatgcgataaagagttccgaacctgtttcgatatcgcaagctttcaacagctcagttgtactttttgcaatatctgacgggtcattgtatcttgtcattgctactgaaacgacttcatatgtcctgccactcttatcgtacaacttcgtaccatttttgagcatttcacacttgccgtccaaagtaacagacaacatatcgctgattttaaatacatcaagaactttaaacatatcagtcgcctcctttttcattatatgcctttaattcactttcatactgttgcaaagcaatttttgtttgttcgacctcagcttctgtcaacttataagccttgttgtttcgtaaaagctttttctgtgccttgatctcgcaattaagtcttgaaacataacttccgtcattttctccgttgcgatattgtgttgcgtggataagttcttcaaaaacactggctctgcctggattttgtttaagcaatatggtcttgtcattgtaagtaatagcctcagcattcttacttttcaggtaagcgtctgtttcttcggcataggctcaatatagcctgctctggtttttctatacattgcttcacttcctgcattcattataccatatttttcgtttttgtcaacaccaccgccataatacagtatacagatttctggaatataacaaaaagagaattaattaaaaagacacaaaaaagtgatatttgaagatagccaagaattcttgcaaaatctttttgacatagcaaaaaaagaaagcatatatatttcccagaaaaagatacaagcagcaccacgacagatcaccataacactgtttataattataaataaaattgtattacttgatatatttgttcaacttataagataagaaaataaatgacatattatatattcaaaataaagaagatatatcgttttaacgcaaataatagttgtttattttctatatcacgtttgccttaaaaaagcaatagctcaagtagttttaaagataaaatcagcggatagcacaaatgcgttagtgtttgattggcgatattgctgtaattctaaaagataacgcattataaaataacaagtttttatttatataaacataaagctgtaataagtaataaggataagtgactcagttttattagatcatatatactcagtatgtttacttattcttgttataaaacaaaataagaagaaacaacacatcttatattacaaagaaagaatgcaaataatagttgtttcttttccatatcacattcgctctaaaaaagcaatagctcaagttgttttaaagataaaatcagcggattatacaaacttataagcttattcttagtggcattgcaggcaaagcattatgataacactatttttcatatattaaaacaaagctacgtaaataagcaaataaaaaaagaagaataagctactcattataatataagaagaaagcaccacttcttatattacaaagaaagaagatatatcgttttaatgcaaataatagttgtttattttctatatcacgtttgctctaaaaaagcaatagctcaagttgttttaaagataaaatcagctttttatacaaatgcgcaaacatttaattggtaatattactgcaaagcttgaagataacgcattataaaataacaagtttttatttatataaacataaagctgtaatacgtaagcaaataaataagaaataaggataagtggctcagttttatttgatcatatatactcagtatgtttacttgttattgttataagataaaataagaaaaaacaacacatcttatattacaacatcttatattacaaagaaagaagatttatcgttttaatgcaagtaatagttgtttattttccatatcacgtttgccctaaaaaagcaatagctcaagtagttttaaagataaaatcagcggattatacaaacttataagcttattcttagtggcattgcaggcaaagcattatgataacactatttttcatatattaaaacaaagctacgtaaataagcaaataaaaaaagaagaataagctactcattataatataagaagaaagcaccacttcttatattacaaagaaagaagatatatcgttttaatgcaaataatagttgtttattttctatatcacgtttgctctaaaaaagcaatagctcaagttgttttaaagataaaatcagctttttatacaaatgcgcaaacatttaattggtaatattactgcaaagcttgaagataacgcattataaaataacaagtttttatttatataaacataaagctgtaatacgtaagcaaataaataagaaataaggataagtggctcagttttatttgatcatatatactcagtatgtttacttgttattgttataagataaaataagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggataagtggctcagttttatttgatcatatatactcagtatgtttacttgttattgttataagataaaataagaagaataagctactcattataatataagaagaaagcaccgcttatattacaaaggaagaagatatatcgttttaacgcaaataatagttgtttcttttccatatcacattcgctctaaaaaagcaatagctcaaatagttttaaagataaaatcagcggatcgcacaaaggtgttaatgtttcattggcggtattgctgtaaaatctgaagataacgcattataaaacaacaatttttcatttatataaacataaaactgtaataagcaagcaaaaaaataagaaataagtagttcagttttatttgatcatatatactcagtatgtttacttattattgttataagataaaataagaagaataagctactcattataatataagaagaaagcactacttattatattacgaaggaagaagatatatcgttttatcgcaaataatagttgtttattttctatatcacgtttgccttaaaaaagcaatagctcaagttgtttcaaagataaaatcagctttttatacaaatacgcaaacatttcattggtaatattgctgcaaagcttgaagataacgcattataaaataacaaattttcatttatataaacataaaactgtaataagtaagcaaataaataagaaataaggataagtggttcagttttatttgatcatatatactcagtatgtttacttattattgttataagataaaataagaagaataagctactcattataatatataagaagaaagcaccgcttcttatattacaaagaaagaagatatatcgttttatcgcaaataatagttgtttattttctatatcacgtttgccttaaaaaagcaatagctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaagaagatatatcgttttatcgcaaataatagttgtttattttctatatcacgtttgccttaaaaaagcaatagctcatgtagtttcaaagataaaatcatcgtattgtacaaatgcgcaaacatttcattggtaatattgctgcaaagcttgaagataacgcattaggaaacatcacgttttcatttatataaacaaaatgctatatagtagtaagataaaaagctactatcaccaaataataaaattagtgatagtatctcaatatcaataatgctattaatagtgaaaatttgcattcttccttattatattatatataaaatgagtgttgatcttagatcaaagatgttctctctataccaattaatgtgtacttgttaaaagcacacattaatttatgtcgtaatgcacaattcatcagacaatattttgttgattctgccaattgaaaattaatttgaaatatggtattattagaacatagaaaagatgtaagtaaagagttcctcagtgagtgggggctcttttttttataaaaaaaacatgagcacacatttgatgtttaaaaatgtgtgctttttttgtcccccaaaaatgtcaatttgtttaaaatataatagagatagcgaaaatgttatcaaagttatagaggcaaataaacgtggtaatcacaatggatatacacgctaagataaagacgcttcatagattgctgcctttgacaataaaaatctgagccacttcgctaataaaaaagtgagccactaatcattattcatagtcagatcaatacgataaaacaagctgcagttcatattcagaactaaggatctgaaagtgactctgtctatgaagaattcgagtattatttcattctaaaaaagctaaatcaatttcgattgatacttgttgaaagaaatgtaactgagctcatcgattatcagcagatctatcttgctgagtttctttggggttaataaatacataagaatactgttttttataaaactaaaaaaataattgtagaataaaatattgccaaaagtaacgtgggttgcttgagtaagtatgagcgttggtctagcaaaaagctggactattcggcaatgttttaataatgctttgagaaacgcatatttcttctggcatatgcgggcgagggcttccgctgcaacgaagccaagtggatcggctcactacaaaggtcgaatgggatgcgttcccatatggaaaacgcaagcgcgacttccgctgcaaagaagtcaggtgaatcaacacactgcaaacgttgaatgggacacagcctccattgagtcaaggctgaaaggcacttaaagaagatgtcacttattgacatcttgcttcatttgaactgggaacatcctagttttggcattcagagccacttaacaagtgctttttgttttactaaagaataaaggagtttttattatgaataaatttaataagatcacagtttgcgtcgagggtaaaaatataaaggtagaagtaggtacgtacacgctgaggacacttataatcaagaaactcaatggaatggctgctttcaaggaaagcaaacaccagtacaaaatttggacaatttcaaaacgaaaaaatgttagggaaagacttgcgttggaggggaaatcaaaagaagagattaatgatatctgcaaccgtatcaactgcttcaagtggaagctctttgctaaaaggaccaaaatagactatattgaaggaaatgttcaattctgtcattttctcgagaaaaagtatcacacctcatacctgactttaaaagaagctgaaaaacatatccaagagttcgttgatgatttaaaggcaagaaaccggagcagcaacactatccatgattatttggctgcagtttgcaaaacttttggaaagtacatgggtgactacgatcaccctattcgccacggtgtttgtcttaaagatgatccaactaaatacaacaccaaacgtggtgaaaaagctcgtgatgttgcattaaccacaggtttaagacgccgcgagctcggccacttaaaagtcgatgatataaaattcattgactgccaaacagttcacatttatagtattggaaaaggcggaaaacataatcgtactgtattgaaaggaatagttgaagtttcgaagctaaaagaatatattagagaagcagaagagaaaggtagtgattctttgttaacaaagacagaagcacgcgttccagatgcactccattactgtagagcaatatgtgcacagaatacctattacacagttttaaaagaaatggaaaatgatccatcaaaacgtgctgagtatattcaagcaatcgaagatgagtttaaacgcaataagaggaaactcaaagaggatcttaacaaaccttatcgattaagaggatacaacaaaaaggcagccgaatctatcaacaagccagttgtctacgatcgagtagcagcaatgtatgtgagcttgttcatactccaccacttccgcacagatactactatcttgcattatttggtgaaataacatcttatatgtgcaaaaagcaaagcctgttcattatgggctttgcttttttattataatattttcgaaattatctctagccaaatgtcaatcccactcatcattttttatcaatttccttgcatttataacactttgatacgcatcattaaagtcactcatatccccattgtattctaaaccattttcctgaaaaagtggctggttaagtataacatttacattatgcactattgatatcgtaaaagcgatctcacccatttcatcatgtgtaaatttatttaaagatattcttctgaaatgtatcaagctgtctttttcttttattagatcaatagtttgctgaacataatttcgcattaccttatcacactcataaagcgcttttatttgcaggctgatcatcttcaatgtattgtcaagcatagttttagctaatttcagcttttcaatttcttcatcgcatttttgagagaaaagccgtgcattatctacaaaagattttgatgaaaaaacatttttaatactatttaaagaagctaaaaccgaacaagtgcaggcttctaacagattttctacgttacttagttttatttcatcaattctttctttgtattcgtctttttctttatttttcattatattaagtatttcttttccatcatcataaagctgtgctaacttatgttctgaaaaaaggtcctgaagtaaatagttaagatcactgttatctctattttgctctattattgtataattattgatatagatgtcaatgtttgataaatttacgtcgatattattcaaacaagtttctatctcagttatccaatttgtttcgccagaaattgtacactcaaaattaggagacaacctttttaacgctttgaaaaatcgtttttcttcttttttatatatagattttctaagctcaacaatatgcaatgctttttcttttatagtatctaacgctaattgataatcactttgtatcagatcatatcgtttttgagcctcatctatgatagcttttccttttttcttgaatactccagatactatatttccaataccacctaccactacattagcagccgtaaatattaaaccacctatcagaaaaatattacttttttcgtcatatttgtttttattagtatccatatctcacatctcaacattaaattttgattttttcttttttcgtgattttctgtataagatcttctgtgctttctattgctggtttttctccaaatgcaattgtcacgctatttgacgcagcgatcgcattatcatactccttatttttcaagaaaatatccattgcttcaaacgattcatcaaaaaactctctaagatcctcacaataccgacttgcatactcatcaagtctttctctataatatctcaatctcagcatgacgtcgatgctcatagcaatttctaactcaatttctgcatgatgtacaaaataagacttgatctcgattataagttctttgaatgtttcacttttcaatataaatattaatgaattttcaatagcattaatagatgtgcttttaaatatctcctgaaattccttttgtcgttgcaattctaatgcagccttaagttttaattcttcaatgcgttccctttcttcacgttttacttctgcatatttgtctgtcagactcgttacccaattatacacataattgaataatgtacctcctaacatacagccaacaatttcgccaaaaacaggaatagggatcagccagtttccaaccactgagccgatttttgagccaacaaaggttgaaccgtttttcccaacttccctaatacactcttcgtcagatattgttccatctgcccatttacaaactgtttctcctgtaactgacactgcagaaatgattttgccaggcacattatttttaccccaaaatgcaataaattttgaggtcgaacttgacatgaaatgatttaatgtagttgtgcctgcgccgtaagcatacccttttgttgtcgcctttactgtatcctcagtgatttcaagcaaagcatcatctagatctttttcaccacttacaacagccgatatattacttattgttgatgttgtaccggtatatgccgcagaaagtcccgccgcatataaacctgatgaatttgcagttttaataacattttctcttactctggcttttttccgcttatctattatctccttggctctttcgccctcttcaactatctgttctgatacttccgaagatgaacgtccgctatctttgccaaggcgctccatttcctcttgatccgtactccattctttttgagtttgaccgcctttaccgcctgtctgattattcttccttgaaataatctgaatattatcttcactattcatgatctcttttatgtcatcggtctttaagaatgcgtcatcttgaaaatcttttacacccttatttagcggatatatatgatcagattcagcaacatgagcttgccaatcatcaccatagtttgcaacagcctctttttgtgttttcaccaaattcttacccgaataaggatcaattgcattttcaccatttttaaaagctttgtcttttgcgttatttaacgccgaatgattatcataaaactttttcctattttgagatgaatatttgggtttatgatactccacatttgctttctctgtcatttccacagcagcatgatcagctacaacagcagaacctatcaaatgtttcttatctttctttttctttcgtgttgattcaaacatatttatcacctttactgtctatttctctttacacagccataaaataaatcccactgatctttctgcactttgtaaagttttcggaagaaggacaattgaatttagacaccctccacgccacggagctcatttaaagaatgatccgacaaaatacaatactgaaacgggtgaaacaactcgtgatgttggattgaccacaggtttaaggcgccgtgagcttgggcacttaaaagtcgatgatataaaattcattgactttgaaactgttcacatattcagtgtgggtaagggcggtaagcataatcgtactgtattgaaaggaatagtcgcagtggcaaagctaaaagaatatattagtcgtgcagagaaaatgaataatgatttcttgttgacaaaggcagaagctcacgtcccagatggactccactattgcagggctatgtgcgcacagattacatataatgccgttttgcaggaaatggaaaatgatcctgcaaagcgtgccaaatatattcaagaaatcaaggatgagtttaaacgctgcgagagaaagctcaaggagaatctcgacaaagtttatcgcctcagaggctataacagagaagcagcattatcaatcggcaagccagttgtctacgatcgagtggcagcgatgtatgttagcctgttcatactccaccacttccgcacgaatacaactattttacattatttggtgaaatagtaagtccagccaagcttgtcaacatagaacggatgacttggtgttgcagatatagtttcaccatttacaccaatgcatcaattattaattaaaacgctttataaaattatacaattcagatttaaaatcgtttaaattcagataacaaaccccatacttatatctaaattccacatctttataattatgatcaatattattccaagtgatttccatgttatctccaactttacaaaacacaataaatggcatacaaaactcatccttacatgaatcaattgaatgatgccaaatccaattctgtcttttttcttggaacttcagtgaatgttcataattttcaggaatataatcatcactataaagccacatatctgctcccgttttagcattagtcttaacaggaaatgggtcatctgaaagaatgtattttaaattatcatttatccactctaacaatttgctaattctgcacataccataataaatatttccgttatatgaatattcggaaatgtcttgtccattaacaataatatgtatataaccatatcctttttctaatgcttcatattttaatgtaaacaacgtttcctacctccatactaattaaagatatttatgatttctcatttttaatttgagaaatcataaataatcataaaaacacatacaaacttcaaacaacagtttatattaggtatctatttgttctttaaaaactttttatattgaggctttgatatcaaatcgtcatttaacatattttttaaaacatctgttggcacctctttagctgtattagtgaccgcataagcatgccaccctgtagcggtatcaggctggaacttaattatttgatcatcgtatatattatataattgtttatttgatgacgatgagtacgcagtatcaagtaaatgttgacctgtttgcatgtccggaatcggattatcactaccccaaccatgtcctggcacatgcttatcgctaggatgataaactctcggtacatcatctgaattttgtgaacttcctgatggcgtacacttcttaccattatgaacaagaataccgcttttaccaacaaaatatgtatggaaatcttcaacctcaaagttataaaccttgatagatgattcaagaatttcgtgctgaacccattcaactgttacaagttcaccatttgaaagtacaagtacatcgcctgctcgaagtgaaccagctaaagtccaaccaagttattgatagcaattatttttacaatcctaattatactataaaatctgtaaaaaatcaatatccgaatacagaaaaagcagacgtggcaaaacgtctgctcagctatttggagcaagcaacgggaatcgaacccgcatcccaagcttgggaagcttgtatactgaccattgtactatgcttgcaaaaaggcaatactaaaatatattgccttagagcaaagcctgttcaccacggactttgctcattcttgtattttttattgtatctcatctttaaacgccaagatgtgaaccccacgcaagccccaagagtgttgttgaaaacatcatcaaattcacaaagccctctgcctgtgatatactgcgttatctcgatacctgctgaaaaggcaagggacatgagaaaaacttttttgaacttcgtgataccgcaaagatatggaagcagaacgcccaaagggataaacattgcaatgtttcctaaaatttgtaccagccaaaaatcccgcagatacttgatgcttatgttctccaaaaggtttcgcacctcccagaagggcataagttccgcctgacgcttgccccactgtctgtctatgagtgtgagccagaggacggcaaagatgtacactgcaaacagcgctgtaagtatttttctctttttactccaccgtaacgctcttcgcaagatttctcggcttatcaacgtcatagccctttcctactgatacataatatgacaaaagctgaagcggtactactgaaaggcttgccgcaaaaaggttatctatccttggagtgtaaactgtgaagtcagcaacgtcctccatagcataattcccataggtagtaagtccgaaaagctttgctccacggctttttacctcgaccatattgcttatggtcttttcataaagtgcagactgagttaccacgctgaacacgacagttccgtcctcgataaggctgatagggccatgcttaagctcgcctgctgcataggcttcggaatggatatagcttatctccttgagtttaaggcttccctccatgcctactgcatagtcgatacctctgccgataaagaatgcgtcctttatattcactacctttgaagcgaaccactgcaagcgttccttatcctcgagaattttctctatcttttcagggatagtattgatctcctcaacgagctgagcaaatctttcgtcggatatctcccctcttgcttttgcaaactgcattgcaaggagatatgcggcaacgagctgacagctataggctttagttgttgcgacagatatttcagggcctgcgagggtatagaagacattatcggcttctcttgcgatcgatgagccaacaacgtttacgataccgagagtttttactcctttttctttgcaaaggcggagagctgcaaggctgtcggcagtttcgcccgactggctgatgatgatagcgaggctattttttgcaagcttcatttgtctgtatctgaactcagaagcaagttccacacggacagagagcgaagttagctcttcgataacatactgagccaccatacccacatggtaggcagaaccgcaggcaactatatacacctgctggatatttttcatatcctcgtcagaaagtccgacgctttcaaagctaatatttccatctgtaaggacagaattgatagtatcctttattacctttggctgttcgtgtatctctttgagcataaaatgctcatatccgcttttttctgcagcttctgcgtcccactcgatagttttcatttctttctgtatttcttcgccatcgagattgtagaaagcaactgcgccctttgtaagttttgcaagctccatattgcctatatagtagacatttcttgtatacttaagtattgcaggaacgtcagaagcaaggtagctttcgccgcctgtaacgcctattatcatagggctgtcttttcttgcggcatatatctcaccgggatagtccttgaacataacagcgagggcataagagccacggatacggacgagggcgtgattaagagcgtcaacaggagtacccaggtactttttgtaataatagtcgataagctttacggcaacctcggtatcagtttctgacttaaaggtatatccttttttgataagcttttcacgaagctcctgatagttttcgataataccgttatgtacggcgataacattttcatcgtcgctgcaatgagggtgggcgtttacagttgacggctcgccatgggtagcccaacgggtatggcctataccgcaggcgccttttacagcttttccgtcgttagtcatttcctttaggactttcagcttgcctttggcttttacgatctcaggctctgcgtcaccgtttcttacagcgataccggcagagtcatagcctctatactcaagctttgacaggccgtccaagagtattggggctgcctcattatttccagtaaatccaacaattccgcacataacagtgtctccttttaatctcttctaaatatatctcttgtatacaccttgtcctcaacatcatcaaggcaaggatcatatctgtttgcaatgattgcgtcagatatttccttgaattttgcaaggtcattcaccacgacacttccgaaaaaagtttctccgtctttaagcgtaggctcatagataacgacttctgcacctttagccttaacacgcttcataacaccttgtattgaagactgacggaagttatcactattggatttcattgttaagcggaatactccaataacgatcttcttctcaaaatctgcattccattcgctgtttgaactataatagccagccttatcaagaactctgtcagcaataaagtcttttcttgttttattagattcaactatagcagacatcatattctgcggtacatcttcatagtttgcaagcaactgttttgtatcctttggcagacaatatccaccatatccaaagcttggattgttatagtgtgtaccgattcttgggtcaaggcacacaccgtcaatgatctgcttagtattaagtcccttcatttcagcataagtatcaagttcattgaaatatgaaactctgagtgcgagataagtatttgcaaaaagcttaacggcctcggcttctgtaaagcccataaacagcgtatcaatattctcctttatcgcaccctgctggagaagctctgcaaatgtatgagcagctttcacaagtctttcgtcattcatatcggtgccaacgataattcttgacggataaagattatcataaagagcctttgattctctcagaaattcagggctgaatatgatattctcactgcccgtcttttcacgaatactctttgtatatcctacagggatcgttgatttgatgaccataattgcatttgggttatatttcattacgaggtcgataacagcctcaactgcacttgtatcgaagaaattcttcttactatcgtaattagttggcgctgcaataactacaaaatcggcgtctttatatgctgattctgcatcaagagttgctgtcaggtcaagtttcttttctgcaaggtatttctcgatatagtcatcttggattggtgactttctgttgttgataagttctaccttttcgggaataatgtcaactgctgttactgtattatgctgtgcaagcaatgttgcaattgacagtcctacgtatcctgttcctgctactgcgattttcataaaagatctctcccttttatatcttatagaaatttttataccattcagcaaattttctaagtccatctcttagacttgtactcggtttaaaaccaaagtcattttccaatgcacttgtatcagcatatgttacaggtacatcgcctggctgcattggaacaagctccttatgtgcatcaaaatcgtaatcctgcggcaatactcctgcacggataagttcttcactgaggatctgcacaaagtcaagaagattttcagggttattgtttccaatgttatatattttgtaaggaggcacaggaagtccgtcctcaccatttttcttttcaggtggactcatcatgacacgctttacaccctcaactatatcatcaacatatgtaaagtcacgcttgcaatttccatagttgaagatcttgatagtttcgttatttacaagcttatttgtaaatccaaaatacgccatatcaggacgaccagcaggaccatatactgtaaagaacctcaggcctgttgatgggatattatatagtttactataggcatgagccataagttcattgcttttctttgtcgctgcataaaggcttacaggattatccaccttatcatctgtactaaaaggcactttcttattgcctccgtatacgcttgacgagcttgcataaaccaaatgctcaacgggatgatttcgacaagcttcaagaatgttatagaaacctatgatgtttgattctatatatgcatcaggatttgtgatactgtaacgaacgcctgcctgagctgcaagatttaccacaatatcgatcttgttttctgtgaatattttttctatcaacgctttatcagcaagattgcctttgataaacgtatacttgcacttcggctttgattctgcaagcttctctatttcagcaagacgatattcctttattgagacatcatagtaatcatttacgctgtcaaagcctatgatgcttatttcttcatttgttttcagcagctcttttacaaggttgcttccgataaaaccggctgagccggtgactaagattgttttgttgtttatttgcacatttacttgtttcataatccaaaaactccattcactagtatatatgccttctacacctcagctttattcaacttttttagccttttctcagcatatctctgtcttttttttgcaatctttccatttataaactttattaaatctataaattttctaaataataccgtatcattaggaatatctccttttatgcatattcctccccacaaaatttgggatttcacatgataatcctttgttgtaaacataatttttctgtcatatggcaatttatcaaactctattatttccttcatactacaataattttgttcggaaaatttaaatacgatattattccaattaattcttttgcttcttcttttccatttttctagtgcttcttgttgagatttataatgtaaaaaaactatctcaacatcatccaaaacgccaatagggcaaatagtatttcgttctaccaaattatctttgtgtttactttcgtcaacagaaatgaattgtagttcttgatcaatataatatttcaagtttttacaaaatttcacataatcatctgcaaaaaagtataatccaattgtaggtgataaatattcaattcctaaatagcgatacacatgtccaccccaacagttatttgaaataattgtcacgtttttatttgacaactttcggtttctatactttcctaaatatatattcattttttctcgagttttcacccgaactgcgtccttaaattccttatatgtcactacgatccactccttccccccctataatccattactttttattattcaaatctttctttatctgtgttgtactgatttctggtgttctaggtaaatatactacttcgcatccttcatctttcaaaaaatcaaactttcccttccaatcatcgccaataacaaatgtatttatgtggtattcatgaacatctgtcttcttttgttcccatttttcttctggtattacaagatctacatatctaatagcctctaataatgcttttctttgttcatacgaaaaataacattttttctgtttttcattccaattaaattcatcggttgagagacaaacaataagataatcacccaaagcttttgctctttttaacaaattaatgtgcccataatgtaataaatcaaatgttccataggttattactcttttcatactatatgtactccttttcactttatttctgaagttttaatacacgcattaacatagctaatgtttctttaaaatattcacttttaaatgaaaatgctattatcaaaattcctgaaattatcacagatagaattcctttcagaatcattgctatcactggattccaagctggaatgcaattacagatagccgaaataactccaataatcactattccttttattaagtcgcttcccatatcttttaaatacttgtatgaagtaacttcgaatgcaactttacttataacaatacctttatgaataaatgtaaaaataactgttggtatagtaagtcccaataatattccttccattccccaaacctttccagcaccataaccacacgctattgctaaaacggcttgtataatcatcactcctgcgtcacacctatgaagtcccattgcattttgaactgaaataattggaatatccaataaatatatcaacatactaaaaaccaaaatcaacacacaagaaaaacttaaaacaaaatttgatccaaaaactatgtatataaaatcttgaatacatgcgataaatcctgcacaacaaataaacgctaaggaattcataacaaagcagctcttcctatatacactgtacattctttttttatcattttctgtcgccaaattaccaaagctagatgtaaatgcgcctcccatttgactaaacaataactgaactgtactaataacaagttgataattaccataataaccaacaatagatatatttcctagtaacatactaatcagaatactattggcagaattttgtactgttagtgatgtttgatttataaaaagtggctttattgtcctaaatattgcctgtttcttttccttttcgagttttaccgcattaatcttctttaaatatggatgctgtttattcacatatatattgcagatcgcattactgcatattttttctccgataagaaataataaaaaatacaaatattcatgcgttaaaacagcagatacgattgccattcctctaaaaatcacttggctaatagttgtagacattatactaatacgattattttgttcagcgtataaaatacttcttttataataagccaaataatttgcaaaaaaagataacgcaaaaaataagaaataaatatgcactgctttcatatcaatcgttgttgatacaatgcttcttaaaaagaaaacatctacaattaagcctacagtcagaaaggcaaatgcaattcctaaatatagttgccgataaaaagatattaatttttttatggtattgtcatctttattttttacaggttcatataaatgaatgaccattgctgagctaacaccagtttccataagagccataacatttattgtattttgaaagagattatgcaaaccattaatttcttctcctaaagcgcgtacaataaaaatacgcacagcaaaattgagggcaactgtaacaagtgctgacaacattccccaaatactatttgtaattgaattatacgttcttgatttttctttcattaattaacctcggtttcttatttctcttcggtttatttcagactaaccctctcaacaaaccagaatatagcaaacatagggattattctaatatataaccaactcaaactaattgtcatatttagtattgttccaagaccaaaccatacagcaacaaatccccatatatatttcatatagcttgtagtttctacatactttttatctgttgcccgtatcaaaagaactgaaatacaactaagcaatggtgccaatacccaactaaagaaaatcccagactgcccaactagaggaatgatttgatctcctcttgaaccataaaaaatccttcctaaatagccattatataaatacactgtcgaattatttgtatcgacaagatgattaattattggcatattattaaaaatatcatatattatattatgaagaccaactccgtcagctttactcaatccaatcgcattattaactgaaactggtcctgcaaaataagcatctccacttgttggtgttatgagttttgaaaataacgaatataagcttcctgtttctctttcaaagccaagccctgatttcaacgctgatgccattaatatcaatgcaatgactggtactattgttgtttgagctatcattttcttttcacctgggaacaaagaaatcaaaacaaagatcgctgtgattgcacttactaatgtataccatcttgagattctggcttgaccaatatatgttatgatcacatacataagcatatacatgatagaaattcctacatgcattcgtttattatcaactgcatatttatccttttgtctattaattccataaacaaaaaaccaagctgtcatacattgccaaactattttcaccatgccagacacatcttgaatagattcatcaacctcattagtaacatcattcacaagaaagatatttccgtttaatatattttgatttgttaaataaattccaaccaaaacacaaaaaattacaatgactactaaaaaagggggtcttactgttacgctctttctaccctgattatactgtttggtatatatataccacgcttttgtagcagtaacttcaagcacaataaaaaccgcaaacatttcatataacataactattacagcttgtaccatatatctgtaatcatttgcatattttgataactcgccagagctacaaagtactactggcaaaacaacatacctacaaaacataacacccataattactgttgcgcctggtgtcttaccaattaatctcctacttttataacatatagcaaacaaaatgctatacaccaaagggagtaaaaaaaagccatactccgtctgtctgttcaacgaagcaaaaatacaatagaagaacgccacaaaattacatatttcccataaaacaatctttcttctcatgccacgccttcctgtgtagttatatatttattcttctctaagcattatccataccagcctctaatatagcatttgcttgtcttattcgttcttctttataaaataatttttttgaagcattcgcctgttctttccattcttttaataatttttcattgcttagaacttctcccaattcatcgcaaatgctttctttatcatttctaataacacatccacaaccggataattcttttaactcaacggctcctcctacatcaactgacgcaacagggatgcccaataacgcagcctcctgacaagatgtgctaaatccctctctataggatgcacagaaatacaaatccgcttctttcaaatatttatacgggtttgtctgtttaccagtcataataacatatttctcaagattattatcctttatatactgctgcatcttactctcttcactaccaccgccaacaatccaaaactccgcattttggttgctcttcacaatttcctttatgcactctaaataacgcataaaccctttttctggtgtaagtcgagatacattaatcacacaatacttatgtttttttgttattggacatttttctttcgccaattctaaaattggtgtttcatcaataatgttataacaataatcacatttttcagggtcaaacccgtcttcaatcattctatctctacctgactttgcaacattaattacttttggaaacattttgtaatattctcttaaaatcattttcgtatcatatccatgcatccaacataatttattagggttaggacttactgcaatacatttagtcggtattccaaattgaaaagcgacctccaaatcatacttttctttgacaaatttcttatatatcttttctggcggtattaaatttataagtttatcaaaccctctaaaataaaaattgtatccaggtataacttttattttattcattatcggtgctgcaaattcttgattaaattcatatattgcaagtaatgaaatgtcatattcattctcatcaagattagcaattaaattccgtaatactgtcgccacaccatttgaaaatcggaaatggttagtaacaaataatattttttttttcatacttctacctcaccacttatatctttacttttcccattgaatcatctgcaaacattttttctctttctggttttctatcatacggaaatttgtatagtaagttcggcaccagatttgcaatagttttcacttctttttcccattctttgtgtactctaaatacttgtgtattctcaattgaatcttttgggttaaaatgttcttttttatgtatatgctgttctttctttaagcccaaaaaagtttcaatactatttacggcgttttcataatcatataccaaatcttcaaaatgaactctctttgcattaggattcttaaagtcctctactaaagtatttttccactcttccgaaaaagctatcatatctgttggaaaatgaacactactttttctaaatgcattatttgaccatatatgctgatccaaaatatataaatctctcggatctctatcgacaattatcatcttaaaattatcatcaaaacatttttcaaaatcgtctatttgacctggccaaattatatgatcaaagatttttacttcattttctgttccattatcaaaaagcgaaaaatatccagacgtaaattttttagccgcatcatataattctttttcacttggtaatgcacagtaagcatcttctttatcatatatatatttaactccataatttgaaaatcgtcttttttgtgctatatggagagcaacttgcgctgtcgctttcaataatgaaaatcgtgttttaacaatgtgatttgtggttttatcctcccttttttctgcgatactttcaacaaattcatataccaaatccatgaatttattaccaaacatcttctgataagagccaaaccacacataattgtaatcattcaatcgtttcatttctgttatgaatgtactaatcactttatcagatgtgtacaatgtatttcctcttgataacagtgtacacacatcatacagtccaccatgatgatatagaacattatgctcataagattgattttcaaaaggaacaactcgtacattttcatattcctttaataaatcaacaaccgctgatgaaccggttccaaaatatcctgtgactgcaacatttattttagattccatatatgcatccttcctattttccttggtgcattttcttatacttaacaagtaacctatgcggaacaattatagctaaaagctctttgtaagcatacacatcatattttcttgataatcccattttttttcgccatatcttgtgtgttcgatagttatttaacctatactttgcttttatttcttttattttgtctcgatcctcataataatcaaacaagacatctggcaatatataccccttatatccacaagcatacattttgcaccaaagatcaaaatcttggcctcgcattgtccgttcacaaacagtatacattcctgctgaaaccaacgcttctttacgcatcatcactgttgggtgtgtaaaaatattacatttgataatatcttccttagttaattctccaccctgtccatatgtattccaaattcctgcattatcaaaagtgtttctgcacgttcctacaattgcatattcctgatgcttatccaaaaaattgttttgcttttcaaatcggtcggcatgagaaatatcatcatcatccattcttgcaatatactctcccttggagatatttatacagttattcaaagatgatgccaaaccacaatttgactcatttcttgttaaaataactctgttatccttttctgtataactttttattactttaatagttgcatctgttgaacaatcatcacatataatcaactcaaaatctgcaaaagtttgattcaatatggaatcaattgctcgtggcaatgtcttttctccattatgtacacccattattacagaaatcttcggcatccttccaacctcacccatttaccttactgttttacataaactatttctatgttcagtcagtcttttaaataattcattttgctcatatttttcttctacatgctgccttgcattgcaaccatattttcttacttcttctggattatcaatacaatgttctatcgtactaataactttatcaatattttttgctggtacagaccacccatcaacattcggttctatagtatctacctgtcctggtacatctgtaactattcccggcagtcccattgctgcagcttcaataacaaccaagccgaatccctctctataacttaatgaacaaaatacatccattgcactataatatttttcaactttatctgtccaatcaacaaaaattacatgtttggacccctcagcccatttacgcaactcagcctctatggtattagcatcatcaaacataccaatcattaataaatatgcatcctttttcttaacaacttctctaaaagctgacaataattcattagcacctttgtcccttgttattctcccaacatatccgaatactggtgctctttctgtaatttttagctctgatcttatttcttctctccatttttcttttttttctatgcaatacttattcaaatcaacaccacaggcactaccattccatataactgaagcctttgatgacggatacaatttttcacttatactaaatctataaattgaataactttcacactcgattaccgatgactttttgcaaactattttttcaattttttttaaaatcatacgcttaatgccaccatcaaatcccatatacctaattccccactggcaatataagcgatttgaacattttgctctttttgccgctattgatgcatacaatgcagcgtttggtgttgaatattgaataatatcaaatttattatctctaaatattcttgtcagtttattaattactgataaaccctccaatcccactcctcttttcataggaactgggatataatgtacttgattattgcacaactcatacataccctcatctgtattgcaaataaaggttacgtcataatcgttattgaccaagtaatctttaaactgtaataaaaatgactttattgttatagaaacagtcgttacaaagcatatttttttcattctcttactcctttatcaaacgcttcgctggtacaccaatatatgtcccctcttcttctaaatctttaattacaaccgctcctgctcctactatacagttatcgcaaatacttaaattattcagaacaattgcccctgcccctatccaggttttcaaaccaatatgcacattgcctgcaacatgtgcacccactgatatatgaacaaaatcatcaattatcccatcatgatcaacagacgctcccgtattcacaatacatcctttacctattttggtatctgaattaattacagcacctgccataactacagttcccattttaatttctactcttctgctaactacagctttggggtgaattaacgaaactatattacattgtatattctctaatttttttaaaacattttgtctagcaagtgcatctcctattgcgacaataaagtcccaagataaatactcttcaatattttcagttgtcccttttaccgcaaatccagcacactctgttacccttttatcatcatccagaaaaacgatttcgtcatactgattgtttagagctatatctgcaatgacctttccatgcccacttgcacctattattactaattttttcaattgggagtctcccatcttgccactacacctttcggagtacccataaattcttccatagttgatgatgattcagagcaaataccctcatgcttcacgacagtttttattgtcgataagataatcttaatatcttctttaaaagtaatatgagttgtataccatacatccattgcaaacttatcttcccatgaaactgcatttcttccatgtgcctgagcataccctgttaatccaggttttacatcatgtctatgatgttgaaactcgttatatcttggcaaatacgcaacaagcaatggtcttggtcctataagactcatatcaccctttaagatattagccaattcaggcaattcatcaagagaagatgctcgtaaaaaacgtccatatttatttaatctaacttcatcaggcaataagtttccttttttgtctttccggttatccattgtccgaaactttattaatttaaaaatcttttcattttttcccggacgatcctgtgtaaaaaaaggatttcctttcataaacacagcccctaatattattagaagcaccaaaagaggtgaaaggataattaacactattagacttgatgaaaaatcaatcaatcgcttaaaatactttgcgtacatattatttctccatatagttgttataattgatcattcaaaacaaactttattacttcaataattcactccactggtaatatacatattcaattttgcacgtccatttttagttctaacaacaaatgagtttaaatgaaaaattgaccccttatgcattgagttccaaattggacatcattctacattaatggatgagttagatttcaaaagctctggtaggcaaaactttactgttcactttagatttacagttgcattaaaagtcatatcaaagcagaatacttgctttttctctgatgcatctgcgtatctgcaaccaatatattaacatattcaattaccagaccatctatggtaagacttcaacgatacttcgaactaaaacttttcatatttattatttcctttaagtttagccttttacttttgggggccaaaccttatttctcataatttaacaaacacttttatcaagcaatctctttatttacgtcttctggtttttgaaatgttggaacaacacttcggagtgcctcttttgcaatcatatcatcacctgtattacatgcatctctaagtacatcaatctttttgtagatttcttccttactcaatgcactatccctttcaatgaaaatcatgctgttatcagttttgtcaagttcttctgtcttaactaacagttcctcatacaacttttcgcctggccttaatcccgtttcaacaatctcaattccctgaacaccagataaacgaatcatattttctgctaaatctataatcttaactggctgtcccatatccaaaacaaataattctccattatccgcaatcgctccactctgaagaacgagctgtgaggcctctggaattgtcataaaatatctgataattctcttatctgtaacagtaaccggaccaccattcgcaatctgacgcttaaataatggaataactgatcctgcgctacctagtacatttccaaatcgtgtagcactgtatttcacttttccgtgtgtacttgcactctgcacaatcatttcacacattctctttgtagcacccataacgttagtagggttaactgctttatctgtggataccatcataaaacgttctgttccaaacttctcgcaaagctctactagattctgtgtaccgaatacattattgtaaatagcttccacgcagttatgttccattaacggaacatgtttatgagcagctgcattaataattatctgaggatggtatttctcaaatactttctcaagagctttcctatttgtgatagaacaaatttcgatctgcagatcaagacaatctccgtatgcgatttttaactcctgttgaacatcatatgcaccattttcataaatatccaaaatgataatcttccttggattcatctttgccagttgtctgcaaagttctgaaccaatggaaccaccaccaccagtgataagtacaactttgtctttatagtaagcatttgttctttcatcagaaaccactaattgttttctaaacaaaagttcctcaatatcaaattctcgaagatgcctctttcctcctgcggtatacatagtcggataatcataaacctttaatttatatcctgcatttttgtaatattcataaagtgcctttttcttgtcagcatccattgacggtattgcaaaaataatctcctgtacttcaaattcacccaatctgttaaatgttgcctcattctctgaccaaactgggattccatgaatttcacgaccaactttttctttgctaatatctataaaacatctcggaatatatgctgtttcttcattatttattagttcctctgccagacttacaccaacacgtcctgcaccaataattgcaactttgattttctgaacttctttttcattttccgcttctatgccagaaaacatatgtaataacgcggaaagaatttttccttttgtagtttcccgatttccgcacttatacgcatagcgatacatcatacgaagcgctaatgctcctagaaggttcaaactgacaattgaaagcattctagcaaatgtaattttttgaattggaagtaataattccagacacagataagctacaaaagcaatagaatcggtaaatagtaaccggatataacactgtattccaccatatctccatacctgcccatatactttaccaataagacgtgctacaaaaatacacagtaccgaaaggcatacttgctgaagtattcctatagttgataacttatcaattcctccatacagtaataacagtattgctactaccactgcatacataatcaaatcatacccgataagcatccacctgatattagatgtgctactctgctttgtacgatccatattcatactattctcatttgctctatccattgttttccccgcaaaaatcggatgggttcatcctttcatattttttctattttgtggtttacttcttttcaagcggtgtaaataattttttactctgtttcaattcttatttcaagtacacttgttgacttcaaaattattctagattttaatgtacagccttattaaaaaaagcatacgttggctagttcaaatcccattatcatgaatttcaagcttatagtgtgatctaaaataagcatctaagaaaccattggattctcatagtcttgctgctcacccgacacaaccacgtagaaaaaatcatcatacctagatccaactaaataagcgaaactcttgtataatcaaggtttctctcattcacctctattgttatactactatcccctgcccaatattgataagtgccattaaactcaaaacaaagtcaagtattctctttatgtatttcgcatacattactcaaaacaactcctgataactcgaataattctctcctgctgttcctcagtcatcttattatcgctaggcaggcaagcgcctctgtcaaagatatcagcgcctacatcttctgcaccgcctgcaatataagcatttgtgcggcatctgatactgccgttgcgtccaacgcactcgtgcattctgtacataggctgcatgtgcattggcttccatattggtcttccctctgcatttatgctcgcaatcgcttccaaaatttcagtaggacaggtcttgccagcttctttgatgtacaaagcctcgctgtcatttctgacctgcttgcacattgcgtctttatctatgataagtgcagacagccaataatttggctctgttccctcaacgataggattcattttaacaggaagtcctttaaaaccctctttgtatctctcgtatattgcttttttctgcgcaatatgttcctcaagatgcggatactgaccacgaacgactcctgcaataacatttgacatacgatagttgtatccgacctcttcatgctgataccatgccgcattctcacgagcctgcgttgaccacttacgagccttgtttgcatcttcaaggctgttcgtcagcaaacatccgccgctagaacctgttattatcttattgccattgtagcttacagcactgtaatcgccaaagcttccgcactgtctgccgtcaattgtagcgcccatagcctcagcagcgtcctcgatcaaaagcgcaccatgcttctcgcatattctcttgatctcgtccattcttccaggaaaaccgtataactcagcgcttactaccagcttgacttcaggatacatctcaaaagccttttcaagcgccacaggatccatgttccaagtatctctgtcagtgtcgataaaaacagggataccgccctcgtaaacaactgggttgagagtagcgtcaaaggtcatgtcgctgcaaaaaactcttctgccctcaagagcgccatgagatatagcaggcttgccataaagcctctcgccagcaagcttacagcacaagtgaagcgcagccgtgcagcatgaaaggccaacagcatacttgacttcagacttctccgccgctatcttctcgacctcatttatattcttaccgactgaagacatccagttggtattataagcctcagtaacatattccagctcctcaccatgcattgtaggtgacgcaagccatactttttgtttaaagggttctatcttttccattattttttacctcttccatatttacttcatataagtaaccataattacacttattcacgttaataattttatcacaaaattttaatctagtcaagtatttgccccatatttatgtatattttttcaaaaatcgtacattttcagtgtaatatacaatgctaaccatttacaaaaagctcagtttgtgcaattttatactaagctgaaagctataattttcttcatttaaaattgttaaatcatgaaacgttttgaataatatttttaccacaagatttttgttccagacaaaagctgacttgatttttatctgcattttacacggcttttattgattatcaggcaaaaccagcatataatcataatagtaattatggcgaagtatgagaaatatgattggagcggtgtttatgatagtaaaaattttctgtgcggttttggtagcccttggagtgagcgttgcaattgttctaggcggtctgataattttggcttcttgtgttagtggcagaaaaaagcccgctggtgacaataccgctgatgacgaggacacatttatttacacaaattatatgcagggattttacctataactttttctatcctgccaagctttttaaatagtatactcatcaagtggagagtgctttgcccataagcattctccacttttgtataccattttttattctatcactcgacccccaaaaaactattgacacagcccgaaacttgtgctatactctcaacaaaatcaaatgaaactacacacagaaagggcgttttataatgactgaaaaagaaaaaatgcttgctggcaagatatatgactcctccgacaaggagcttgcagaattgaggacaaaggctcacaagctttcacagcagtacagcagtttgtatgaagatgatgagagaagaaaagctatccttaacgagcttctgcccgaccatggcgagggattttttctccaaggccctgtgtattttgactatggcgttttcacaaagttcggctcaggctgctatgctaactttaatctgacagtgcttgacacctgccctgtgacgattggcgacaacgtgtttttcggtcccaactgcaccattgccacccctgttcacccattcagatggcaggagcgtaacatgaagaaaaagtctgacggcactgtttatgatgatgaatacggcaagcctatcacgattcactccaactgttggatagcaagcaatgttgttataacaggcggcgtaaccataggcgagggctgcgttatcggtgcaggaagcgtcgtcacccgtgacataccgccaaattctcttgcggcaggaaatccatgcagagttatccgtgagataactgaggaggattctatcaagtacaaagcagaacttttctgagcataaaaaatacccctgaccagaaaatgatcaggggcatttttatcgtctgtcatatcattgagtatagacccattttttatcggaccacgctccgttataagtctttccgcctttgacagtgtagcttcttacacggacgtaatatttttgatatcttgcaagcccggaaactgtctttttatcggtgcggttgtttgttacctttacgctttttgctcccttaaagtcggaacgctgtgagtatgatatttcatatccagtggcagagcctttctgtgcataatctataaagaagcctgcatatgtgccgtaaagcttctgtatcacctgctttgcaggatagatagcaaagctttttgtgataactccgccgtaaatgcccttgccagtgatagtcacctttgctgtgccgacctttgtgtttgcagaatatttcactgtgtagtctgtgccgtttttaagggtctttgagccgtattttactgtgatcttctgcgttatcgccttgcctgtgaagctttttgaagaaataccgctgacctttgcgtttgcaaaattagtctttgccgtcacaatgcttttagcgtctgaccaattgccgtaataggtctttcctcccttgacagtataagagcgaactcttacataatatgtctttgaagctcctaatccaagtaccgtcatcttatccgtcttgttggtggtggatctgtaagtggaagcgcctgaaaaatcagatcttgtgccatactggacttcatagcctgttgcagatcctttctgcacaaaatccacaaaaaagcccttgtatcttgtttcaagcacctgtatctgctgttttgcaggatttataacaaaggaagcggtctgcttgcccttgtaattgccgtaaaattcaactgatatcttgcccgtgccaacgttcacgtttgaggaatacatcaccatataatcaacataacgttcaagggtcttgttgccgtcctttataagcacatcaggtgttattgccttgccggtgaacgacagcggtgtagcataataaagcttgaacttggaagcgtcctttggctggatagtaaagcttttcgcaacagaaccgctgtattcgccattgcccacaaaggtcatttttgcaggacctgcgtcacgattggtcttataataaacagtgtaatccacgccctctttaagctctttgccctcataggcgagcgttacgtcaggctgttcaatatcctttcctgtgtatgtgaacgtattcttaaagcctgatatctcgcagtctgcaataagcttgctgtcagaatactccgctgtgacagtcatatcctctgtgacgtttttatagtccttgtcccagcctgtaaaacgcagaccctttatagcaggggctttcggagcttttgcagacttgccgtattccactgtctgctgacttatcaccttgccgtccttatccacaaacgtaacattatatgtataaggcttccatgcggcataaagggtctttgcaccgcctgaatatgagatgctttctattctttcaccagaaagtgcggcattatcataccagcctgcaaagtctgcaccctcttttgtcggctcggaaagcgtcacgctttcgcctttgctgaggtattctggattgcctgtgctgttcgtgccgccatttaaaacatagtcgacagtgacaaattttgcttcaacaagctttgcctttactgtgctgtcagcagtataaactgtgttcgcatcgacagcaatgccgttcttgtaccatttaagagcataaccgctttgcactttgacaacaggatatttcaccttgccgtctttatcagtgcaggcataatgcttgccgtcaggggcttcaaatgttatcttgtgcgaagcctgctcccctggacgagttagccttgctttgccgcctgccattgtccacctgccgctgtctgtctgctttccgccaacggtattcagcgaataagcggcagagcttgtaacgttagacagagccgttttctttaccttgctgtcagaaaagttgccgttataccagcaactggcagattgctgtccataataaaaagcgtcattatcaatactgcccaccatagctttagcatttgaactgcttgactttgcaaggtctgaagcgcactctgtcaaggtcagaccacctgctttgcccacgattccgcctgccgagcttgtacccttgacagttccgctgaacgtacagcgttggatagataccgcatcaaattcaccaacgatcccccctgcgtacttaccgctgacagttattttctcagcactgagatctcttatctgcgccctgtcctcagcatagccgaacagacctgcataagaattgttttggataacagcgtttttcagaacgtgtccgttgccgtcaaaatatccgcaaaaaggctttgaagctgttcctactgccgatatctttgcaccaccgaagtcgatgtctttttcaagcacaacacgcttccctgcgaagctttcaccgcctgatacacgctttgcgaagtttttccaatccgtcgccgtctttataacaaggctttgttcctttatctctttagcctttgcctttataagaagcttggcattggtgatatcgttctttgaagcgttttcgtctgcaatgactttcttgccgttattgacctcacgctcataaccgctctgcttttcatactttgccacaagtgtttcaagctcgcttttgtcagccttatctatatcatcggtataggcaaatattataggctgaccggtataagcgtcctcgtcggtaacgtccgtccaactgtcaccgtcattggaaatatacgcctgaccaggcttcatgaccccgtcagaatagccgtaaacggtcacataggctgagccgtcatcaccgctgaatgtcatcacgacagaatatctttcgccctcgtcaagctcaacatcagggatatccacagtatagaagccgtcgctctgcacctttccgctgacctcacattcaagtatccccacaggcgtgctgtctgaaacagaagtgtagacctgcacggtgtagtcagcctttccggtatagccaagatacataaagcccactttgtcaagaagctcgtctttttttgctgtaaaaacatcagcaccgctcatttggttttcattgcaaacataaaatatagaattatccttattggcaggataatggtaattattatcacagctttcagtgagatcgaacgccacccaatcagtcatttctgcctcttcataggatatccagtaatagccgtctgtgccactggatactccccaggagcctttcacaagccatgctccgtttttctttggctgatagcctgcaaggaaatttgacttgctataattatcgtcccagcccactaagcttacagcatgattaatgccactatattttgtagtttccggatcgtaatagcttttgttatcaaaggtcatatacaggtcgtctgcataatagctcaccattacgccgccaagctcttttatcttgtttttaatggcgtttcgtccgcctgtgatagtggaagcgtaattaagctgatattcacaaacgccctttttctcctcagatacgatagtggtttccgttccgtcggacacgaaaggctcatattcctcatagcaaagtcccctatgagccgccattgcaagtgacgaatccatccacgttccgccgcaatcccatattgactcgtcaaatccgccgttagcatatgtagaaagggtaaggctcggcacagaaaactgcacgttttgattttcaagacccttttgaataagattgctctcagtgcaggaaagtgccgcaaacgcccagcaagtgcctgtctggaactgatttttgatagtcgtcagcgaattcttagatctggggtcatatttcgcaggcagcgaagccgttgccttttgtgcataaggtgaaaccccgtcgtccgtatcgaccagatctccatcagcgatctccgatttttccaggccttccttttcgtagccataaccattatcagtaaaaattatcctgcccatcttaaatttcgggctgtcattatctccgccatgctccgcatccgcaaaagctgcgcaaggaaactgcactgacaatatcgctgccgtcaaaatggcggcacatttatagatcaccttcataaagatctcctttctgcttttctgttatttagttgcacaaagtttcttttggttactattttaatgattacttttttatctctttctccccactgagataatatttttcttagtaagcacaagcagcacaatgccaagcaaaagtatcagcggccaagtgagatacggtcttttatcattatcaatatcggtcacgaccttatcaggctcaccatttttatcagtgttgtaatacacgttcactttttcgttctgactcacataatatgtgcctgtgaagatctctcttgtgtactccttgccgccaacatcaaaagcgacagttatgtaatatgtttcagctttgttgcttgcctttttgttatgtccccaagttttcagctcatggtctatccacttcacatagcctgtggttttctcagcacttgacatgaaaaccctgtttgaaacatacttgctgagattatagatagtagagaaaccacccataagaataaaaacgatactcagagcgataagccctgcattttgctttttcatttgatataccccctaaacagaaatgttgtgttaatatgaatttattatatcatatgagaacatggaaagtcaataagcctatcccatctttccataagtcttatagacatatttattagtacggttttgatcgttgaggtaagccgctattttctttctgctgtaaggactttttttataagatcatgttgaaactttattttcttcattttttgaacaattcttgactttgttgcaaatctgtgttatactaatcataaacgaacggtcggtacgcataaaaggagcgaagcaacatgaaaacaactgagcaacagcacaatgagcggaaacgtgaactaatggaaaagtgcttcgagtgctatgcggaaaacgggctcacaggcacaggaattaaagcactagccgatgcgtgcggatgcacgaaagcaaatttgtattcgtattttaaaaaccttgatgaactgatcattgagtcaacggcatactgtatggaaaaggttgaggacgactttatggagatggcacccaccgaccccgaggatgttgtccgttttgtgaaggaggtcccgtattggacagcaaaaaagcacggaaaaaaatatcgcctgatgtatcagatatatacgcacccgaagtatatcgagcacggcaagaaattctttgagggcgtgaacgaacgctataccgagtacgccaagcggcttgagccgaagatcggcattcgatatacggtcatcacgccgctgatctttatattcgtccgcgcctgcgttcattatgcgatgtttgaggatgaatattatctgaaaacccagatggaggtcttaaaacagggggtcgccctgtttgtggataagtacaaagcaaaccaagcataagcctatcgaccgccgctcatttacggcgtgggcagcggtgcaaagctccgccgtgataaacaattccgaacggaggaaaaaagatgaaaacagaaaaaaaactactcacaggtacacttttggcgctttgcaccgctcttttggtgctttgcagcgtgcttgcaataggatggagcaaggcggcaaaaacaggcgacgcactgccggaggtgcgaaacaacggcacggcgattcagtggaaatacagcgacgaagccgactggcacgaccttgtggcgcttactgagctgcggggcgctgccggagaaaacggaacagacggtaaaaacggtaaagacggctctgacggcaagaacggaataaacggtacaaacggaaaagacggcattaacggctccgacggcaaggacggcattaacggagttgacggtaaagacggcattaatgccaaaagcatagaggtgcagcgagctgaaacccacatacagtggcgttacgagggcgatgagtggcaggaccttgtggcgatagccgacatcacaggccccaccgggcagaaaggtgcagacggagcaaacggaaagacaccggagttccgtgtaagcgaaaacaccctgcagtggcgctatgtcggcgatgaaatatggctgaacctgtacgatctttcggttttgaaaggtcttgacggcaaggatggtataaacggaaaagacggagccgacggcaaggacggaacaaacggacaaaacggctctgacggtgtggacggaaacaccccgtttatcggcgagaacggcaactggtggattggagaaaccgacaccggcgtaaaagcggcaggcattgacggcacagacggagaaaagggtgacaagggagataaaggtgacaagggtgatgccggagaaaagggcgacaaaggagataaaggcgacaagggcgatgccggtcagaacggcagctgttcggggtattttcacgcctcaaacggcggcaccggcgcttcattcaatcagccgcttcagttgtttgaagattgcaattccggaggactttttgtatgggatcgagccaatagaaccgtaacgctgaaagccggacatacatacagtatttcattcagcggttcggtctgcatttctcacgacatgggtggatggtactcggtagtattgaaaggcagacaaggcattcttaatgatacattgatcgaaaggtatatgaacgatgcagataattcacgagtgtggatgccgtttgcattcaaccgcatctacaatgccggcagtgatattgtgctgcaatatgaatttatccagttgacccccggcacacagctgaacggtgctgtctataatattacaatcattgctcttgactgagccgatatacacgaaaacagaggtaacggaaaataaaaaaacgaatactcagtatcatgctcaccctttgtatggttctttgccttgtgtcgacaagtgtatttgccgaggataatatggcagcgagtgggacggcggaagtttccacagcggcggaactggtttcagcaatcagagaagcttcatacggaacagtcaaactgacgtcagacattaccatttacaccacattagtggtcaaccgcaccatcacccttgatctcaacggttatgtgctgaaatacggcagcagcagtgcagggcatgttataatgtcccccttgtcaagacacaaatgaaaaaaattatcgtgacagcgaaaactttgtatagccatccaaaaaataccacaaaaaaagactgctgtcttgctttttggcaagatcgcagccttttttcttggggactttttttacagcccccttttttgttttccgcacagaacaactgtaggggcgaacagtgttcgcccgtttcattttttcacgatcctactgattattacattgtataaacactgcacccaaatgtaggggacggctcccccgacgtcccgacatcgaagcgttaaggtttgatttatcataaagctgtgtaggcaaacaaaagcgggtcagagctttacactccgacaccgctttattatagcttattattcatatctcaaagcgtcgataggattgagcttcgccgcctttatggacggaataagtccaaatactattccaactaccattgaaaataccaccgacactactattgacgccgaggatatagccacaggcacttccgctaccttcgctattacctgcgaaagccctatgcccgtcagcacaccgattattccgcctatgctcgtaagcactgccgcttctgtcaaaaactgtgcaagaattctctttttccttgctcccagtgcttttttcagtcctatctctctcgttctctctgttaccgacacaagcataatgttcattacgcctataccgcctaccagcagtgagatgctagctatccatataagcatcttattagtcgacgaactcagatcctgcaatgacttcgcctgctccagcaggctatcgctcttgtattccacagaagcgctggtttccttgctttcgccctttacagccgaaacgttctcgttaagaatatccgccgactttttgcctgcattcgtcatcgagtccgtgtccacagcctttacgatacagttttctggttcgtcatagcggaaaactatcccccaatcgtttgtggggataaagacaagtccgcttgatgtctgattgtatgtgtagtagtcctccactgagcttataacaggctcaaagtttgaatttttcacagccacgcctattacagtgaacggctcgccacttatatctattacctttcccacagggctttcaccctggaaaaggccctctgcaagtgttttgtctaccactgccaccttgtcaaatttggtaaagtttctctccgcaaagccctttccctcaactatctcgtatccaacagtgtcaaaataatccttgtctactccgtatatagttgacgaatccattttgttgttaagataaaacagattgtcaggattgtttcttgtgcggtaaaaagtgcttgactccacctctttaagctcgttgatacgttttttagtgtccgatgtgaacattgccacattagacggtggcgcttcataagaaaagtcgcaaacagtgtcgccatttgaaagctggatcttcacagtgttgtttcctgcgccgataagattgttctttatctgctcatttgtacccttgatagtggaaactatagcaatgatagccgcaataccgataatgataccaagcatagtaagaaacgagcgtatcttatgtgaaagtattcccttaaatgaaagtctgatattttctatcatattatccgcccccttttaatactcaggataaaggactttgtcggtctcctttgtccttacgccctctttgacgtccttgccgtatgggaagcatatcttatctttcatagaaagtccgcccttgacctcgatattagtgccatacattatcttgcctgtttttatgtagcttttcacaagtctgccgtccttgtcggctttcattatatagtagtttccgttttcctgccttacataatgtataggcagataaacgctgtcactggtcgtggtgtcattcacaaatgaaacgcctacccaatcgcccacgttgaaatccgtgctgtcgctgagcttagcttctatagtgtaggtggagctgttaggattgtcaccccagttgtttgtcgagtatgacgtaggctcgctgcttatctttgttatctcagcgtcaatgctcattcccgtgctgtatgagttcaccataacagtgtttcccacagccgctctgtcaagattaagctcgcccacactaaaagtaacggaaactccgccctcgccctcgattattgcgaaaacgtcatcatcagagctgtcaccactgtagtccgtgctgccgtctgtaatgtccttatcgtctttgtcgtcaccatcgtccgaattatcaccctctgcggcagcgtcgcctacagtgcctatctttttaacgactccgtcgatattagccactaccttgccgtctgtctttttcttcaaagcgtcattgtagtcaagctttgcagacttaaggttaagctttaagctctttatctcgtcctctttttctgatatcattttctttatctctgcacggctgtgcatatagtccccagagcctgaatttgcatcgtccgtctgtgacgggtcagcaggagtgacatctatgccggcgtcattatcatcataatcaccgttatcaggtatatccacatcaccgccattgtcgatatcatcagtatcatcgctatcgtcagcactgtcatcactgctgtctgagcctgcaggcaaaacaatagagaacttgccgaactgctccacagaagtgtcaagagaaagcgtaccgctttccttgtcctcagttatcccctgtgaaactgtccagtctgcaagagcctttttgccaattgtttcacggttgactatccacttgtatataaagtttgagttatcatcataaacgcaaagctccgcataagcccccgttgtctttatcctatcaagaaacgctctggatacctttgtgttcctgttgcagtttataatgtaaggatcgtcctttgtgcctgcatttttcgtctggaaaacagcctttacaacgtccacagtttccacaggctcaggagttggctcaggatctggagttggctctgggtctggttccggctctggttccggctcaggctctggatcgtcaggctcttgcggtgcgtcctcagaaggctttaaaagcttatatttagcaagctccttttcagccattttgatgttctgctcgcagacctttacctgattttctttctgtgaaagctccagctccaccaccgtcatgtcatattcaagtatagtgtcgccctttttcacagtgtcgccctttttcacaaacacctttttaacaagcttctcgttgtcaagagtaattctctgagcgttggcagaaactatctgcccgtccatgttcgttgagctgtcccactcgtacgcatccgcagtttccgccataaggtcaacaggaactaccgccacaacagttttcttgtcctgatttttcttatatttcattgctcccgcatatccgcctccgccgaggatagctatgcacaggagtgttattattacctttttcattcctgctcacctgccttttctccatgaagctcgccgtcacggatatacattatcctctttgcacatcttgcaatgtcaggctcgtgtgttatcataacgatagtaacaccgtcgtcattaagctccttgaaaagctccattacctgatcgccagactttgtgtcaagagcgcctgtgggttcgtctgcaagaagaagctttggattgttgactatcgcccttgcaatagccaccctctgcttctgaccgcctgaaagctgagtaggcttgaacatcattctctgtgcaagccccaccttttcaagagccgcctttgctctctgacgtctttctcttttgcctacccccgcatagagcagcggaagctccacattttcaagagctgattgtctagggagcagattaaagttctgaaatacaaaacctatcttcttgtttcttatctccgaaagcttcctatcctttgcctgcataatgtcacagccgtcaaaaacaaagcttccctttgtctgcttgtcaagacagcctataatgttcataagcgtagactttcccgaacctgacggacccattatcgccacatattccccctctgagacatcaagggaaatatccttaagcacaggcacagcttccttgccctgcaaataatccttgtagatatttttcagttcaaataccattgcaagccctccttattcagcgaaagctgcgtcagcatcagcagcgtcggcattctcaccgtctgcattttctgcattttcctcttcaccgtaaagcttgttgaagtattcttctatctcctcgtccgtcatgcttgcaagcatatcctcgtctatagccatgccgtcctcatcacttccgtcaaaagcgatgtcctcgtcaccgccctcggtatcagcgtcaccgttgtcgttcgtgccaaggtcattaggtggaacagacacgtcagcctcatttgtggtagccgtcatgccctcctcgatagacttgtcagggtatgcgatataatcgcccttttcaagacctgactttatctcgcagtcaccgttatcctcgtccttctgacctatctcaacatatctcttttctatctttccgtcctcgttcttagcccaaacgtagttcttcttgccgtccttgcagataaagtcggaatagagccatatgcccgtcttgtttatagaagtgtcctgatcgttgtctatctcgataagaacgtgctgaccgagcataagtccgtcaaagctctcaggcttaacatagaaagcgtagtttgaagactggctcatctcatcgcttgaaccgaagctgtatatatcatcaccagaatttttctgcggacttgtgtcaacagaagttatctcgcccttccaagtggaatcatcaagccttgactttacgataacagaagctccctgcatgatatctttgctgttctgctcgttgaatctgccctttattctgtagtcgccctcttctgttatctgcattataacgtcgccgccgtcctgctgaagcttgtctaccgtcttgacgttcttaacagttccgtcgatagaagcggtgacatatgcgttctttgtggaagcctccagctttttgatctcaacgtttttagcctttatatcatattcgttcttagcattgtcgctctgcaaagaaaggatctgggtcgtgtatgacacagcagcgtcctgatcggcgtttttcttttccttttcaagctcagctatctggctcttattggaagctatctcgttctggagcctctccacctcgagcttagcctgctcaagctgaagatttatagcctcaacgtcatatgtaagaagcttgtcaccctttttaacagagtcaccgttcttaacaagtatctcggccaccgtctttgagctgtcatactttacgtccacagactcctgtgcctcaacaacgcccaagaacgagcgattagaaagcttgaagtccgacgcagtgttaagtgacgataccttctgcacatataccttctgtgagctttttgagcctcccttgccggtctttttccatacgaaaaagcctcccacacatactgtgcagacgataacaagcactattataacagtgcatatcctttttttcgtggtcattgcaatacctccgtttgtgattttttccaaaacagcataaaaaaatccgcctgacagcagccagacggataatacagccccatcttccccataagggtatagcatgagcgtattattctttgttatcttgctgtcctgttgtcttttgttcttatctgtttttatgtatacattataccataaaaagaatacaagtcaataaaaaaagacgttgttttaagaaactcataagaatttccctcatctataaagacgtgcaataacaaaaaaagttgcaaacaaaaaaaatctctctcgtactatcccgcagaggcacctgatgtttttcaacactctcggtgcaaacagcattcaccaaaacagattgtaacaaatcaccccaacaaaaaagggcagcccacgccgccctaatatgtattattttttcttagccataagccctatcattataagcactaccaccgcaccgccaccgatacagccgaaaagcacccaatcggtctcattgttctctgtggcgtttttctgcgccttgatgaccccctgctccgccatagcctccgccgcagagctttccgtcacaatggagctgtcctccacctgagggctgtccgcatacaccgcccacggtattatcatcataagcgacatcacagtcgccccaagccccgacaaaagctttctcgtcctcatataaaaagacctcctccgatacgccatttatcaacagcaaagctttatcacagagctgcttaaagttttcctcattcaattatacacattttccaataaaattacaagcagaattttgtacaaatcatacattagtttacacaacaatatacacaacacctcacgaattacaaacaaatcgctgtaaattttgatttatcagtttattaattgtgtattgtcacaaaaatatatagcaaaattcatcaaaaatagcattgaaaatcttgttcatatgtgatataataacgaatagcaacatactgttcacactttacttgtaaggaggtctttattttggaagaacgtatgcaaattatacaggcagcaggcaacagcaagatacagataggcgttataccgggtcactatgcaactaaccactcgcatatcaattattatgtagatataacatctcttaaaactggttataaaatggcaaaggaagccgcaaaggcattggcagccacctatgtttcaacacatatcgacactatcatatgtcttgaaggcacagagatcatcggtgcctttctcgctgaaagccttggcgaaagcggcataaacagcggtgcagacgtaaatgtagtaacacctgagctaaacgctgtaaatcagatgatattcagagataacactcagaagaagatatggggcaagcaggtgcttctgcttatcgcttccgtttcaactggaaagagcataaacagagcaatggactgtctgaaatactataacggcaaccttgtaggaatagcttccatattctccgctatcaaagagaacaacggcactgctatccacgcccttttcacagaaaaggatctgcctgattacatgacatatacatcatcagaatgcccaatgtgcaaatcaggacagaaggtcgacgctttggtaaacagcttcggctattcaaagatatagcttgtaacttcattctccataaaataacgttaaagggacggaaaatcaaatttccgtccctttttcttttgcaaaaatgtcaaatcaacgggcgaacactgttcgcccctacatacaaacagcgtatttacgtcgtttgtaggaaattgaggcgtcacgcttgtttgagcctttttttcttttgcaaataatgtgtaggggcgacctgaggtcgcccgctttgtttcaccgctatgacgtctactttaaccaaacaaatgtgaaaacttctttttaagtccagccttgtcaaaagcaagtccaagcactatataaagtatcgagcttgcaagcacctgtatgcagtaagcaggagtctgaccgaaagccgagattattgcgctctttgagaaaccgcctgccataaaaattccctcataaagactgtagcataccacgcatataacaagtgcagggataatgccgagaagatttctcacgcagattattttctctgtctttcttgaaaagcaaagggcagttattgcctttataacgatagttccaggaagccataccacaaatcccgaaagtccgtctgcaagacctgctccgatagcgcctgccgccattgcataaggtgtaggaagcattgaagccgcaagataaataagtccgtcacctgcgtgtgtgtagcctgcacccgtaggaatgtgcagccatgccgtaagaacatatatcattgccgcaaaaagacctgtcacacatataagctgaatatgctttgttgaattttttacctgaactgttgtactcattattatcactccaatttaatttctatccttattttatacctccagactatgatttgcaaatgcctcagtttcgcactttttccaccgcagattgtatcttttgcacaatccaaaagtcctatccgaacatcacatttgtgcatcaaagcaataccatatcccacaataattttacaataacatgacaaaatcaattatgcacaaaaccaagctgtcatataggctttcttttgtgctataggtagaagataaaaaggcgtaaaaaaagagtggtcatgggcaagaccactccattctgcaaacagacagcttaaaatcgcacaaaaaaacgcataaaaaaacgggcgagcaaagctcgcccctactgatatcagaaaaaaatcaaataacgtaatcatctacccttgcattttcctgatttacaaggtcctgcaaggtaatgccgtcaacaacaccatttatagcaccgtaaagctttttccataccgtcagcgttgcacagctgtcctgacgtggacaggtattttcttccccctccagacaagccacaggagcaaggcttccctctgtgagccgaagtatcattcccacagtgtattccgcaggcgtttttgccagcttgtatccgccccctgcaccacgaacgctctttacaaagcccgctcttgcaagaatggatattatctgttcaagatacttgtcgctgatgtcttgtctttcagcgatcactttgataggcacatatccgctctgctcatgtaaagcaaggtcaagcataagcctcagtgcatatcttccctttgtggatattttcatcagcgtcagatcctttcataaatcctatagaaaatctatgattaattatatatcatatttgtaaaaatgtcaagcaaaaaccaccgcaaagggcgtatttacaaaaaacttctttttaccctctttatttttctcaaaaagtagtgtataatacaattaagtatacaagttcacagcaaagaaaataaagggaggtcaaaagctatgaaaaacaagcttaaagtaaatatttataaccgtacatacaacctgctttccgaagagtcgcaggagtataccaataaacttgcgttggtgataaattcaaagataaaaggcatgatgaaagctatcccgagcctttccgttcaggacgccgcagtgctgacagcacttgattgtcttgacgagcttagcaaggcaaatcaaaatattgagaatatccgcacccagataaaggactatgttgacgacgcaggcagagcaagaagtcaggctgacgaagctcagaaagaaataagagagcttcaggcaaaagtccatgaccttgaagaacagctcgaagcacgcacagttgtaaaaagagagcctgaggacgaagttataaacgcaaacgagcttctttcgcaggagataaagaacgctatcgaaagacctgtccaccctaatcagcctaacaacggcaattttgtcggcacagtaaattacagacccgagggaggaagccattaatggctcacaaagctgagatacttgccccctgcggttcttttgaaactctcgaagccgcccttagaagcggctgtgacgcagtttatctcgggggagagaaattctccgccagacaaaatgccgccaatttcacagatgaacagctaaaagaagccgtaaggctctgtcacctgcgaggtgtaaaggtctatcaggcgataaacactgttgtctttgacgaacagctcgaagagtgcaaaaaagccgtcaaatttgccgcagaaattggcgttgacggacttatcacccaagacctgacccttgtgaaaatatgccgtgaatgttgccccgaccttgaatatcacgcctccacccaaatgaccatccacagcgaaagcggtgtgaaaatggctaaaaacctcggtttttcaagagccgtcctgtcaagagagcttcccgagcataccataaaagacctcaccaaccttggcatcgaaacagaagtctttgtccacggcgcactttgtatgtccgtgtcaggtcagtgctatatgagtgcgttgataggttcgagaagtgccaacaggggactttgtgctcaggcttgcagactgcctgcacaaggggataagataacaaagggacaggagcgttacgccctctctctgaaagatatgtcctatgttgataagctccaaaggctcgaaaaggacggagtttcctctcttaaaatagagggcagaatgaagcgccccgaatatgttgcggcggcagtgaactgctgtaaaaattctctcgaaaacaagccttatgacctaaaagcccttgaagcggtcttttcccgcggtggctttacagacggctattacaatggcagattaggcagagaaatgttcggcacaaggcagaaagaggacgtttccgccaccgccagaattcttcccgagcttcatgagctttaccgcagatgtgaaaagcgcacaaaagcctttttcaccataaagcttcaggaaagttctcaggcggagctttctctccgtgacagcgagggaaacaccgtgaccgtttacggcgatataccacaaaaagccttgaaaaaggcctgcgacagcgactatgtaaaaaaacagctctccaagcttggggacaccatatatgagttcggaggacttgaagccgccataggcaaagaccttgcctatccagcttccgcacttaatgacctaagacggcaggcggtagaaaagcttgaccagaagcgtatagactttttcacccataccgccgatttcaccgacaaagcacttgccgatcttcctaccctgccaaaagcctatgaacacaaaaagatccgcataatgctctcaaaactctctcagcttgagggtgttgaccttgacaaagcagagcttgtgggcgtgccaatagagatagcgtcagaagcggtaaagatcgtgtcagacaaaaacaagcttatgataataatgccacgcttcacatttgacgagaaagccctatgtgaaaagctttcagccgcaaaagaagcaggcataacaaaaatgctcgccatgaatatcggccactgccttattgcgaatgaccttggttttgagcttcacgcaggctattcattcaatctctgcaactcagccgcattggacgaggtaaaaaaacttggtgcaaaagactgcacagtgtcctttgagcttaaagcgtcgcagatagaaaagttaaagaagcccattgagataggctttgtggcatacggcagacttccccttatgctcacagcaaactgtcctataagaaacgatatgggctgtaaaaactgcaagggcaagctttttgaccgcacaggcagagagtttccggtgagatgtccaaagggcagagattgcgcagagatactaaattccgatattttgtatcttgcagacaagctgacggattttgacaatgccgactatatggagcttcacttctatgaggagaatgcccacagaataaacgaaataataaaagcctacagtggcgaaagaggcgcaaagcccgaaaacgccaccaatggcctatactacagaggagttttataaaatgagattacttataaaaaagcttaaggaaaatgcagttatccctgcaagacaaacagaatttagcgcaggctatgacctttgtgcctgcacagacgcacccgtgaccataaaagcaggtcagaccgagaaaatacacacaggcatatcagccgaggttcagggtgagaaaaactgcgttcttcttatctatgcaagaagctcactcgcatcaaagttcggcattgcccctgcaaactgcgttggcgttgttgattgggactacagaggtgagattatctgcgctctccacaacagttcagacaaggactacaccataaacagtggcgacaggatcgcacagcttgtgataacccctgttttcactcccgaagtagaggaagtaacagagctttccgatacagagcgtggcgcaggcggatttggctcaacaggcaaataagaatggtgaaaactgcatatgaaaatttacaacgttaaaataaagaccatggacagcgacagacgtgttattgaaaacggctgggtggagataacagacggcattatttccgctgtagaaagtggctctcccgaagctgtcacagccgaagacataaacggcaacggcagaacagtttaccctggttttatcgacattcacacacatcttggactatccacaagcggcgtaggcatggagggcgaggatttcaacgaggaatccgaaccatgcacagcacatatccgcattgttgacggcataaacccgatcgactattcctttgagcttgcaagaaaagcaggcgtaacatgctgtcttgtatccccaggctcagcaaaccctgtcgcaggcagtattgcggcagtaaaaacctatggcaagcgaatagataaaatgcttgtaggcacagttggaatgaaattctcaatgggcgaaaaccctaaactcacctattctgacaaagaggacgccccctacacccgaatggcagtggcaggcataataagagaagcacttataaaggcgcagaaatacggtgaagcgatcgagcgtgcaatgggaagcgaggaggatatgcctgagtttgacatgaagtcggaggctctgctccctgttctcagaggcgaagtcaaagcgcattttcactgtcacagggcggacgatattttcaccgccataaggatagcgaaagaatttgagcttgactatgtgcttatacactgcactgacggtcatatcatagctgacgagcttgcagaggaagaagcaagctgtgtgataggtcctgtaatatgcgacaggtgcaagcctgaaatggcaaatcttaccccagcaaacgcaggcatactttcttctcacggcataaaggtagctatctgcaccgaccacgcagaagtgccgatagaatatctgcccttgtcagcggctattgcagtaaaaaacggtcttgactatgaaaagggcattgaagctatcacctgcacagcggcagagatagcaggcatatccgaccgggtaggctctgtaaagacagggcttgacgcagacctcaccctattcagcggtgacccacttgatgtaatggtatcacctgacatggtgatatgcggcggaaaaataatttgatatgataccaatgcggaacggttttcgtttcgcattttttatttgtacttgtgttagccgcactttgttatgcactttacaaaccatataggggctgacgtcctcgacagcccgcacctgtttgcctgctcaatcctgcgataaccccacaaatggcggtaggggcgaacagcgttcgcccgcctttattcgcctacatggtttgtacaaattcaaccccccgcaactcctcgaaacgggacgtcgtatttctgcaaagcagaaattgcgctgctcccctacaggtattctggcaagtttctgcgccgcaaaatcgctccgctctttgcggatatacgttttgctttgggatagaatagcggtgcagattgtgttactccgatatttcttttgtctgatatcttatttctatatgcttttaatactacaatctgcacctagtcggctatcgccgaatgaggctctgcctcatactccgctaggggctttgcccctagaccccacaagccctccagcgccgagcttgagcgtgcgctttatctctcgcttcgctcggtgcttgggggcagctttgctcattcctcattcctaattcctcattcctaattcctaactcctcacttgatcgtttcttttacttaaaatgcacaaaaatgcttgaaaaatatcaaaaaatttgctataatattattgattatatccgtatgcttcaacagcaccgaaagggagtgacttttttgccgaaatttgaaagcggtatggaaaatatggcggatatgttcgtctttgaaacaggcgaccttctggaaaagttggacgagatccttatgcgcaccgagcaggaagactctatctcctccgacgatatcaacgagatattccgtaccatgcacactattaaaggctctgccgccatgatgagtatgcacaatatgtctacccttgcccactcagttgaggatctcttctacattatccgtgaagaccctactgtgaaatatgacaagcctgctctctatgagcttcttttctcagcctccgataaccttaaatcagagcttgacagcatttatgacgacgctccgctcaccgatttttcagagcttgaaaataagatacacgcctttgctgacaccatgaaaggtcagcctgccacagacagttccgatacttcctcagccgataccgacacctatgaggggcttttccctgatgatgaaaaagagggcgttctcacctataaggtcacatattccgaaagctgtgcaatgcctgatatgcgtgcattggtgcttttgcgtgccttaggtaaaatgtgcgaggtaataaaaactttccctgaggatcttgacgccgacaatgcaggggacgagatatccaaaaagggactttacataaagcttatcaccgatgacccgaatggcgttcttgaccttatgaaaaacgccgtgaacgttgacaaagccgagcaggtgaaaaagcctgagcaacctgctaacgcagccaaaaaacctcagcctgcccaaaagtctgctccggaaaagtcagccccaaagcctgctcagcctgcaaatacagtcccaaaaaagcatgccgaaaagcatgagcagtccatgatatccgtcaagctcgataagctcaacagacttcttgatcttgtggctgagatcgttataaccgaaggttctgttatctcctctcccgacctgaaaaaagccgagataaaccttgaccgcttcaataaatcctcccgtgagctgaaaaagcttaccgatgagcttcaggacgttgtaatgtccatacgaatggttcctgtttccacagcatttcagaagatgaaccgtgttgtcagggatatgaaccaaaagcttaaaaagaacgttactcttgtgtttgaagggcaggaaacggaagtggataaatctatcgtagatatcctcaatgacccccttatgcacattgtgagaaacgcagttgaccacggcatagaagaccccgaagtccgtgcaaaagcaggcaagaccgagcctgccacagttactctaagcgcaggctatgactccaacgaagtggtcatctcctgccgtgacaacggcgcaggaatggataccgcaaagcttatggcgaaagccaagaaaaatggtatgctcacgaagcctgagaatgaatataccgacaaagagatattcaattttgttgtggccgcaggcttttccaccaatgataaaataaccgaatattcaggcagaggcgtgggaatggacgttgtaaagaaaaaccttgagaaagtcggcggaaagctctatgttgactccaagtttggcgaaggctctgtctttactataaggataccactttctctgtctatccttgacgttttaagcgttgacgtagggggcgagaatttctctctgcctgtttccgcagtttccgaagctttctcctgcaaagccgaaagctttatcaccgaccccgagggcaacgagtttataatgctccgtgaaaaatgtctgcctcttatcagaatgagcgaccattttgatataccaaatgccgaaaaggacgtaacaaagggcataatgctctgttgtaaagacggtggcaaggaagccgtcctcatggcagacaggataacagttgaccagcaggtggtagtaaaaccgttctcacctctccttgacgcctatcccctcaaggaatcaggcatggcaggctgttcggtcctcggtgacggcagtataaccataatactggatatgaaagaatttctcggcaattatgacttccgaaagggtgaacaaagatgtcagaacaggatataaacgaattttgtcagaagggcggaaaaatactctcctttgtttctgatgaaaaatattacgcctttgaggtaaaagatgtcaccgatataatagggcttctccccgtcacaagactcccgaaaacaccaaagttcataaaaggcgttataaatctgcgaggaaaagccgttccagtgatagatctccgcctgcgccttggactgcccgaaggggagtatgacaacagaagcagtaccatagtgatagaagtcggctcaaatcaggctggcataatatgcgataaggtcttggacgttgaggatatcctcccccagcagaccgccgtgtcgcctgtaaaaaacagccttgtaaaatgctttataaacgcaaacaacaaaaacatatccctgcttgaccctgatattctggtcagaacaaacaggtaaaacataataacaaggaggaagaggaatgctgtcacgtcttgagatctctcagtcagactttgacgagcttactgcattcataaaagaaaaatacggccttgaccttgcaaggaaaaagtctatcgttgaaagcaggctgagcaactatgtattggactgcggcttcaacagcttttcagaatatctcagcgccgtctacagcgatgaaacaggcagagaaactgccaaccttataaaccgccttactaccaaccatacatatttcatgcgtgaaacggaccatttccaacacttcatggagaaatttctcccctatgccgaaaaaaacgtcctcgatcatgatatgcgtatatggagtgcaggctgctcattcggcaacgagccatataatcttgccatgtgtatggacgattatttcggctttgatcgccgtttctgggacttgaaaatacttgccacggatatctcccttaacgcactgcgttctgccaaaaacggcatttataccagtatgtccataaagaatatccccgaagattggcgtaaaaaatattttcacccatattcaaacacaaaggatctctggcaggtcagcgatacaataaggcagaatgttgagtttcgttaccacaatcttatggatgatttcactttcaaaaagaaattcgaccttatcgtctgccgtaacgtcatgatatattttgacgacgatacaaaagccgagatatgcagaaaattctatgacgcaatggaggagggcggctatttctatatcggtcacgcagaatcagtgccgaagtatatgccttttgtaaaagttgcccctgcaatataccgcaagctgggaggggataaaaaatgacgcctctctttcttgtgataaccgaaaacaaagcctttgcacagctttgcagaaaggcccttacaaacgcaggcttccaaagctcaaagcttgcctcagcctgccttagcaacggcagaaaaagcgtcactgccctttctcccgactatgttcttctcgacggtgattgccaagacaatatggacgactacatcataagccttgccccacgatattctgtgcctataatctatcttaccattcagcataacaataaatatcccatgatgcaggcaggtgccatagacgtcgtatataaacctgacggcactccgtctgataacgagcgttttcagaaacgctttgccgaaagcatacagcgccttgaaaaagcaagagctaattctgttgtgcatatacctgccataaatacctccagaataatagccataggcggttcaacaggctcaacggaagccctgaaagctatccttaaagacctccgccacgacctgcctcctatagtggcagtcctgcatatgcctgcaggctatacaaggatatatgccgaacagctatgcactgagactggtcacaacgttgtggaagccaaaagcggtctgtatctcagccaaggcatggtggtaatagcgcagggcggtcagcaccttagattgttcaaggataaaaaaggctattttgtcacctctgaagcaggtgtaaaggtttcaggtcactgtccgtcagttgacgtgctttttgactctgtggcatacagcgcaaagcgtaacgctataggcgttatcctcaccggcatgggctgtgacggtgcaaagggtatgctcaacatgaagaaaatgggagcatataatatcggacaggacgcagaaagctccatagtctatggtatgcccaaagccgcatatgaaaatggctcagtgtcaaagcagtgtccccttgacaagatagcacaggagatacattatcgcatcgacagcggcttatgataaaatataacaaggagggatagctgtggaaaacagcagatatctcattttcacctcagcagggcgaagcttttcactgccctttgaggatataaaaataatcatagcggcgcagaccccaactcccgtgcctgattttcccgattatgtgccgggaacagtggtgaacgagggtgaggtagtgcctgtcatagacctgcgcagacgtttccactatgagccaaaagagatctccgacagagattgcataataatcacaatgggcgaagaagtttccgtagggcttttgtgcgacagcgtaacaggcttcacggatatccccgaagataagctgtgtaaagccccaaacgtcaacgaagaagcctgcgcagattttctaaaaggagaatttcttctggagggcaagccatgctatgtccttgacagcgaaaaagtaataaagctcagcgaccgtgaaaaggtagcaaatacagagcgaaaggataaataaaaatgagagagataaacgtttcagaagtagaagaacttgtaagagatctgtgcataaaagccaatctgtatcttcccgaggatatggaaagctgtatagagtgcaacgccaggaaagagcagtccccagtgggaaagaacgtctttgctgacatccttgacaatatgagagtagcaagagaagaaactatccctatatgtcaggatacaggcatggcagttatcttcatgaccataggacaggacgtgcattttgtaggcggttcgctgaacgaggctataaaccgaggcgtagcaagaggctatacagagggcagactgcgctgttccatagtatccgacccattggaaagagtaaacacaggggataatacaccgcctgttgtgcatcttaaaatagcagagggcgaaaaggtagaaataatggtggcaccaaagggctttggcagcgaaaatatgtcacagcttaaaatgatgaccccgtcagttaccgaggacgagatagtggattgggtagtgtcagtgtgtgcaaaagcaggttctaacccatgtccgccaatagtcataggcgtaggcataggcggcgactttgagaagtgcgcataccttgcaaagaaagcactgtgcagaagcgtatcaaagagaaatccaaaggaacgttatgcaaagcttgaagcgaaaatgctggagaagataaacctccttggcataggaccacaaggctttggcggcacacagacctgccttgcagtaaatatagaagaagcaccgacccatatcgcaggcctgccggtgtcagtgaacgtaggctgtcatgtgacaagacacgcaagcggagagatataagggcataatgtggaggcgaacagtgttcacccgcctttgttcgtttgaatgacttcacgaaaaaacaaaactcactacttcgataacgggacgccgagggcgtcgtcccctacatcttcatcgtgccgcaaactcgctccgctcggtgttggatatcccactctggtcagctttgccaattcctcactcctcattcctcattcctacctcttttctccacaacaccaacaccccgataacattcggcactgccataagtccattgaaaatatccgacactccccacacaagctccatgctccacatcgttccaatgcacccacaagctatcgccatgatcctatagatcatatcacttcgagggaaaaggtatctccaagccctctcccctatgaaaaaccaccctgccactgtcgctaatgcaaaaagtatcagcgaacctgacatgaaatacttccccgctccaccaagagcagcattgtaagccctcactgccatgtcctcccccgtgaggtcagtgccgcttattattatcaccacagccgtcagagtgcatatgacaaaggtatctataaaaacctcagccattgcccatgttccctgcaattcaggcgactttatcctgcacgagctgtgtactgccaccgttgagcctaagcctgcttcgtttgaaaacgctccacgctttaacccctccaccatggaaaatattatcgtccctgccaccgagcctgttatgcaggctgtggggcaaaaggcgttttttactatcattgctatcgctcctgcggcttttaatgggtgaaatattatcactcccaaactgccgcctatgaaaaacaccgccattatcggcacaagcttttcgcaaagacaagctgctgagttttttcccacagctactaaaaatacgaaaataagcaccacaagtgcaaatatatatgagggtatcccaaacccctctcgggcagccgcagccgccgaacccgtctgcaccatgttgcccattccaagggacgcacccaccgtaaaaactgcaaacaaaacagccgtgagcttcgttctgcctatcttttcgagataagacgccgcaccgcaaagctttccgtcagagcatctcactcccagatagttttcgcagtaagcaagccccattccgaaaaatgcagacacccacatccagaataccgagcctgcgccccctatcctgatacattcccccacgcccaccactgagcctgttcctacagttgccgcaagcgccgtggaaaatgtctgaaactgcgagagagaatcgctttcggagctttcttttttaaacagcgtaaaaaccgttttcttcattatttttaaaatgtgtatctgtggaaatccaagctttatgctcagatatattccgcctccaagcaaaagtaccaaaagcggaacgccccacaaaaacgaatttatcttgtttattatagccgtaagttccatagctttcccccgaaaacacttttttcgtgcaaataattgccttataaatgatatgatataaaagggagattaattcttgaaaactgagataaccatacatacaaatacgcaaaaaaacaaacagcgaggtgaacgtcctcaaatgcacagatataagccctcaaaaataccgctttttatcttctgggctatccttgcggtaatattgtttcttatccgctatgcggtcaatctcatagaaaaacttatcccgttttccgtgaattatatccttatgccaatgtggataatcgccgcacttttttgcctgctggtgcttcccttttatttcatcagatcttatttcaccgtcagttcaaaagaagtcaccgcctttacagggcttttctttaccatgcggcattttatgcccacctcggcaataaaatccgtcacaactatcataaccccactgggcagtataacaggacttaacttcgttgtcttaaacgccttgggcgcaagacttcttataccttttatgagccgccgtgatgccatggaaatatccgccatagtaaacagctccatacgaaacagagaacgcaaagaagactagataccatagacaggaaaggtttaaatgagccgcagagaaactatcaaagaaaaaagaagctggctgaagaatttcttcgcccaccgccagcaccctataatgatattatcttatacaactaaatatatgtggcttcttgctatccctcttgccaagtatctcatagccgcaaaattcaactttcaaagctggtttcaggcacattgggtcgatatcctcactatcacatttatcttcggctacgctttcctgcgctggatatttgtctactatgagcttgaagaagattgcatcatagcccacacaggctatttcggcataacacgaacaaaggtctattttgccgagataagctcattgtcactgtcacaaggatatatttccagacttatacattcctgtgccgtatacatagacaccgatgcaaaatcactgcaaaatgcagatataatgctcacccttacaaaaaaacgagcctttgagctttatcattttgccactgccaaatgcaaaaacaaacctaaatatgtctacaactcaaagaaaagcctgctcgttatattctctcttatcttttcatcaactctgtcaggcatgataatcgtgctgtcggtactttacgaagcatataggatagtaggaagagaggcggaggaacaaatactccgcagagtgaatacggagatagcaaaagttccggtgcttgcagaagtgcctgaatatatccttatcgcaggcggtgtgctggcaggaggctggctcatatcatttctgtctaatcttatgcgccactggaatttttcctgcacacgctgtgccgaccttttcataatcagaagcgggataggcacaagacgcagacacgtcctctatagagatagagtaaactatatcgacctaagacaatcattgcttatgaagatatgcaaaataacctctgtgtctgcccactgtacaggatacggaaaaagacggcttgaaatatcagcacttataccgataacgacaaacggacaggttgaccgctccctgaagatgctcatgccgaaaataccgccggtgaaaagcgacatctccacaggaaaagccgaccttggcagatttataacgataccgctcatatgcacgtttatacccatcatatcaggaagaggagcgctttacttttttcctaactggaaaagagaaataaccatacttgttatactaactaccataccattgctgtggctcgtgatagtcaaggcggcggcagcgttcacaacatcaataggctttgaaaacgggtattgtacattgtcatattgtaaatggtatagctttcataaatcaatagccgcacttgacagagtgtcaatggtaacggtcatgcaaaatccgtttcagaagataagccatacttgtgccgtgagagtttataccaattcggagagtacagactatcatactgtaaagggacttaattatgataaggtcataaaattgttgaacaggaatgggtatgcggtgtgaaaaaaatgaggaatgaggagtgaggaatgaggaattagcatagcagaccaaagttaccccctcagcacctacacagtttgataaacaaatatcatcagggacgaccacctcgtccccgatttttttattcaaaaaattttttcactgcaacatttcagtgaaaaatatacacttatattatgacggacgacaggggggatcagattggacaaaaagggaagaaaaaagctcgcagaacttgcggtgaacggcgatacggacgccttttctaagctctatggagagatatataaggagctttattattacgccctcgctaacctgcaaaatgccgaggacgccgccgatgcagtgcaggacgctgtgctggacggctatatgagcatctcctcgctgcggaaaagcgaagctttcgatagctggatgttcaaaattctggtcgccaagatcaaacaaaaacaaaaggaatacgcccaaagacgctctaacctcgattatattaatgaaagcgacgcaataatcaaggacgaaaacggattcgagcggtgcgagatcttagaagagtttgctgatctcagtgaagcggaaagactctgtatatcacttcactgtatagcaggctacaaaggcagggagataatggagataacaggtattaaagatacgacagtccgttcccatatatccagaggtaaagcaaaaatacgcagtaagctgtttggaaaggaggtgacatgatgagaaatttaagaaaacgcagaaagcttatcagacaaatggaacaggcaaacaaaattcctgataagctcatgccccaggaaataaaagatatgctggacgtggcaggcttcagacccgttatcgaaaatactccaaatagtgcagagataaaaataaacagcggcagaagcaacgccctgagatgtctggctgtggtggcggctttcgtccttgtggtaggcggatttgctgtgcttaggttcagcaatacccagttcgtcaaaaaataccccaattccgcttcttcacagtccgctgacgcctcaggtcttgacggcctccgtggaacgacctataagggtctttacaactatataaatagcaacagcaaaaacatagaggactttatagttgacaatagctatatattcaaaaatatcgacgctttgtctgttgatgacgatgactatgtggctttgtataagcaggcgctcagagatcaccagctcacccctaaccccgctgatatacagctcactcgctcaggcgtggatatcacccccacaaacagcatagatgagctggaaacaaacataacctacggaaatgcccatttcattactgacaatggcggtatcgacgtttatattacccaaaacggaaatatcacaaagtcagaacaggatatctttgcggaaaccttccttaaaaaaggtcttgtcgacattgccgaatacgaacagtacggctgtaagttcgctccaagcgttgttgcaatgtatttggataataacgagctttacgctttcttcgactttatcttacccgtgaaggcaggaaagaaaaacctcgatatcgaatactgcggaatgtgcgtgtttgacgtgagcgaccctgagaatatcaagctcataagcgagtttgaacagcccggcgtgctggagggcataagaaaagttgacggaaaatttttcatcgtgtcacgctacacccgagcagcttcactgctattagatgaccaaaagcccgaggatatcacacccgtgcgatacatcaatggtgaaaaacagctttttgaagaaagtgaaatgtatatcacagccagagataatacaccgtccatgatcttgctttcgtcctttgacggaaaaaatcaaggctcatacatggcttcaaagcttatcgcctgcggtgaaagcagcatcttaatgggaacagacaacatttatattttaagagcatatggctttgaaaaaacagacgatgattacagcacagtgccaacaagagcgcttattacaagaataaactacggtggcggcgacatggagcttaacaaaacccagaccgtcacaggcgcagacgccgagcatataagccacgccatatcaggaaatgagtataacggcagattgtcgctgttctcaaacgactctgcaaacatttacgatatcagcacacacaatacctattatagcggcattaatatctgcacgctgtggctttttgacaatgaccttggcgtccctgtgaaaaaggccctcacatacgaggacactgatttcgagagtgcaaggtatagcacattctatcattccatgctgtatgtttacagagaatattcatttgcatacagcatggatgacacttatcaggcagcgaacaatatccagcttgatgaagtatatgatttctcagaccctaacaagataactcaggtgacccctgatgataaaatgatagcagtgtcaacggcaaacaacttcttccattatggtacgaactataacgatgatatcgccgtgcgcaccgacagcacgtcattcgactctttcagcgtaaaaatactcgacaagagcaaaacagaaaagcaagaaacccttttatacggctcaagcggcaagggcatagcgaatgctaacggcacagtggatcaggtgcaggtctatgacacagaggtagtaaagaaattcaacttcttcaagactatacaggaatacaaatatcacgagaaagaaatgggaacaacagttgacggaaaggatatgacccaaagatccgccagcactgttttttcaaattcaataataacagacaacgaaaacggatatatagccataccattctatgacataaccacagtaggcaagaccgatgacggcgacaattgggaatatacctattatgaaaaaactattgaaaaaattctggtaatgaaatataacatagaaaccaaaactttcagcgagtatggaactataaagcttgacgaatatacagattattttgacgattatttcgatcatgctagtgaagacgagatcacggctctggtcaacgacaatgaccaaagagactgttaccgcagtgcattcgttcaggacggatatatttatatcttctccgacagacagatacgctcatacagctatgccgatctctcaaaacccactgacagtgtagacatagttaaatagcattacaccaaatttcccttttagcacccgacggataaatttctgtcgggcgtttttttgctaaaacgttttcgttattgcacacaaataaaaccaccgcaaattgtatagtatgtacaataaatgttcacagtaatataaccaattgaaactctgtttgtgctaaaataatatggttttaggaataaatataagacataaataggagaaagaattatgaaagacctaacgaaaggaaatatcacaaagctgatattgatgttttccctgccccttctgcttggcaacatttttcagcttttttataatcttgccgacacccgtatcgtgggtcagaccttaggcaaaaacgccatagccgcccttggcgcaacttcatcagtgaacaccgtcataataggctttctgaacggtcttacaaacggctttgcccttgtgacagcacgctttttcggcgcaaaggagtttgaccgcctgaaaaagtccgtcgcccacgcccttaccctaggtatcgcaacggcaatagccctcaccgccctcagccttgcctttatcgacccactgctgagagcgttgaacacgcctgacaacatctttaagcaggcaaaaacctacatagtcataatccttgcaggaatgataatatcaatgttctataacatctgcgcaggtatcctccgtgcagtgggtgatacagtttccccgcttatcttccttataatctcaactatcgctaatatcgggcttgaccttctctttatccttggctttaaaatgggtgttgagggtgcggcatatgccacccttatcgcacagggtatctcagttgtgctttgtgtaatatacatcattaaaaaacacaaatttcttatcccatcaaaaagcgacttccgctttaacttcaagctcgcaggagatatgtatgcaacaggagtttcaatgggacttatgatatctctcgttggtatcggcactgttataatgcagggcgcaataaatatattcggcactgacataatagtcgcccacaccaccgcaagaaaaatatctgagatctatatgctccctatatcagttttcggtgcagcttcagcaaccttttcaagccagaactacggtgcaggcaggatagacagagtaaaagagggcgtgaaaaaagcgaccctcataacatggggctggtctgttatcgtaatagccgcaacatggcttttcacaccatttttcgcacaccttatcacaggtatcagcgaccctgagatagtgggtacagtggaaaaatacatgaaaataaacacagcattttaccttatcctcggcatagtaatagttttcagaaacgcacttcagggcgtaggagataagataacacctatagcttcaagcataatagagcttttgggcaagttcgcagtggcaatgatactcgccccacgcatgggatatttcggcatcatgataagcgaaccccttgtgtgggcaggcatggcagtgatgcttggcataggctttgccgcaaataagaccttccgtaaagagaatatccccaatacggcaaaacaaatgtaaataatttgttaactcacataaaacagatagctccctatgtagaaaaaagtaagccactattgattttatcaaagaaacgtgttataattagtaaaaacatacaatccacaaaaatgtggctaacataccatagacgtgaaagggggaaatgcctgcaaacggcaggcatgacagaaaaaatgctttcaaaaatattgtcaaaagaggaatgtgcaaagtgcaggatatgctgctgctttgacagctatgatatatgggaaacaccgtatatctcacaaacgcttgcaagcaagatattgcaggaatatacccctaagcaggaatttataaagaaggaaaaccatttcttgttcaaaatggataaggaacagaatgcagacctgtattattgcccaatgctggataacgagaagggctgtatattaggcgacgacaaaccgttcgactgcaggatatggccgctgagagtaatggcactgaatgaaactaaagtaataacattgtcgccggtctgtcctactatgaatgaaaagtccataaaggagctgacgaaaacggctaacgaactggcagatcagatatttgagtatgcagacgaaaatccggaagccgtgaaaccgtatcttgacggctatccaatattggtggtagagggcaaaaagtataaggataccctcgtataaaaagtaaaaatccaaaaacaaagcggtgtcggagtgaaaaactctgcaccgctttttctatcccatagcataaagtaaaatccgcaaagaacaccagcgattttgcgacgaaaaaaatcgacacaaatgtgtaggggctggcgcccccgacagcccgcacctgcttgctgctcaatcatgcggtatatgcacaatgaactgcataatatttcccagcacggcacgtctacataaattcgtgataaaaccaaaccttatcgctctcagaacgggacgtcgtattttttgcaaagcagaaattgcgccgctcccctacagtgagtttgtgcggttatcatgaattgcaagcaacttacctcaaaaacaaataataaataagcccgtaaagcacactagccaaagtgccgtaaagaataacaggtccgctgataatgaagatcttcgccccaagcccaagaatatatccctccgtcttgaactcaagagcaggcgccgccacagagtttgcaaaacctgttatgggtacaagcgtgcctgcacctgcgtgcttcgctatgcggtcataccagccaagacctgtgagaagagccgataaaaatatcaaagttattgataccgacattgaggcgttattcttggataaacctaaatataaatacatatccataagcgattgcccaataacgcatataagtccgccaaataaaaacgccttcggtatggtcacccaccacttagtcccctttgacgcctctttgtacatctcgctgtattgtgccttgcttaaatttatatccattttgttctcgctcctttttgtttctgactgccagtattgtgccacataaagctcaggttattcatattttaagtgcacgattttcgcatgatttgttcaatatgttgctgtaaggttaatatttttatatagtttcaacaagttttgtataatgtaaacgatttatcatagggaaatttgttaaaatagtatcttgaaaaaaatgcgaaaattttgtatcatattcattagagatattctatcttaggggcagtgtaactgccattatttttcaggaggttattataatgaaagctaaaaaaattcttgctgctgtcacagctctttctctgacaacagtagtattcgcatcatgcggcgattcagctgattcatcaagcacacctgccgcaacaacaactacagctgctactacaactacagctgcaacaactacaacagctgctacagaggattctgctgcaacaggcggcggagcaggcgactctgctgtagcagcagacagcacagctgactcaaagacagagggcggtgactctgattacacacctgtaaagacattcaagggctatgacgcattccttatgttcggtgacagccagtggctctggggcaactgggaaggtcaggaagttgcattcgataaagctaagatcaagtatggcaacatcgaggacaacaacaactgctacagaatcgagatctacaacgattacggcgatacagctaaggattctcctatcgacaaggacaatcttgcatttgaggacagccttgagattacattctctatcgagggtctttctgaataatttttcatgaaaactaagagcagaccgcaatatggtctgctcttttgtatttttatacatctttccagtgacaaaaagtgtgacagattttttaaaatagctgtcacacttttatgttgacatgaaactaatgggaatatataataatagtattatagtaattctataatatcatcacatattttattaatcccctaagaaaaaagctgtggtaccctttcttaccacagcttttttctttttttatttattctgactgtctgccaccagaccgccgttatccgccataagattgaattttatctcaaactctttctcatcaccgctgtccgtcttgcgatataccttgcagacgacttcatctcctgcctgctttcctgaaaacagcgacgctatatccacctctcctgcggtggactttccgtctatttccgtgatgatatcgccctccgcaaggtctgtgttggcaacatcacaatcaggatttatggacacaatacaaatacccggctttatgccgtatatctcagcagtggtgtcgctgacagcataataagtcacacctatctttactctgcctgccacatagcccttttccataagctcctcaataacaggcttcgcctcgtctatggataccgcaaagcctatgccctcataatcgcttgaagcaagcttagatgaggttatccctatgacttgcccccacatattgaacagcgctccacctgagttaccggggtttatggctgcgtctatctgtatgcagttcattattattgacgagttttcaagccttatcctgcggttcacacctgatacgataccctttgtcacagtgccgtaatagccagccggtgagccgatagcgactacctcttcccctgcattcacctgagttgaatcaccgaactcagccgcctgcaagccctgcgcctgtatctttatcaccgctatatccgtggcagggtcctgccccaccaccttggcttcatactccgaattgtcgcttagaacaacttttatgcccgactccgccgcatttacaacatgagcgtttgtgacgatatatccgtcggcagacattataacaccgctgccctgacctgccgcaacatatccacccgaatttttgtaaacctctatagataccacagcgggagaaaacccctttgcgataccctcggcagtgtatcttccgtcagcctgataaaattcatcgtcaagcttcggcttgtcagccacaggaagcgtaaagcttatcttttcgtcccctgtaacaagatttctcacccagccgcttccccttatggaggttattgatatggctattccgatgcctacaaaaagcaccataaagcacagccttgcaactgcatggcgcatacgctctctgtggcggcttctttttcttgccgaatcaacagccgaccaaaaatcttcgtccaccttgtgagcggctaccgctccctcaggcagcttgtaatgcccggtttcttgggctgtatcttcattttcatcatgcagacaaggctgctcttcaaactgctccatatgagcctcctagtcgccctccgccttgttaggcagcgtgaacacaaattccgtatactcgttcttaacgcttcgtaccattatcttgcccccgtggagctttatgatagaacgtacgatattaagtcccaatccaacgcccgtcttgtcaagtcctcttgacttatcggtcttataaaatctgtcgaacaccagcggaagctcgtcctcagacagaccctcaccgctgtttctgatagaaatgcttgtcatattgccctcaggctcaaagtgaaactctatataaccgcccttgtcaacgaactttatggcgttctctatcaagttatacatgacctgatgcacaaggtcattatccgcataaaggatcactctgtcaacgtcaagaccccttatctctatctgcttttcctcaagccttggctcaaaagtcacaagggtatcgactatcggctcaagcacagagaaatactgcaaattcggtttaagctcgcctgcctcgatctttgcaagattgagcatacttcttacgagccttgcaagtctgtgtacctcagaggaaattatcttaagataatatctctcctgctcctttggtatggtgccgtcaagcagaccgtccacaaaaccgcctatagacgtcataggcgttctaagctcatgagaaacgttcgcaaggaagctatttcgcatggtgtcatagcttttcaagctggcagccatatcgttgaaagcgttgctgagctgttcaagctccgaggtagaataatcaggcagggtgacagaaaaatctcctgctcctatcttctttgacacctccgctatctcttttataggctctgtaagcttcagcgtcatgaaatataccagaaacattactatgaccagaactattatagcggaaactataaatatttccattatgttgtaggtatagtcgtcttgagccgcctttgaactgaatgcaagcacataatattcaggtccattcgctttgaacgacttacctatcacatgatatatagcatcgaaagctcctccgagatccgaataaacatactcgcaattgtcagaaaaagcttcaagctcatggacagatatattatgagggctgcacacaggatccttactggagttcacaagcactgctcccgtagagtcgcacaagataaaatcagcgttgcacgccattgaatactgcatcatctcatctgtcaccgactttttccagtcggcaggctgagccagcatttcttcctgcgtatataaagcaagagccttggtgtttttctccaacaggctctttttttcgtcaataaaataccttgaagaaaccagcagtaataccgttcctaagcacacaaagcttataagtattactgctgaacaaattacaaagtatttaaagaatatgcttttacgattactcatgcggtgtttcagcgacttcaaacttgtatcctacgccccatacagttttaagtgcccacttgtcagaaacgccctcaagcttctcacgcagacgcttaacgtgaacgtcgatagttctcgaatcgccgtaatattcaaagccccatacctcatcaaggagctgatctcttgtataaactctgttcggatttgaagcaaggtggaacagaagctcaagctcctttggcggtgtatcaaacacctgaccgtttactctcagctcatatcttgtcatattaactgaaagcttgtcatacttgacttcctttatctcagcttcgcctgatgactgacctactcttctgtaaacagcctttattcttgcgataacttcctttgtatcgaaaggctttacgatatagtcgtcagctccaagctccagaccaagcaccttatcaaatgtttctacctttgcggttatcatgatgataggcacgttggacttctttcttatctcacggcatacctgccagccgtctataccaggcagcataatgtcaagcagtatgatgtcaggcttaagagcgttgaattttaccactgcttcctcaccgtcatgtgcaagtattactccatagccctccttttcaaggtaaagcctaagcagctcgcagatgttcttatcatcgtctactaccaatactcgtccaagcgacatatttcatcttcctttcgtttatttacttcttttcatgcccattatttcaaattttcacacttctgaaaatttgaacaaaagacaataattattcaaattgatataagtattataacaaattcacaaacccattgtgtgaatatttatttaattttttattaaatatcataatttgctttaattttaagcggacgtctgcaacaatatgtatatatttaatttaattaatcaatacttttggattttacttacaaaagcatcgaggatattatttgatttttgtaaactatatcataaaatattacccattccatacaaacagcctccgcaggataactacggaggctgtaaattatatcagatattagtcatgggagcttattagtacataccgcccattccgcctgcacctgctgctgcggctgccatagcagcgtcagcctgtgggtccttcttgtctgcaacaaggctctcagttgtgagcaccattgaagcaacagaagctgcgttctggagagctgaacgtgtaaccttagtagggtcaacgatacctgcaggtatcatgtcaacatactcagaagtataagcgttgaaaccatagccgacctttcttgaacggattatcttgtctatgataacgctgccctcaagacctgcgttcactgcgatctgtctaactggttcttcaagagccttgtaaacgatctgagcgcctgtcttttcgtcaccgctaagcttgtcaacgagcttcttaactgctggcatagcgttgataagagctgttccgccgcctgctacgataccctcttcaacagctgcctttgtagctgccagagcgtcctcgattctcagcttcttctctttcatttctacctcagttgcagcaccgaccttgataacagctacgccacctgaaagcttagcaagtctttcctgaagcttttctctgtcgaaatcagaagttgtgttctcgatctgtgacttgatctgaccaactcttgccttgatatcgtcgctgttgcctgcgccgtcaacgatgatagtgttctctttctgaacgactacctgtcttgctctgcccagctgctccatagttgtttcgctgagttcaagaccaagttcagatgaaattacctgaccgcctgtgaggatagctatatcctggagcatttcctttcttctgtcgccaaagccaggagcctttacagctacgcaagtgaaagtacctctcagcttgtttacgataagagttgaaagagcctcgccctcaacgtcctcggcgatgataagaagcttcttgccagcctttacgatctgctcgagaagtggaagaatttcctgaatgttagagatcttcttgtctgtgataagaatgtaagcgtcatcaaggacagcctccattttatctgtatctgttaccatgtaaggtgcgatatatcctctgtcgaactgcataccttcaacgacttcgctgtaagtttcagcagtctttgactcctcaagagtgataacgccgtcagcagttaccttttccatagcctcagcgataagcttaccgatattctcatcagcggcagaaacagcacctactctagctatctcatcagagccttctatcttctttgagttagcgacgatagtttcaacagcagtatctacagcctgatccatacctttcttaagtaccattggattagcacctgctgcgatattcttcataccctctctaacaagagcctgagcaagcaatgtagctgttgttgtaccgtcaccggcagcgtcgttagtcttagtagcgacttcctttacaagctgtgcacccatgttctcgaatgggtcgtcaagctcgatctccttagctatagtaacaccgtcgtttgtgataagaggagcaccatacttcttatcaagaactacatttctgcccttaggtcccagtgttatcttaacagtgtttgcgagcttgtcgataccgctctgcaaagcttttcttgcgtcttcgccaaaaattatatccttagccattgtaaattacctccgtttatatactatttaaaatgcagtgaaattagtcaacaactgcgagaatgtcgtccattttaacgataatgaactcttcaccgtccagcttaacattagtaccgctgtacttagagataagcaccttgtcgcccttattaacgcccatagtaacgtcctttttaccagggcccacagctattacctctgcgacctcaggcttttccttagctgagcctgtgagaatgataccgctctttgtggtttcctcagcctctgtcatcttaactacaactctgtcctgcaatggtttgatcgccatgataagttcctccttttataataccaattataagctttgtaaaatattgtgagctactgtatttttagtcttttcagcactctcaccgtttgattgttagcactcagtctttctgagtgctaattatattttagcacctttttcgcaaaattcaagtcatttaaggtcatttatgtgatttttgtaggattgcacaatatctatcaggataaaaattggtttcagaagcatattgtacaatttattaaggggtattgcaggtctgaaatcagattttcgggtggggataaatgtattcaatggaggtatgcgtatcaacagtatccataattgtaggggacgacgccctcggcgtcccgatattcctcaccaattgaattaacggagattatcacaacaatgtcaccccgaataattcaacatcgaagataccaaaaccacggcgttacctctccgaacgggacgcccatttctgtgaaacagaaattgcgtcgctcccatacaagtgcggtgggcaagtttttcggttgccaaaccgtgttgtaattgtgggcttgttccttcgacgggcgaacggtgttcgcccctacagatttattgccgtgggtttatccgtattttatattcaattttcaagcttcaaacaaggtgcaggaagtgcttttctgtgcgatcagaacctctcatcgtgttcacctaactcacgttgacaaaatgtttcctcatacactgctaccttgcaggatattcgatttgggataatacccttatacttatcccgaaaaaggggtaatttgttgcataaaaaatgcaacaattgcagaaatgttgccaaattaaaagataaatcatttgtttgcacaagtttagttgtcaaaatttgtgcagttattacagaaaattattacagaaatattgatgaaaatacgagaaaaaatagtgtgtctatgcagttatcccacaattttaatatatatcaatatatgcaattttgataaaaaacagttgacaaacgggtgcgatttggtgtattattgtattgtaatcgtttaatcgttaagatcaaacaataatatattcggaggtcaaaattatggcagagtattttaaggatattccaaagatcaagtatgagggcgtaaactcaactaatcccctctcttttaagtattataacccagatgaggttgtaatgggcaagactatgagagaacagctcaagttcgctctttcatggtggcacacaatgggcggcgacggcactgatatgttcggctgcggcactactgacaagacttggggcgaggctgctcctgaggcaagagctaagaagaaggtcgatgttgctttcgagataatggacaagctttctatcgactatttctgcttccatgaccgtgacctttctcctgagtacggtgatctcggcaccactaacgcaaagcttgctgaggtagttgactacatagctgaaaaaatggctgctgaccctactaagaagcttctttggggtactgctaagtgcttcgatcacccaagatatatgcatggtgcaggcacatcaccttctgctgatgttttcgcttatgcggctgctcagatcaagaacgctgttgacgctactatcaagcttggcggtaagggctacgttttctggggcggaagagaaggatatgagactcttctgaacacaaacatgggtctggagcttgacaacatggcaagacttatgaagatgacagttgattacgctcgttcaaagggctacactggtgatttctacatcgagccaaagccaaaggagcctacaaagcatcagtatgatttcgatacagctacagttcttggattcctgagaaaatatggtcttgacaaggacttcaaaatgaacatcgaggctaaccacgctacacttgcccagcacacattccagcatgagctgagagttgcaagagataacggtgtattcggttctatcgacgctaaccagggcgacccactgctcggttgggatacagaccagttccctacaaacgcttatgacgctacactttgtatgtacgaagttctcaaggcaggcggcttcacaaacggcggtctgaactttgacgctaaggcaagaagaggctcatacacaatggaagacattttcctgagctacattgcaggtatggacacatttgcacttggtcttaaggctgctgcaaagatcattgaggacggcagacttgacaagttcgttgatgacagatatgcaagctggacaacaggcattggtgcagacatcattgcaggtaaggctgacatggagagccttgagaagtatgcagttgagaagggcgaagttactgactcactttcaagcggcagacaggaatatctggagagcgtactcaatcagatcatgttcaatctttaagcaggggcgtgcccctgcacccatatccgctatcattcgtggtagcggattttttgtacaaaaaaagagcggctctcagcgaaccgccctctttgattatcattatttctcttttcttgagagttcctgcaactcctgttcatactgtgagaagccctcaacagacttcataagctcgtcctcaacgtgttcttcatgattatccttaaacacaaacttcaggaataccggtgtgattatcgttgttgcaaccaccatgatgatgataggtgcgaaaacctcgtcgcccataagtccaagcttctgtcctttagccgctactataagtgcgacctcgcctcgtgagatcatacccattgctatctgcaagctttcctgatttgtatacttacaaacctttgcgcctagtccgcagcctattatctttgtgactattgccacagcaaggagcaaaactgtaaacaacaccattttgccgttcatgttgataccgttcattgtaagaccaatgcttgcaaagaacactggtgaaaggaacatatacgaaagtgtttcaaatctgtttgagatatactttacgtccttttcgcttgaaattgcaagacctgcaacaaatgcgcctgtgatatctgctacgccgaaaagctctgctacatacgccatgagcaggcagaaaacgaaggaaatgataacgtgacgtctaaggtcttttttatctctttttctccactttgtgaacacaacatggtaaacgactgtacagccgatagccactgcaaagaacgctactatcttaataagaactgttgcaacgtgaacgcttgtatctgcaaggcttgtgataagggtcaatgcgatgataccaaggatatcgtctatgatagccgcaccgagaatggcattacctgctcttgtagagagtttgccaagctctttcagagtttctactgtgatagaaactgatgttgcagtaagcacaacgcctatgaagaggtgctgcaggaatggtgagcaggagagcttatcgcccttgcctacgcccattgcagcggcaagtccaagtccgccgaacattggtacgataacgccaagaagagcgattatgaatgacgctttaccagtctttttaagctccttaacgtctgttgtaagtcctgcagtgaacatcagcacgataacgccgatttctgacagttctgagatgaattcagtttcttttacaacattaagaacggcaggtccgagtattacacccgccaacaacgcaccgactacctgcggcagcttcattttctttgttacaagtccgagaattttggtcgaaagcagtataagtgcaataaacaatatgtagctgtattcttccatgattttacttcctttccacgccgccattatatgacgttaatgcgtaaaaataacgatctacagcattttactctctgcaaatcgtcattgattttccgtatcttattatagcattatgccgcattatagtcaacagacagcacaatttgttcacaaaaaagagcaacaaaaaagagccgcaaaagtcggctctttttgtgattattttatcaaagtttgtttatacagcttttttgccgttagggaatatcttatcctcgcagatacctgccattttctctatagcaggctggatatccagccacagtccgcagccgtcgtcctgaccgcttgttttccatgcaaacacgccgttccagccattgttgtaagcgtcctcataagctgaggtgatgtcgaaatcactgtcgcttgcaacggctgggcattcgcctataacgcaaggctttgtaccgtcaaggccaaagtctgttggagattcgctgaaaggatatccccacattccctgcatccaagtgtaccaatgagttgaatagaagtcaacataggcaaggctcttgtcatacttatcaccgctcaaaacgccctgaagctcgctgtcggatattttgttgccctgctggctgtcggagttatactttatcatacccatgcccacggttacgagaacgtctgaatttgcatggatagctgcggctgcctttgcataatactgctccagatagagccaatcaagcttgccgcactcttcattttcaactatccagtcaggctcgttacaaaggtccacagaccagaaatagtcgctcttgccatatctctgaacaagaggaactatatagttatctacaaacatatctgtcttgtcgctgtcctgaatgagcgttctccaagcctgataattctggttctgatccttgaagttatcaaaggactgaactgttgccattatatagatctgatactgctctgcaagatagaacagattgtcaagatcctcccaatgagctgttgttgcaccgtcaaatgtaccgtctgctgagatagccataccaacgtcgccgttgcagattatccagatccttgcggcatttacgcctgaattgtgaagcttctggaaatgatcctgccagaactcaaaattaaagcctccgccaaagtcgttccacttatcccatggagcgttcactccattgaaccaaagttccttgtcgcccaccatgaattttgttccgtcgatcttgactttcgctgagccgtcggtcgttgttgcataatccttttcaggcattgcagtttccgaaacaacggcagagctgttgtttgatttgctttcagcctttgagcttgaggaattatctccgcagcccacggtcgaaacaagcatcagcactgcaagtgatgatgcaagccactgtttaactttcataaaatataccttccctttctttggactaaagttttgaacacatttgattatagcacaatactgctccattttcaatagcaagatctgatttttttgcagataatatcctctaaaattttaacattgtataattatattagcgttaataaatcggcactttttcatatagtgattaaaaatatgaacatttgaggtttatacacaaaaagaaggtatgttatttgtttaataagcgtattctaatttgaacagagatgtggtataatgaaatacactgatgaggttaatattttatatatgaaaggacgggaaagaatgaaatcagtatcaaaaagatacctgagctttattttatctcttttaatggcaatgaccatatttattggtcttgaccttggggatataaatgtgcaggcattgtcgggagatactctcaaaaacgctgacacggaagccatacttgaggatatgggtctgggctggaatttgggcaactctcttgacgcaacaggcggttcgggtcttgacacagaaacatcgtggagcaatcctaaaacaactcaggctcttatagacaaggtaaagtctttaggcttcaacacagtgagagtgcctgtttcttggggcaagcacgtatcgggtgacaactacactatcgactcagcatggcttgcaagagtaaaggaagtagttgactactgctacaaaaacgatatgtatgtaattctcaacattcatcatgacacaaagtcttctgcaagcgcttcgggagcaggatattatccaaggtcttctgcatattcaagctctgagaaatttgttacgagcgtatggtcacaggtgtcagaatatttcaaggattatgactatcatcttatatttgaaacccttaacgagcctcggcttattggcacaagatatgagtggtggttcgacaagtggaacattccgtcagaggtaaaggacgctatagactgcattaacaagctcaatcagaaggctgttgacaccataagagccacaggctcaaacaacaggggcagacttatcatgtgtcctggttacgacgcttccatagacggggcaactgtttcaggcttcaagcttcctacagatatctcaggcaacaaaaaccgcatcgctgtatcagttcacgcttacagcccttacaactttgcaatgaatgttggctcaggctcgacctcttcatatacatcttctataaagagtgagcttcaggaccttttcagcacgccgaaaagcactttccgtgacaagggtatacctgttgttataggcgagtttggctcaacggacaagaacaacactgctgagcgtgtaaagtgggcgacagactacactgcgcttgcaaaaaagaacaacattccatgcgtactgtgggacaacaatgcttttgcaagatacaacggaagcagcattgttctcaacagtgaatatcacggctacataaacagaaaaaacaacactgttacaagccctgcaaaggacgttatcgaggctcttatgaagccttacggcaacaaagcagatcttaactgctcttcaagcgttaccatagttgcgggacagagcaagaacattggcgcaagctcatcaacaagcggtgctgttctcacatacaaaagcacgactccgtatatatgcactgttgacaagaacggaaacgtgaccgctcttaagacaggcacaggatatgttactgttacggcttctgcaaatggttatgacagcgtttcaaaggacgttaagatagttgtttcaaagaagagccttaacaacggacttcttacgctttcagaaacaagctatgtttatgacggcacatacaaaaagcctgcggctacagttacgtttggcggcaaggtgcttcaggaaggcaaggattacactatctcatacagaaacaatctgaacgttggcgttacaactgttattgcgacaggcatgggcgactacacaggttacacatcaaagaacttcactatcacaaagcgtgcaatgacaggcggaacagtttcagtggcttcaagcgtttcattcacgggaagcaatattactccgtcagttacagtaaaggtagcaggcaggacgcttacaagcggcactgactacacagtttcatactcaaacaacaagaacgttggcacgtcaaacgtttatgtatacggcaagggcaactattctggctctctgagcgctaagttcgacattgttcctgcaaaacagcagatacagaagcttgaaaccagatacaagggcttctatattgattgggcgcagaaaggctctgcaacgggatatgacgttgagtattctgtaaactcaaacatgagcggtgcagtttcaaagcatttgacagcaaacaagcctgacacgctgacagtaagcggtctgtcgggggacaaggtttattatgttcgtgttcgttcttacacaaacgtaaacggcaaggtatactacggcgcatggtctgatgtaaagagcataaagacagctaacaacgacatcacaaaggcttctgtttcgggcatttccacaaaggcgttcacaggaaaggctattacacagaacgtaactgtaaaggttggaaacactgttcttaaaaacggcactgactacacagtttcatactccaacaacaaaaaagttggcaaagctactgtaaagataacaggcaagggcaagtatggcggagttatcacaaagacgttcaagataaatcctgcaaagcaggagatacagaagcttacggctaagtcaaaggcattctttatcgactgggcgcagaagggctctgctacgggatatgaaattcagtatgcaacaaactcaaagttcactggtgctaagaaagtgactataacaaacaacaagacagacaagaccactgtttcaaagctttctgccaacaagaaatactatgttcgtgtgagatcttacacaactgtaggcggaacaaagtattacggggcttggtcggctgttaagaatgttaccactaagaaataaggctatattggcataatgaaaataccgacggctcaggttgagcggtcggtatttttttgcgatatttttcagtttgtggggaagctaggcgggtgaacgttgttcgcccctgcatggggtcggggttttatccgttggtgcttgccacaaagaagtatgttatgtaggacaggacgataaacgcagaagaaagatagctcagggtgctgactatggctttgcagggggctttttcagagcggttgcaaaggtctgtgaaaagtccgatatttataagtcctatgagcatacaagggattatgtatctgaaattcattgtgcagataaaaggatatctgatacagaagttataatagttgcctaagatagtggcatagaccactgtgagcatgagtttttcggtaaatcttgcgttatcggtctttacaaaaagcactatgagcattgcgatgaacgctatgaccgcaagaaccaaggctatccagaaaagtgcatatggcacgagcattgcgtttttggggaagaaagtttcgtttatgccctcgccaaaaatggagtttttaagcattgctatagtagggttatactctttatagctttctccgccccactgctcaaagactattttgatctgtgagaagctgaagtctgtaaggcggtgtttggctgtaaggtcgcctatatactggacgtcggcatttgaaaggcttgggacatagtttggttttacgccgaagcgcaggtagtttctcacgctccaccaaagtccaagaggacagcatattacaccgaaaaggcacatttgacccaggcggtttgctatattcttacgattttgcacaagcgccataaagaaaagtatggctacggcaggggcgataagccctacggatatttttgtcatcatgccaagaccgatacagagggctgctttgacgatattctttgcggtctgctctctataccatttcagcacgcaatataatgctcccactgtgaagcagagcataagagggtcgttatttattccacctgacataaggacaaggtatggatacatacagcacataccgaacggtatggtcagggctttgcctttaaggtcaaagagccttaatatcttatagactgttattgttacggcacagacatagaagagggtcaaagcttgtatagcctcgcacgccatgtaatactctatgcctacggaggcgcagaatttcagccataccgcacagatgatatggtggaggggcgggtgataatactgccaaagggtggtagggtcgaaattcggcagggcgttgttattatagatatactctatatagcctgcgtgaccgccctcgccgccgaaataccacacgtcattctgtcttgtatagatatcggacatgaaaacataggaatatctcagcacaaagcctgctcctgccaaggcaaggcaggtgacacggtcgtggaactttttatcgttattgagcaacgcgacatacataacaagcacgacgcaaagtcctgcaaagcagataaaagccgctttatactgggtatgtacgaaataattcactgccgcaagggtcaaaagggtcttgcctgcaaaggtcaaaactgagcctgcggtatgttttccgctgtcatcgagctgtttcaaaaaccgtctgaggtagaaaaactctattatcatgaaaacgccacacacaatgacgccgtttaaaaacttgtagctatagcttccaaagcctgtgagtgcaaggcatatgaacgctgcaactatataagggtgacggctgagggtgcggaagatcgcctcaagccgtctgtcgcttatggctcttctgttcatgtctttccgcagggacagaagaagtccacctttctttttgttcatattagtttccagatttttcttcgtggtattctttttctgtattcacgttccagatatcttttctgctctttttgcctgtttttatggcttcggctgtttccatggcggtgagcattgaatggtccatattattatatctatgctgaccgtttctgccaacgcaatagaggttcgggaaagtatcgaggaactttatcatggtatcgaaatgcttatatgtatcaaaataagcaggataggctttcttgaccttttctctatgggaatcgaggacttcgttttcggagataacgcccattttaacaagctcggcggttgcgaatttcacgcaatcctcctcggacatattccagaaatcgtccccctcggcgcagaaatactcaagacctatccaaactgtatcctcaggcttttccaccatataaggcgaccagttgttgaatatctgtattctgccaagctttacgcccttatcctgaacatatatccagcagtcagggacgatattgccgagagttgttttatttgtttcatttttaaggttgagcttattgaccagcagaccaacggtaacaaagtcacggtatggcagacccttggctatctttatgacggtatcgcaaggctttgtgccgtccatgccgaggataaggtctttgacaggcattgaggagataaagatatcacctgtgaaggtcttttcgccctcagcggtatcgcagacaacggaggtgacttttctgccttcgcacattattttctttacctgacagcctgtgagtatttttcccccaagctcttttactttctcagcggctgtttcccaaagctgacctgggccgtattttggataccagaactgttcgataagggaggtttctacctcgcccttattctttgtgccgaacacctttttgaacatatctttcaaaagggctgtgatagaaagaccttttactcgctgtgagccccaatctgcggatatctcgcttgggtgtctgccccagagcttttcggtatagccctcaaagaacatggaatagaggacctttccgaaacggtttatgtagaaattctcaaggtttgtttcaggctttttgaacacgcacgcccaaaggtagctaaagcctgctttcatggtggtgacaaagcccatgttctttatggtttcgggcttcattgagatagggtagtcgaagaagtgcttattgtaataaattctcgatactctgtcacggacgagcattacattatcctcggtttcagggtcggggccgttttcggcaagcggcttttcgtggcctagctttttatcgtcataggcaggcttgccctgcaaaggcataaggtctgcccaccaatccatgacctgctgattttttgagaaaaatctgtgtccgcctatatccatgcggttgccgttatatctcactgtctgtgatattccgcccattgcctgcgagccttcaagtatggtcacgtcatagtcaccgccgtttttaagaagctctattgccgcagtcagaccggctgggcctgcgcctataataattaccttttccatgtgttatcctctcctgtttagtccttatttttatcaaatataataaattttctgcctgcaaagttccatatgaaaactatcactgtggaaacgagtttgcccacaagataatatttatcctgcgggagaagcgtgccgaatatgagctttgaagcaaggatatccttgaagaaccatattattgcggcgtttatgccaagtcccacaacgcccacggcagcaaatgccgcaaactctgcaaggcggttttttatctttgaatttttgaatatccaaaatgtactcagaacataattcaccaaaagccctgccacgaaagagatagtcgcggcaatgacggggtcgaagcggcaaagctccacaagtgcggtcataatgccgtaatccaccacaaaggcaaagccgcccacaaagacgtatctgaaaaactgtatgaatgtattatcggtatcacccgaaaaaagctgttttatcttcattttttatgttccgttctgaaaagtttcttgtgggcaacactgcaaaaaagtgagcctactatatataagtacgttttaaaaaggcaaaatgtcgctgttttttacaaaattctatctttcgcacaaatatatgacgctgtttttgtacatagtgcttaaacacaaagttcataaagcattaatcaatattatacaactttttcttcattttgtcaagtaaacttgtgcaaaaacaaaaaaggacgcttttatccgtcctctgagggtgtatgaaaatttttgccgatcggtcaatgacaaaaagagggcgaccaaaggtcgcccatacaagttttttcagaaccattacagatcatattctgttatgaggtttttgtcttttatcttcatacatatatttatcggcgatgtgcattacatcgtcaaaccagaagttttccaccggagcaacggctgcgcccacgcttactgagaggacataggattttccgcttcgtctgttcagctctgccattttatcctttatctcttccttgacctgatcggcaaggtctgtatcaactatagcaaaaagggcaagctcatctccgccaaatctgccgcagaccttattctcaatgctcacgctgtcgatagcgtttgcggcggctcttattgcatagtcgcctgcttcgtggccgaaattatcgtttatatatttcagtccgtcaacgtccactgaaaccaccaatgcaagctggtcgtttcttcgtgggagagtttcaagggcattataaaagccagtacggttataaagccctgttagcatatcgtgacggtacatttcttcgatatgctttgtcatatacttctgataggtgacgcttcggaagctgcccaaggcggtatttagggaatttacatagagtggtattttaaaatactcgctgagctgcgccggaaaatagaagcaggcatagccaagtggtacgccgatatgggcaagtgctgaaaatatgagggggactttatagtccattatattctctatatcgggaatgatgttggtgcggtcaaaaggctgtgggatatttctatcttccacggcacggctccgcagaagtatcattttatcgctaaaaagcggttctctatcgcttattacaccaggggctttacgttcgtcaaaaaaatcgccgttcaccacaacagccacatcgccaaaattatactccttcagcagtgtagcaagagtcttaggagtctcacaattcatgatattcactgcaagctcatagaggacacgctcctcgtcctgatagcgattcattctgtctcggagtattctgatatactcccccgtatttatctgctccactgagggtttacagccgcaggaattttcaacggacagatcatagtctactgtatatattttttcgggcttttcaccagccagagctttacttataacattaatgattgttttagcggtatcatcatagctacagccgcttgttgtaagcataggagtgcaaaaattagcttcttctgagccgtcaaagcctgttatgataatatcctccgggatcttatagccccttctttgaaactcagcccctgcggctatagccatcatatcgtttgcacagatgatcgctcttgggactttatttttttctatcatatcgtccactgctttcaaagcaggaacagaccaatagtcaccgtaataaaagacatcatttctgaatgggatatcatactcctcgagtagctttctgaaaactgctatacgctcttctgaattttcttcgtcttttctgcctgcgataaagcctatatctcttacaccatgctgttctatcacatggcgaaccacttgctcaaagccttttgcatagtcgaatttgatgcttatgcaatcgtcatgctctacgccgactgatatgacaggcttaccatatttggcggcgtccattctgatttttgtcattacattctcagcatacacaccctcttcaaaggtcacgacggcatctgttatattataatcaataaggtcaaacacagactgctcgcctttttcagacagagtcttccaataaaggtctgagcaggtgtgatatacaaacagcctgtaatcgttttcaacagcaaaattattaagagcccgtatgattctataattacgctcatcatagactttacacatacagacagcaattattttgatgttaccgatcatacagcacagctcctttcctataaattcaaacacagtgttattataacatgatttaatgaataaatcaagagaaaattggacaattcttaagaaattaagacatagtttcgcacacttgattaaataattaaagaaaaggagcaggctgttaatccagtctgctcacatcgttccatgaccttacacgctgataagacattttatgctgttggagatactcgtcggtattttcgggagggctggcgatatcctgtggtttatcgcttgtaaagatatcctcataatcgttagttatgaccttatcgcccttttggttatccagcaatttttgtaggttttcggtcattttatcacgggtaagcccctcgaagtctatacgctcttttctgccgtcgaagggaaagttggggagtttacgcatgaaattaaggtcagacacagtttttgcggtgatgacagcgactgctataaggtaggcgagcataacgaaagtatcgcctgacacgctgtaaaaaagggcgaatttcagacccatatataatatcatcacggcaggggaggcgactatcaatttagttgtatccgccatgagcaaagcaccgcaggcggcaaacgccacatagttaaaaaaggcatttgagcttgcatcaaaaaatgcgaacatcgcactttccgacgcaaaaaaattcgcccatcccatcattccgtatattatagccgcaggaataagcaacgcaaaggtaaaagctgcaaatcgccgctgcctttttataagcctgcggaaatgcctgcgaagagtttcgtcaggcagtgttttatagtcggctctcagatcaaacatttccatgttatgtcacctcctgaatttattatagcattgggggaggggattgtcaaatggtttctgggggtgttagcacaaaccatgtagtggagcggcgcaatttctgctttgcagaaatacgacgtcccattatttctcgcacgtcaccatttgtgttttttcacaacaaccccgaataaccacacaacgcatttgtaggggacggcgccctcgacgtcccgacccctcgacagcctttgtccccctgcatggcttgtgaaaaaaatacaaacctcactccttcgagcgggacgccgagggcgtcgtcccctacaatcctgaatttacagcaaactccaagcacaggcgaacaatgttctcccctacatctcattcgggcaagttcctgccgccgcaaaatcgctccgctctttgcgtatctacattgcgcttagggctagaaagacggtgcagatttaattctccgatatcactttcatctgatatcctatttctatctgcttttgatactacaatctgcaccttgtcggcttacgccgaatgaggctctgcctcatactccgctaggggctttgcccctagaccccacaatgggtttcaccccttgaccctgaccagggacgtgtccctggaccttttgctcgcttcgctcggtgttgggtactctactttgtgcggcactgtcattcctcactcctcactcctcacttaacttcactcctcatttaactccgctcctcacttagcctcgcccctgatttattcaaatgtaatcgttttatgcctattgcattaatttgctttttgttgtataatatatttgttaatatatacagccatttggcaaaatcaagatatgaaaggaccttattactatgaagaaattccttgcggcggctcttgctctttgcatgacaagtgctgctctcacaagctgcggtgattcaaacagctcttctgctgctgactcaaactccgctgcggcaaactctcaggcttccgattcaagtgcggctgataccgaaagtgtttcagacaagcttcttgctgaataccctgcatctacggaaaagatagatgttaaaaatggtgctactgagaacatgatcgccagaagcgttatcaacgagggcgacacttcccgtcttgcggctaagctcgactacgctctgcaaaatcctaaggagacaacaaagatctgtttcatcggcgactctatcacggcaggttcgggtgctaactcctcaactaatcagtatgtaaaccagttcaagagctggtgggaggaaaacataagcttctacgttgatgttactaatgccggtatcggtgcaactgactcatacataggtgttcacagggcacagcgtgacgctttggaggctaagcctgacattatcgttattgagtttatcaatgacgctgatgatgaattttatgagtcctgcatggacagccttgtaagaatgtgtcttgagcaggacaacaatcctgcagttatgatacttgaaccttcaactgaggggggtacatctccacaggctgcacatctcaaggtagcacaggcttacaacattcctatgatttcttatcatgacgctgttatgcctgagatagaggctggcaacttcacatgggctgacatttcacctgacaacgttcaccctaatgatgacggacacgttataatggcttcactgctcacaaaattcgttggcaacataaaggacaatattgacagcgttgacaaggaagcaaaggcatttgacacaagcactgttgcaccgacgggcgatgtattcgctgacgctactatcggaagccgtcagacagaggacattgtaaagacaactgatgagggaacattcacagatgttacaacattccagaagttcacagacggttggggaacgacaacaggcggcactatcaagtttgagataactgcaaagaacattggtatgatatactacatgacagttgacggcaagtccggcgtggctgcggtaaaggtcgatggcgaggacgttgcgactatcaacgctgacttcacaagcggctggggcaactacgctaaggcacagcagatatactcatctgacgaggtggctactcacactgttgaggtaactgtcgttgatgacgcaaagcctaacttccagatacttaactggcttatttcataaggatctataataatattttggcggatacgagagttcgtatccgccgaagttttgttttcatttatgttatatgaattaaataggacacaaaatatttagtgaaaactaagcagccagcttaacaaaaacgaaaatagatatgatataataaatatgctgaaagaaacaaaaacagcgataacttattgatccccttaataagacttctcccgacaggttttccgactgtcgggagtttttttgcatattaattttctttttgttctgtgataatatccgaaagcttatttatcagatcttcaggcacgttgtagtaacacttatttatctttacgttatacgcatctgccgtcgtttgtctgacaattatgctatattctttaccgtctgatactttccactgagcagtaccctttgaaagcattccattttttgctgtgttttcatcgaccgcatagcttaaactttcgttgaggagctggcgaaattctgttatagccgtttcatctgttatatcccagtttttcccctttgcatatgggtcgccatactcggcagacacgccaaagccatttatattgctgaaatcaagttctgtgatactatcattgtccaccgaagcttcactttgttcagtgctttcaccgagcacaacagagctgtttgcaggcgttggggcggcactgctttctgtggtatttccgcaggctgtcattacagctattcctgacaaggtgaaaataaataatattttatatttcgttttgttcataatatcgcctcctgtaataattatactcgaattggataattaccacaattgacaattttaacatattacttgtttatgttttgtacaatttactaaataaatctaaatattattaaaaatcgtcaaaaaaatcggcagcaggcacatgatagcgtctgctgccgatagttttatattgttttaagcattaaagcaattatccaagaacaacaacgatgtttgtctgctctgtcatcttgcactcgcatacgaagttgccttcaactgcttcgccgttgactgtcatagactttacgccgctctgaacgtggtctgggttctgaatgtcgatagaaaggtgcttgccacggaaattcttttcgatcttgaagccgtcccatgtgtgtgggatagatgggcttattacaagtccctctgcgtttggacgcataccgcagataccctctacgcagcctaccattactgttgagcctgtacctgtcagccaatgaacgtgtgaacgtcctgcatatggtgaacgtgttgactctgtaaactgaccgtgaacgtatggctcaagtattcttacttctgccttatcgttcatgttagcaggtgaggactcgaggaagtactcgaatgctctgtcaccgtgaccgagaagtgactctgcaaggatagcccagccctgtgtctgtgagaagataccaccgttctcctttgtatcagggttaaagatgtgcatgagggcaccgtcaaagtaatgatctacataaggtggctccatgatctttacgccaaatggagtattgagtatctcgtgtaccttttccatagcagtttcagcctgcttatcagatgcgaagcctgagataactgaccaagactgtgggttgagccacattgaagcctcttgatccttcttagcgccaacgatctcgccgttctctctgtaacctctgataaatctatcctcgtcccagcaagcttcaaggctcttgccgagttcaggctgtaccttatcgatatatgaagcgtactcattatcgcctctgtcaagtgcatagcccttgatgatgctcattgcatagtagagctggaatgcaacgaatgttgactcacccttcttgccaagtctgaggcagtcgttccagtcagcataaagacctgctggcattgtatgagcaccaagtctttccattgagaagttgatagctctcttaagatgctcgtaaactgtatcctcgccgccgtttgcgtatacgataacctcatcgaggaacgccttgtttccgctctcaccgatatacttattaactgttgggaagagccagagagcatcgtctgctctatagcatgggtgacctgtttccttagcgtagatagagttctcatcgttctcgtccgggcaagtttcatggcctgccttgtggtcgaacttaacaagtggaagtccgccgccgttatctacctgtgcagagatcataaatctgatcttttcagcagcaagctcaggattgatatggataataccctggatatcctgaactgtatctctatagccatagccgtttcttagaccgcaatagatgaatgatgcagctcttgaccagataaatgtgatgaagcactgataagcgttccatacgtttaccatgttattgaactcgtcagaaggagtttcgatctggaagttattgagctgaccatgccaataagcgataagctcctttacctcagcgtctaccttgccaggctcgttatatgcagcgagtatctcgtctgctacctttggattcttctgaccaacaacatagattatctcctttgtctcgccaggagcaaggataatgtcagactgaagagcgccgcaagcgtttgagttatagttgagcttgttatcgcagaagcctctttcaactgcaacaggattgccataagttctgtaagagccgataaagctgtccagattaccgttataagcggaaacaggagcgccaactacgccgaaaaatctttctctccagttagagccgttctcgtccttaccgctgttctcattgatgtgctgaacgatcttgttgccctcaaagcttgttcttgtgatgaacagtgtatactggaggtttacctgatcctgctcgtagttgttctcatttgtgaactctacaaagccgaatgttgaaaggtttctgtatctgtcagagttatttgtgatcttagttctccatacctcatatgttttgttcagaggaacataatatgtaagctcggagtggatatctgcatagtcagacttgatagttgtataagctgtaccgtggtggcactctgtcttatactgatcgagaggcttgcctacaggctgccatgtgcatgaccaataatccttggcgtcgttatctctgatgtagatatatctgccaggaagaccgatatttgagttgaaacggtaacggattattcttccgttagcaccgctctttacaaagctgtatccgccgccgttgttggatacgatagcaccgtactctggtgagccgaggtagttagcccaaggtgcaggtgtgtcaggtcttgtgatgacgtattccttgtgttcaaggtcaaaataaccatactgcatattttttatacgctccttttcaatattttaatgctgtaaacgtttcaccaaaatggcgtaaacgtttccctcatagatcccgtcattattcataacgcttatattattttagcatacttccgatagctttacaagggggtaaagccaaaaaaatgggcgtattttcaaaaaactttttcgggattgttgacttttgaaacttaaacgattgaaaatcgtcatgctttttgtcattgtccaaaacgcactaataactgatatttatttatatatattggatattgacagcaatgccgaaaatatggtatattgtgtatataataaattataggaggtttaccattatgaacattaaaggaagagttttagctatggtttctgcttgtgttgtgattttctcacaaagttcaatcgcaacgtttgctcttgataaccaggaggttcttacattaccaacttctgtttcagatttaaccagcgctgaaaacatgggacaagtggttaaaattcacaacttacatggagcagatgaaggaaccattgctttctgcgctgaaatggagtcgggatatgtgatatatgatttgtcaggaaatacaatagagtatagtcctacatcatcatctccatatagcgacttacaaggcgatttatattatgctggtccacttgaatacttgactaaaacaagcactgattacaaaaatttgcgaacaggtgagattttaacagacgagcaattcaacgaagttactgaaagttttactaatgagagcataaaactttcatcaactaattttatgaattcaagtgcttccagggctaattcaggatttcgcacagcagtttcaaaagtatctggaacacctagaaaactaaactacaacacatctaatcaatgtggggcgttagcagctgttatcaacttatgctatattgatgactacaaagacaacaattgtttgagcaattcttattctaataatcccaaaagtcttttcaacacccttaacaattatattccgagagaaacagaccggaatggaataataaatggacttagcaacgcaaaaaaagataaaatatgtagttttacttcatcgcctgacgcttactatggcggtgattcatggggattttgtttttacaggatactcacgtcaaattctccaaccatattacttattataaagcatccgaattatggtggagcaaaggggagaaatcattgggtactaacatatggcattgttcaatgcttcgataataataataaattagttgataaatattttattgttaacgatgggtatggaaaaaatgatatacgaatccattacacatatcaggacgactgtgtttacatttaagggtaggtgacaaaacatgaaaaagacagtttatttggttttagcgctctcactgcttctttgctcatgctcacagacaacagacaatgataacaaaagcaaggtcaatgacagcagtacagttgtgacaacagcttctacaacaatgacaactaccacaacttcatcatcaaaggtcgatgaaaatgctgaaatttcggcatattatattcatcactggtatggagaagaaccatatgagataacagacaaggacactatcgaaaagataactgcgtggatagagaatgctaaatcggtatgcaaggattatccttacattgacggcttagaatacggtggcgcagacgcttatggaatctctctcgaaaaggatgaatcaagtgatgcgtatgagagcatttgtgttatcgatgtttcacagtattcgtgggacacctcagacggtatgcactctgaaagtaaaatatgcaattttagcataaaagatgatgcaggcgaatttcaggattacaatttgccaaaggaaatgatagatgaaataatgccccttataacaagacctaatgttgaatagcaaacaacacatacaaaaccggcgtgtatcttcgtgatacacgccggtcgtttctattatgtttttatgataccttgagccatgcgcaggcaaaatcaagtgcttcataaaggcttgatttttctgctaccttaacgatctgcttattcggaggcagtgtgctgtctgttgcaacttttcttattcttaccttatttgcaacgtcgataccgccgaccttttctgtagaaagtatttctatcatgactacgaactcgtcatacatatttccaaaatagatattattcccttttctcaccagaggaacgcccttataggtgaaaaaagctttcttttcttctgccatttatctctccgcctttctcataatatatttctctttttgtttactattttattataccatacttttcacataattaaaagagcttttgacaacttttttgcgcaggttttcagcctcactttatgtgggatacatattgtatcacttattctttgtgaaagctgtcgaaacatgaccgtaggggcgaacgctgttcgcccgtcagatcatatgcttagcatggggtatgcgttttaatagttatcgtccacagcctcgcctttaagaagtctgtccatatttgcaacgaacgtatctacccaagttgactgtattctgaatgaggtttcaccatttagcttgactacagaacgtcttgaagaatccttataaatctccataacgtcctttttgccgtccttgcggtcgaatgttacagtcagatagctttcgccctcagggtctgtgaagtatatctcatttgtcgggcaacccataagatactgatagaaggtcttaaagttgtcaacgtcaagctccttgccgtctgttgtgacctttgttacctgtgcagtagttttgccgtcagaatctgtatccgtgcttgcgcctgagctttccacctcatagactgtctttttgccgttatatactacctcaacgttcttaaggtcaacaaggtagtttgaagtcataaggcttttgataacgtcctctgctttgatcgttgcccatgggaggttatcggctgaaacgaggtatatagcgtcaacgccctttacgccctcaaagtagcaataatatgcagacactgtatctgttgtttcactgctgtcgcctgctgttgcatagacagggtcgcctattttaagggtatagtcatagccgtctcccgagagtcttactgttgcgaacgggtcggaaagtccatgctccttcattgcagtttcatcaggtgcgatgacctcacagctctgtgctgtaagtccccacataccatgggtagttgctgaagaatttgtaatgttcaggtatgagaagataggctctgtcattacctgacctgaaagtccctctatctcgttagggttattttcaaacgccatttcatagtccagatcttttcttgtaactgtttccttgccatagtcaggccaatcgtcgtcagacggctttgtgagcaaagtgaggttcgcatatgcggtcactggatctgtatagtatgaaagctttgttcccattaccatatagacggtcttttcatcgtcaaggctcacatagctgtatctttcgttgcttggtgaaacagagcctacatgaagggtagtggcagtgccgtcgctgtattcaactgtgagatctgctgtgggcttatcaagaccgtattttgacatatcctcaacattttcttcaacgagctttttcgccttgaagccgtcaagattcgatatcatggaagcttctgcggtggcatttgcattgagagtgccaagctcaggtatgctccatgtggatttacctgactcggacttattaacagaatactcgccatgttcgtttgaaacctttacgcttgttatatcgtcgcttgactttgtaaggataacaacgctctcgtcctgacttgaaactgccgctgttgacgatgagctggattctgcgtctgatttgcctgaggtggagttgagaaacgccattactcccaccagacaagcggctgtgactccgcagataatgataccctgcaatttaccattcatttgtgattacctctgtgttttacttattctttcttcttgcccagataacgatacccactataagaactacaacaggtacgccaaggcagaatgtccatttaagaactgttttctgctgctgagtgatatcgaaaacattgcctgtgatagtttttggtgtgatagtgatacctgcggtcttttcggtaaggccgtttataacgcttatgaaatactcgctgttctgatactgtgaatactgcaagtaggtatcagacagcataccctctgaacctactgcgataacattgctatagagagttttgttatcgtctgtaaattttgcctttgagccgacagccatataattctgctgaccctttaccagagcgtcgcctatattcacctgacctgtggtctgtgatatattaacatttgcggtataggcagaatctgaggacttgaggtaggcgtctgtagacaccatatcctgctcgtcaaagagtgtgtttacaggacggcagagtgctgaaagtatagccggtttctctgcagaaacgtcctgagtgaagttatcggacacatctgacgcaactgttacgcaaggtgagttataatacttgcctgagtcgctttcgcagataacgcccttgccgacagaaagtccatactctgacaggaactcatcaagattcggagtgtcctcctgaccataagaagcgatatagaggagctgtttgccaagatttccgtcattattgaggaagtcgctgacctttttgatatcctcctccagatagtcagtcttaggagcagggataaccacaacgtctgtatcggcagggatatcctcggaggttatatccactgtgttcacgttatagccgttagctgtaagaagcgtctggaaatatgtgagctgtgtaagctcgcttctgcctgtgaggacagtaacatagacagggttagggtctgttactgtcataagtgcagaagtgaaagcctgctctgcgtttgaggactcaacatagctgccgtaataggacaggaaagaaaggtcgccgcctgcctgctgggcaagggtatctatgctgtagcctgactgtgacagcttctgctcaaactcgtctgtgaatgtaagaaggtcgagcataccgagctttcttgttcggcttatctctttgccgtcaacctttgtttttgtttcaaatatcatatcgaactggctgatagtatcggtatactccttaacgatctcagggtgtgagtcgatatcaacgaaacgatatgtgatatggtgattgagcttacaatagtttttcaaaagctcaacagcctgcttattataagagctgtaatttgtataagtattctcgtctgcgaaaatagttacctgaacgtcaacgttcactttctttacataatcctctgtatcgtttgaaactgaatatatcttattgcttgtcaggtcgatagtgataggatatctgtcaaaaagcattgttgtgacaacattcactaggacaagcagagcgacaaaaacgcaggtgaacactgttgccattgttccatgcttgagctttttggcattgaactttttgccgtcctttgtctttttctcttttttatctttctttttgtctttatcttttttatccttttctgtatcctttggagcggtctttgctgccttttcgtctgctacaacgtctttaagcaggtctgctcctgatacagagatcttttcgttattattctcttccatttaaacagccctcctttagccccagcggcgtttttcaagcactctcaccgtgaggaaaagaaatgccactattgcactcagaaagaacacaacgttagaaaaatcaaaaagtccataggtgaatgaataatatctctcgccgaatgacaccttttcgcacactgttgtgagccattcaaaaggcagaagattgcctatagttgacaggaacgacacgaagataagtgcgataaagcttattactgcggcaactatctggttttctgtgaaagatgagcagaagataccgatagcgatataagcgccgccaacaagtgccagagcgacgatattgcccacaacgacgttccagtcaggcgtaccgaaagcggatacgataactgcgaaaacgcctgtgatagcgatagctatgatatagataagaaaagcggcaaggaatttacctacaactatgctgccaaggcccacaggggcggtgagcagacactggtctgtttttgttcgcttttcctcggatatggtcctcatggtgaggacaggtataagcactattatgattataagaagcgcactgaaaacggaatcaagtcttgtatagccgctttcaaggctgtagtttgcaaacattacgcctgaataggcatagaatgctgcaaggaaaatataaccgataggtgaggtaaaatagcttcttacctctcgtctgaatattgcgcccattagtcatttccctccttatcggaagtattttcaagggcaggcaaagcctcgcccattgtgagcttgaggaatatatcttcaagtgaaagctcggaggtcttaagttcaagcatataccagccgtttttaacaactgtttcaaagacgtcacgtctgatatccacgccctcttttgcctctattcttatatcgttcacgccgtctttatggcttgcgtcgcagataactttctcaacgccctttatgccctgcattgctctgacgatcttatccttatcgccctgtatctttgcagtgagcttatgctcgcctgagagcttctgtgagaggtgttcctctgtatcgtttgcgacaaccttgccctcgttgataactattatcttatcgcagacagcctgcacctcagagaggatatgggaagaaaggataacggtatgatttttgccgagctttcttataagagttcttatctcgattatctgcttagggtcaagacctactgtaggctcgtccaggataagaacctttggattgccgataagagcctgagcaagacctactctctgtctataaccttttgacaggttcttgattattctgttataaacatggtctatctttacaagtccgcatatatctttaagatgtgacacctttggaagcttacactttttaaggtcatagacaaaatagagatattcttttacggtcatatccatataaaggggcggaagctcagggagatagcctatctgctttttagccttgatagggtcttcaaggatatctacgccgtctataagggctttgccgtctgtacaggatatgtagcctgtaaggatattcatggtggtggattttcccgctccgttaggaccgaggaagccgagaacttcgccgtcctccgctttgaaagagatattatcgacagcttttttgtcgccgtatctcttggtaaggtttataacctctatcattttatttcctcctcttaggaaaagcattcataagtctttacaattttataatacttatgtgacaggggagtgatagctgtacgaaatacagagcattttaagtaaatttaaaagtagcaaatactcaaaatgctccgctgttgaattatttatctgtttaaaagcgatgtatctatgtaatttgtaggggagcggtgcaatttctgctttgcagagatccgacatcccacttgtttggaaattatttcgcccctacacatattcaacattttcgtagtttttattatgacagcttctcaatgccctttcttattcttgcaagagtatcctccttgccgatgagatatgatatctcaacaccgccgcccggagtgaacgccttacctgaaactgcaactctcagaggccacagaacgataccgttctttacgccaagcttgccgataaggtcaaagagtgcgtcatggatattttcctctgtccaatcctcaacgccctcgagaacagggagaacttctttgagagattcaagagaattttcagggttcgttttcatcttcttatgtgtatagagagctatatcatactcagggagagcgtcgataaagtctaccatttcaggtatctctgtgaaaagctctgttcttgcctgcaagagctttgcgatctcgttaaggtcaacgtcctctctatgaacggactgcttgatataagggatagcatactcagcaaacttctcaggggtcatagcctttatatacttgccgttgatagctttaagcttagcagggtcgaagatagcaggggacttagaaagtccgtggatatcgaattccttaacaagctcttcaagtgagaatatctcgttctcgccctttggcgcccagccaagcagagcgatatagtttataacagcttctttaagatagccctttttcataagatcctcataggaagcgtcgccgtctctctttgagagcttatgctgcttatctttcatgatatgctcaacatggatataggttggtatctcccagccgaaagccttatagagcaggttatacttaggtgcagaagcaaggtactcgttacctctaacaacgtgggtgatacccataaggtggtcgtcaacgacgtttgcaaagttataggtaggcataccgtctgtctttataagtatctggtcgtcgagggtagagcagtcaacagtgatatcgccgtaaagctcgtcatggaaagtaacttcgccctctgtaggtattttctgtctgataacataaggaacgcctgcgtcaagcttttcctttatctcttcaggtgagaggttacggcaatgtctgtcatacattggagcgataccgcttgcttcctgaatggctcttacttcctcaagtctttccttgtcgcagaagcaataataagcctcgcccttttcaacgagttcctcggcatatttcttgaacatacccattctctgtgactggatataagggcctacaggtccgccgatatcaggaccttcgtcccaattaagaccaacgtctttaagtgtcttatagatgacctcaacagcaccgtcaacataacgctcctggtctgtatcctcgatacggagaataaagtctcctccgttctgctttgcaataagataggtaaagagtgctgttctcaggttacctatgtgcatataacctgttggtgaaggtgcaaatcttgttcttaccttgttcatttatatcttcctttcaaaattagagtcttatttcatatcctgctcatcaaatgcattttttacatatttcgcaggattatttgcaatatactgccttatttctgcgtgttgctttctgtttttgattatcgtatcataaaaagatttttgccatatggaataacctagttcttttgtgacagcctccttgaaatgttttatgacccttgaaagtgtcggtgtttcacttgtaggggcgaacagtgttcgcccgtttttcggctgtttttcaattttgattataatatgcacatggtcaggcatgatacaagacatctctacaaaaacatcgggatagtgcccagatatctctgtgagttttctctttacaagttttcctgtaacagaaagttttgggtgcagaatttcatttgcagtcagcgggcgaactgttcgcccctacattctcccacaggacttggtatttttcagtaacacatatcgtcacaaaatacaagccgtttgcagaataatcataaccctcaagacgtattttctttcgtcttggcaaatcttcatttgtcatattttattttcctcaaaatatctgaccgcctgctctttgttttttgctatctcctcacggaggctgtcaaagctgtcaaacattttttcggggcggagaaattcatgcagttcaagttttagctttctgccgtaaagatccccatgataatccatgatgaaggtttctgcaaggggagctgtttcaacatggacggtaggctttacgcctatatttgtcacgcctgcatacttatttccgtctatttcaacagcggagcaataaacgccgaatttcggcattaccctgccctttggtatctgctgatttattgtggggaaatcccatgttctgccacgttgaaagccgtgttccacttcaaggcagaatccaaaatgataacccagcatttcatttgctttggctatctcgccctcacggacgcatcgtcttatctcagtggaacttatgacctcgccgcccatgagcagtggacttactatttccacatctatatcatatttttcaccgagccttttaaggtcaacagccttgccctgtgcgcctttgccgaatgtaaaatcgtttccgcacactgcaccgctgcaattgagcctttctttcagcacctttttcacaaaatcctccggtgacattcctttgaactctgcaaaatcaggtgagaaaagcacttcgaccccaagctctgccatttttttatgcttttcctcgtcgctcataagcatttctatcctgccgtcatgaccttttgaggtcactgtgtcggtcttgaaacagaaaactgccgaatgtccgtcaaggctctgagcctttttcacagccgttgttattatgagctgatgtcctctgtggactccgtcaaaaagtccaagagcgcaaactgtcctttttttggggataaacccgctgtttgttatatccgtcaaaatatccctccgaataaaacaaattatcagaaatttttgaagcttctgaagctgccctcatgaaaagtgccgataccgaggaagctgttatcactgccgtagacacggtagagcttgtcctctgacagatcttttatacctgtctgctcaggtctgagctttactccgtttctataaagctttgtttcccactgtccaagggtagttttttcgtagcttacaaaggctctgtcaagggggataagcatttgtgacagcttgtcctgctcacaaatttcggctatctcctctatggtatagcaatcctttatatcaacgccccctgaataggaacgctcaagagaagtcatcattccgccgcagccaagcttttcacctatgtcgctgataacggagcgtatataagtacctttttcgcaatcaactttcattacgcccctgcgtgaagcttcgtcatattctattatatcaatgctgtcgatatggacagctctcggctcacgctctatttctttgcctgctcttgcaagctcatagagctttttgccgttcacttttattgcagaatacataggcggcacctgcatgatatcgcctacaaaactgctttttgcacattcaaggtcggctctggtaactgccttgtcgcttgtttttaacgtctttcctgtgctgtctaaggtatcggtgcttaccccaagctgaaagcctgcggtatagacctttcgtctgtcggggataatatcgcaggcttttgtggctctgcccacgaaaacaggcagaacgcctgttgccatagggtcaagggtccctgaatgacccaatctttttatccttagaacgcctctgagctttgcgataacgtcaaaagaagtccagccctcgggcttttttacaggcaaaatgccgcagatattatccttgctgttatccaagctcatcagcccaagaccttttccgcttgcttgagaagcttagcctttacttcttcaaggcttcctgttatctcacagcctgcggctcttatgtgtcctccgccgccaaactcacggcagaatgcagaagcgtctatctcatcgtcgcttcttactgatattttaaagacgttctcgtgtctttgcttaactgttatgcctattttcacgccctcaacggacaatggtatagaagcaagtccctcgaactcggcagcgtcaacgccgcttttctccattagctcttttgtaagcactatcatagagcatttgccaccgcagtaatactccatattcgctgtaacggactgctccaccataagtctgcccttgctttttacatcaaacatttttctgttgatataagcaaaatctatgccatatgacataagctctgcacaggcgatatgagcctgcggagttgtgttttcatacttaaagcagcctgtatccgttgcaatgcctgtataaaggcatctcgctatctgacgtgatatctttctgcctgaagctttgaatatcttatacattataagtgctgcggcagaagcgtctgcttctacatatgactgctttgcataatacttgtttgagatgtggtggtcgatgcaaagatcgatcgcaccctcctcggcatactttgaaaggttgctgccaagaagatttgtgtctgcaatatccactgcgataacgtacttcacatcaaattcctgagggtaatagctctcatagataagatcatatctttcgggaaagctgtcggaatttacaacgttagcctttttccccatatctctcagaaaagcgcacagggcaaagcctgaaccaagcgtatcgccgtcgggacttttatgagttaaaataagaaaattgtcgttttcttcaaatattttaagaatatcctgaaatgtcataatatcctttctcctctattactcttcgccgtctttctcttctttttcttcttcgggcagaacttctttaagaagcttgtttatctttgctgaatgctcgatagaattatctgcgataaatttaagctcagggcattttttcagcttcagcacgtttgatatctctcttttgagaaatcctgttgccgactcaaagcccttaacggcttcctttgccttttcatagccctcaaagcttgaaacatacactttacagaatgagccgtcgcctgccacgtcgcagcggacgatagtgagcatatctcctccgtgtatccttgggtctttaaggtctctcattttgcccgatattattcttcttatatcttcggacatacgtcctgctctgtaacctgccataatatctttatctcctgcttaaatatgctcttacggggcggctgtccgtcccgtaagcatcattatcaatctctgtattcttccatatagaacgcctcgaaaatgtcgccctccttgatatcggtgaacttttcaagagtgataccgcactcaaagcctgcggcaacttccttggcgtcgtccttaaatctcttaaggcttgacatcttatcctcggcgataacgataccgtctcttacgactcttatctcgttatttctgcccaccttaccgtcaagaacgtaagaacctgctacagtaccaacattggatatcttgtagacctgtcttacctcgatacgggctgtttccacctctctgtacttaggagcgagcatacccttcatagcgtctgttatttcttctattgcatcatagattattctgtaaagtctgatatcaacgccgctctgctctgcattctgctttgcaacagggtcaggacgaacgttaaatccaacgatgatagcgtttgaagcgtttgcgagcataacgtcgctttcagatacagcgcctacgccgccgtggatgaccttaactctgacctcgtcatttgaaagcttttcaagtgactgcttaacggcttcaactgagccttgaacgtcagccttgacgatgataggaagctctttcatttctccctcagctatctggctgaacaggttgtcgagagttaccttctgatgctgctggaacagttcttccttagcttcttgctttctctgctcaacaagctctcttgcaagcttttcgtctgcaactgcgttgaaaacgtcgcctgcacttggaacttcgcccagacctgttatctcaacaggtgttgacgggccggcttccttaatgcttctgcccttatcgtttgtcatcgttcttatacgtccgacagaagtgcctgcgattataacgtcgcctgacttcaaagtaccgttctgaacgaggagtgtagcaacagggcctttacccttatcaagtctggcctcgacaacagtacctcttgcaagtctgtcagggttagctttaagctccttgacctctgcaacgaggagaatgttttcaagaagctcatcgatacccataccggtctttgcggaaacaggaactgcgataacatcgccgccccattcctcgacaacgagggactgctcagtaagctgctgcttaactctgtcagggtctgcaccttctttatccattttattgatagcaacgattattgaaacgcccgctgcctttgcgtggttgatagactcgatagtctgcggcatgataccgtcatcagcggcaacaacgaggatagcgatatctgtaacgttcgcacctcttgctctcatggctgtgaaagcttcatgacccggagtatccaggaacgttatcttcttgccctgatactctacctgataagcaccgatatgctgtgtgataccgcctgcctcagtgtcagtaacgtgagcgtttcttattctgtcgaggatagatgtcttaccatggtcaacgtgacccataacgacaacgacagggcatctttcctgcaggctctcctctggatcttcgtcagtttcgataagtctttcttctattgtaacgtgtacttccttttcaacctttgcgccaagctcttctgcaacaagtgcggcggtatcaaagtcgaccacctcattgatagaagccattacgccaagacccataagctttttgatgacctcggtagctgttactttaagtctgcttgcaagctctgaaacaacgatctcgtcaggtatcatgaccttgagctgctgctttcttgctctttcaagctccagtctgcggagcttttcgctctcagtttccttcttatgtgagaactgctgtttctttctctgctgagatttctgggtgagcttctgcttctttgtgaagttatccttgctcttgttctgctttgagtttgcaaggttatcatacttctcgttatacttatcaagctctatatagcttcctcttgtgtcgatagttctctgtgtgccgaacgaatcgttatcctcagagatagtatatccgcctgaagcttctttcttatcagaaaaaccgccaagctgctgacgaacgccatgctctttcttctttgcaggcttctgtggagctggctgctttttcttctgttcaggtgcaggctgttttgtttcggccttgacctccggcttcttttccacctttggctctgccttaggctcaggctttgcttccgcctttggggccggcttaggctcaggctttgcttccgcctttggggctggcttaagctcaggcttcttttcagcctttttctcctttttctcagcctttacaggcttcttatctgccttcttttcttccttggcaggctttacgttatttgcatagaaagcatcaaagctgtccacctgattgttctgtgtataatactccagaacataagagatctcctcaggggtaagcactgactgtgttttctttggctctccgccgagcttgccaagacactcgataaggtcgttatttgtaactttcagatccttagccatatcgctaagcttatatttagttgttttcatactcataggctgtaaaatacctcctcaataaatgctaaatgctataaaactcattttcgtctatagggatctcctcaagccctttggcgcaagcctttgcgaagcctccctcgcaaatagcgataacgcctgttcttttgccaaggccaaaatggatatcgtccattgtcatgccaaggctgtaaagctttatcccgtttttgtagcagttgaactttatctctttaagagatttaggtgaaaaatccgttgccgcaaacactgcgcaggctttgcctgtattgcaggcgtccttcaccatatccatacccattacaagctttcctgcttttctgcacattgtaacaagccctattttattattcattttccctaagctcgccctccatgctgttatatatatcctcgcttatcatgcaggaaaagcttctttcaaactttcttgcttttcttgctttctcaaagcattcgacgcttttgcatatataagcgcctctgcctgattttttgcctgtgaggtcaagggagatatccccctcttttgacttcaccactctgataagctctctcttgggtttcatttcaccgcacccaagacacattctcattggtatcttcttagttttcatcatcagcagcctcagcctttgcagagctttcggatacgatatctattttatagcctgtcagacctgcggcaagctttgcgttctgacccttattaccgatagcaagtgagagctggttatctggaacagtaacacggcactctcttacgccctcctcttcgctgagaacaacgtttattacctcagccggagcaagagcctttgcgataaactgtgcagggtcttcgcaccaattgataacgtctatcttctcgcccttaagctcgttcacaacagaagttattcttgactttctaggaccgatacaagcgcctacggcgtcaacattagggtcctttgaataaaccgctatcttgcttcttgcgcctgcaactcttgaaatagcctttacttcaacagtgccgtctgctatctcaggaacttcaagctcaaaaagtcttttaacaagctctctgtgagttcttgatatcttgatagaaggctttctgtcaggatttgcgatacccacaacatataccttgatgatatctcctgccttgagtgtttcgcctggtatctgctcgtttcttacaagataaacttcgttcttgtcgatagtaagtatagcgttctgagtagcaggctcgaccttctggactgtggcagaaacgcactcatgctccttatcgtgatactgctcgataagtcttgctctttcaaaatccttgatatcgtgcttgatagactgctttgcattctgagcggcaactctgccgaactttgcagggtcgagaggtatctccaccatatcgcccaccttgatgttagggtcatagacctttgcttcgtcaaggaagatctcgttgtcagggtcgtcaacatacataacgtccataacttccttgagtatccttatatcgagctttcctgtaacagggtcgatatccactctgatattctcacagtaaggataatccttcttgatagccttttcgatacctgattttattttctcaataagtatatcgctgccaatattattttccttttccaaatccgtcagagcttcaaaaaatttgctggtcatttccttattcattttctgatcaatcctttcacacttgattcgggctttgcccatatttattaaatttcttcattcagaacaggtctgcgtcatcattgagctttacataagcacaatctgcaagcttgaactctacattctccacgccgttcatatcctcgtccagcttctgacaaagtatcttatccttgtcatatcccacaagacccacaacgaactctttttcaccgttttcgtcaggtcttatgagccttactcttataacgtcgcctatgcagacctcaaaatgctcgggtcttctaagctctctgccaagtccgggacttccgcactccagcacatagctctgagatatagggtcagcctcgtcaagcaccttgttcatcggtcttgtgaaagcctcgcaatcgtccatatctatgccgccgtccttgtcgataagcaccctgaggtaccacgttgctccctccttttcaaaccttacgtcccaaaggaaaaagccaagctcgtctgcgataggctgtgcaagctctcttactttttctaccgtagttttctttacttccatacagcacctccgttaatgcttcccaaagcaaagtcatcaggctttgccatgaaaaaaagccccatacaaaaccaaaagaccggaagtcaagttccagtctttcattaaaagcctattgtgattattataccacacaaaacagttttttgcaaggacattcaaaagtttttaatgaaaagaattaaatattatgttaatagtctgtaaacatttcgtcaactgacgttcttttcattctcctcagggatatccttaggttttgctttttctttatccacgggtttcttcactgttccctcgacgaaatccagcggaacggtgaacattattcccgtattgggctgagatagatcgcccacagtattataaactatctttcgtgcggtatcgagctgattattttttattaccgacaggatagttctgttatcctcgtcgccgctgaaaagtcctcggatagaggcgctgagaaagctgctgtcaagtcttgaaagggtcattgccatacctgacgactcgattatagtcgcaccctttatgcctgctgctgaaagtccctccagcaaatagtcaagcacgtctgttttattaaggattatgaccagaagtttcacgttatatcgccccctgttaaaatttcagcctttacgtttttacttctcagctgctgacggtgcagtatctttgagcattgtctgaacgctctccttgaacttatcagacaccttaaagtgagaatcgtccgtccactcgccctccggcacaagagcttctgcaggagtaaggttctgatccagcatatccttgagatacgacttttcttccttatactgtgcacttgtccaatcggtatcgctgtttgcggtgaatatattatagaagttatcaagattatccttagtgatattcgtctgctggaaagcgttgtttataagcattgtcaccgcagttccaagaaacttcatattaccattcctgccctctttgaaaacaggatactgacagataagtcttatctgatgaccgctgaggttagtcagatcgccgcttgggatagcgatatcgttctcgtcattatcctgagagagatagtaaagctcctcatcaggagtatatgtaattccgccaacaatatccgccgcattctcgaatgcgtcatttgtgagagaaacgtaattgtctatagtgataccgaaagtgtctgcaacggctgcttcaagcttcaccatgccgccctcttcatgtatctcacgcattgtctggcttccgctcactgtgaacgctgaaacaggcattatgattatcttctttgcgtccggtgcaactcttatgactgttgcgtctgcaagaacacccttgctgttcactcttgcaaaaagggtattataaaccgggctttttatgcctgcgtcgctgtcgctgtcatcattgccgataacaccaaactctcttagggcatacagtgcaagcatgccgataacaaagaggaatattatcatcgttatgaagtagaccagagcgataggagcctgagatcttctttttttcttgtgagctttcgtctgagccatgttattgatctccttactttcaaatatatacaggcaggcatactgtccgccatattttcatatataaactttttcggaaaaattctcgaaaactattgaacaatttgcaatttaggtgtaaactaaataggacggctgtctgagtctgagtcgatataaaaaacaggattatcgtcaaggcatatgatgttcagcgtaaggcctgcacgctttgccatgtttatggtctgcaaagtgcctgagcctttggctttctcttttatgaccccgatcacacgagaggaatgttcaaccataaagctgtttcgctttttataacagccgctttcatacttagggcttgttatcacgaccgcactgcaagagttcagaataagcgaatatgtatagctgtccaagggtgttttcatctctgtacgctggcctgcatagggcagaacgcacacgagcttcatatccttatattcgggctgagccgaaaggctgtggactatctcagcacagcgcaggtcgataccttttgacatacctgatataaaagtacggcagccttcgctatatgcttcctttatcataaggacgagcatactcaggagatttttcataccctgcttatggacatcgccgccgaaaggcagatccctgtccctatgacctgtaaagcagcaagaggtatctcggttgcagaaaaattcttctgcggggacgatattactcacatcaaagcctcctgaaagatttggcgacacaatgcccatgataagaacattataacacattgatttatctttttcaatagaaaatgacaaatattttgtgcaaaggcacaattataaaaccgaaagggaagaaaaataaaatggattttttgaagagagcatgggctgaggtagatcttgacagcattgaatacaatctgaaagaataccgcaggctcataggggaaaaaacagagataatgtgcgttgtaaaggcgagctgctacggacattttgacaacggggtagttccgtttcttgaaaacgaaatggacattcgctggtttgcggtatccaacatacacgaagcccacaggctcagggatatgggcataaagggcgagatactcattttgggctacacacctcctgagaatgctaagtggctcacaaagcttgacatcattcaggcttgcacagagctttcatatgctaaagcactttcagaaaacgctgacggcaaggtacgcatacacgccgctatagacacgggcatgacgaggataggtcttcacggggaaaccgacaagatatacggcgagcttaaagagatatcaaagcttgaaaacatttcgctggagggcattttcacccactatgcggtggctgacagcctgagagagcaggacgaggaatacacaaaggcgcagacggagaagatacttgccgttgctgacaaatgcgaagcagaggggcttcaccttgaaaaagtgcattttctcaactcagccggcggagtatactattataatgagagaagctctcttgcaaggcttggaataatactttacggactttatcctgaccctgcaaaggctctgccttttgagccaaagcctgctatggaatttaaggcggctgttgcgcaggtaaaatacatagacaatggcactgacgtaagctacggcaggacttacactgcaaacggcaaagtaaagctcgcaactgttacggcaggctatgcagacggatatcccagggcgctttcaaacaagggatatgtgcttatcaacggaaagaaatgccctatcacaggcaggatatgtatggatcagttcatgtgtgatgtaactgaggtagaggacgtaaaggctggtgacgaggctgtcctcataggcgcacagggaaatgaaaagataaccgctgacgatatcggcaaaatgacaggaacgataggctacgagatagtttgcggaatatctgcaagagttccgagagttatctcacgccacggagagcagacggctgttcttgaaatagagtaagggaggataaagagccatgataagatttttcggcggcagggtaatgacccttgccaacggcatagaaacgcaggatatagaggtctggacggaaggttcaaagatagttttcgttggcaagcctaaggctgaggagcttgacggaaaggtttttgaacgtgaatatgacctcaagggaaatctccttatgccgtcattcaaaaatgcgcacactcactcggcaatgacttttctgcgatcatatgctgacgatatgcctttgcaggactggcttttcaagcagatctttccaatggaagcaaagctggacggtgagaaagtttactggctcacgaagcttgctatacttgaatatctcacaacaggctgtacggcggcatttgatatgtactttgagcttgacgattatgtaaaagcctgcatagaaagcggcttccgctctgtgctttgcggtgcagtgagcggtgacaagtctaatcttgaaaggcttgaaaacaactatctgaaatacaacaatgttgaccctcttataagctttatgcttggcttccatgcagaatacacctgcgaaaaggagcttatggaaggcgttggcaagcttgcggcaaaatacaaagcgcctgttgcaatgcacaactcggaaactgcaaaagaagttagagagtgcatagagaaatatggcatgacgccaactgagctttttgacagcttcggaattttcgactttggcggtgcaggcttccactgcgttcacatgagcgacaaggaccttgagatattcaaaaacaagggcgtatgggctgttcactgtgcaggctctaacgtaaagcttgcaagcggcattgcgcctatcgtaaaaatgcaggatatgggcataaacattgctatcggtactgacggtcctgcaagcaacaactgtcttgatatgttcagagaaatgttccttatgacaggcttgcagaagatagcttgcgatgatgcttctgcctgccctgctgactcggtgctgaaagcggcaactgtaggctctgcaagggcaatggggctttctgactgcgacattatcgcagagggcaagcaggctgaccttatcgttatcgacctttttcagcctaatatgcagcctctcaacaacattggcaagaaccttgtttacagcggctcaaagcagaacgtaaagctcactatgtgtgctggaaaggtgctttacgaggacggcgagtttaagataggcgaagaacctgcggtcatttacaagaaagctaacgagataatcgagagcatgaaagattaaatgtaggggcggccttgggtcgcctttatcttttacgcaaacactgtgttgacacacaaaaaagggacgctttgaaacgtccctttttacattatattctattcttcaaagaaaaatgcttcgtttgcaggatagtctgtttcgtccgtgagagttaccactgcacagccatttgagctttcgtcctttttgccgaatatctgatctctgaaaagccagaaaacgtcaacgcagataacagcaagtataagaatgataagtattatcggcacaagtgcgcctgcaccctttccaggtgtaacgccgttcatttgattcatctgatttggctggataggctgtccaccctgattcatctgtggcattgcattgttcacaggctgagcaggctgctgatagccctctggtgtaagaactctttcaggctgctgaggctgtggagcaacgtttggagtttcagcaactgtaggcgtctgaggtatttccacagttcttgaagccattgcaacttcctcggctgtcggctgtgcaggctgaacaggctttgcaggctcttgcccaggcagataaacgctgtccatagtcggcatatcaggagtcgttggcggaatagtctgattttgcacaggagtatcatcaaaatgcagctcaggcacttcgatagactccatttcaggatttctctcgtccactacaggctcgtcggcaggcgtttcgtcctgcggcacggctgttccgcagacgttgcagaacttagcccccgcattaagtgtatttccacacactgagcagaccttgctctttataagcttctgcggcattcttgttccgcaggcagcgcagaactttgcaccgtcggcaacaggcagaccgcattttggacaattttccatattaataccctcttttcatattattattgatcccctcagcccttttggctgagatcaaatttttcgataacttttccgaaaatataccagttgttttctattttgaccactgttatctcacggctggcagacagctcgccgctgtcagtagtctctgtgagctttgctgtcattgtaacagcttttttgatagtcacatttttgtgatagctttccttatagcttttttcaaggtctttcaagccgtcgctgtcaagctcttttttactgctgagcttataagaaagctccgttttttcctcgccccttgtgagaagcgtttccgcaagggcttcgttatagctgtcgctgtttttatactccgcctccgcttctggggtaaagcaggaaagatatgactgcgtatcgctatactgcgccgctgtgataagtgtcgccacgggctgttcatatcccaggacagctctttcttcctctccgcaggagcaaaagagcattgccacacacaaaagcatacacagcactgataattttttcattgtgcaaacaccgcattttcaaaaacgggcggaaaattctccgcccgttactgatcgtttatatatcttagaaacctgtgcttattggaaggtcgccctcgtccagaagaacccatgtgccgtccatctttccaacaatgacagttgtcttgtcggtcttgtcagcgtcttcgccttcgatagtatacttgatctttaccttataagcctttgtaagcttatacttcttagcctttttgctgctgagtattgacgcaacgtctgaaacttcgttatagctgtcgatatcgtctgagtctaccttagtctttttaactacctcatagcttatctcagcgtcatcgccgtatttctttgtaagtctgtctctctgcttttcagcctcttcgtcaaaatcctcgtcgcttatatcaatgataccgtccagagcgtctgccatatccttataataaggaggcataagctcttcaaaagccttaccgtcaccgtcattgagaacgtccataacgttattgataggagttttccagcttccgccgccgaatatcatgcaaaggataacaactaccagaataacaagcacgagcagaaccgccagaactgcgatagtgagcttattaggcttgtttttcagatttttgatgttttcaacagaaacagcgtcctttatagcgttcatgtcgatattcttggctgcctgctgaagatttgccattggtgaagcggtctgctgtgcaggctgctgaggtgctattgttgcaccgcactgagtgcagaaagtcgcattgtcattaagctgagctccgcactgtccacaaaattttgccatatgattatctctccatattcttgatatattttttgaagatacttacttcataataatatattaaactaaagtgtttgatttgtcaatagtttttcacaaagtttagcaaaaaagtacacatcatcagcccttttcgcacatttgttacatattattttgaaaaagctgttacaaaaccttaaagctgtttacctattcttataatgctttcagtgataagctttttgaaaaggggagcagccttgtctgcacattcctgaacttcagcatgagtgagaggattatccgtcatgcctgctgcaaggtttgcaacgcaggatattccgcagactttcatacctgcatgatttgcggcgatagcctcgcaggctgttgacattcccactgcgtcagcaccgatagttcttgccattcttatttccgcaggggactcgaaagacggtccggtaagctggagataaacgccatggcggagggttatattaagatcctccgctgcacctgagatgatatccctgagctttttgttatatatctcgctcatatcaggaaatcttgttccaagctcgtcgatgttcttgccgataagaggattaggaacaaagcttgagatatggtcggttataagcatgaagtcgcctgccttgaagcctgcgttcactccgcccgatgcgtttgtgaggaagagcacctttgcgcccaacattctcataagtcttgcaggaagcacaacgtcctccattgcatatccctcataataatgcactctgccctgcattataacaacaggcacttcgccaacatatccgaaaacgaactgacccttatgaccctctaccgttgatgtagggaagccctctatatccttatagctgagggtatatttcacgtctatggaatttgcataatcgccaagacctgagccaagcacaagggctacttttggctcaaagtctattttgctttttacgcactcataacattttgtaagcttttcataagctgtcataaaatttcctcctatcaatcctcaccaagcttcaacgcctgacttatctttatcttctttataagtctgccaagcaccacaaaggctgtgagcagcattactcctataactgcataaagcttcagatagtcgctgcgttcaggtatcactgcaaacggcggcactgactggcttgcgtcgaagatgctctggaacagcggtacgaaaaggtcgctggttatgccgccgataaagatagcggcgaatattgcaacgcctgacaccaaaagctgttcatagactatcatcattattatctctctgaacttcattcccattgctcttaggataccaaactgcaaagtcctgctctttatggagagtatccaatagataaggaaacctattatgcacatcaccatgatgatgataaagccgagagtgagagcgccgttcatgccctggagcatagggtcgtttttcttttctatggtcttctggcttgcagattcaagggtgaggggtttaatgcctgctttgtctattgagtcataaaactcctgaacggaagctccgtctttgagcttgaaccatacctcataaggctccatgcttgtctgaacgttcacataatcgtagttcataacggcaaagtccatataaccgccgtttttcgcctctttataagggcttagtcccggccagtagtcaacaaaggcaaggacggtcacttcaaagggctcgtttccgccccacttacactctacagtatcaccaagctccagaccatagctcttgaagcttgaagagaggataactcccggggtgtactctgcgagggcgttcaggtagttatttaactgaactggcagaagtctgtcctcaaatttgcagacctttgagaaatcgcttggcactatggtcataagctggacattgcttgttgagcttttgcctgagcttgtgtcaacgctttggtcaaggaaatcgtcacgggtcttttcctcatcgtcagactttgtctgctgtcttggaacgttcattttgtttgaagatatggtcacgtcgtcttttctgaaaacctttgtgacattttccactcctgcgagcttttcaaatcgctcaaaaacaggctctacatactgtatggtagtttctgtatcttcctcgtcgctttcttcggaagtctgctttgtgcctgattgagctgtctgagatgcgctttgaggagtggtctgctgtgcagattctattttactgctataccactgctctgtaagaacagcgtcgcagccaaccccataggcaacgctttcctcggcatttctgttcaaggctcttgcggtatttgcaaagaacacgcccaatgatacagtaagaacaaggaacagcatcaaaaatctttccctgcccgttgatgagcgacctatattagtcagtgaaacatactgtgcaggcgaccacactcttctgcctattcttgcgagaagccttattatataaggatatatccttataagaaacagaccaaggccaagtataaaggcagtggaagccacgaacattatagggtttactgttgcggtggtgtctgttacaccctctgcaacaagcttttcctgagttttgttgtaataataaagccagccaactgaaccgcccacaaggataaaatcaaggcagaccttttcccacagagcgtgctttttctttttggcttttgactgcttatgctcaacaatagttgtttttgtggcaggaaagatcggtatcatagttgtgacaaagaacactgccacggctattgccgcatagacgacagcttctattgtcatatgaacagggagcgaacgcctgttgacaaactccaagaatccgtttgacgcaccaagtaccttgcaaagtccaagacctgcgaatggtcctattataacggtcagaacgcccagtacgagagattccagagcataaatgcccattatctgcaagcggcttgctccacggcttttgaacaccgctatctcgttacgctcctgctcaacgttgagctgcgacaccataaagagatagaatattatcataagtatgacaggtatctgcaaaaaccacaaaacaagctggagctgtgatgaacggctctcatagtccttgaggatatctgaggcaggcatcgaaaagcctatggaattatcaccaaaataggtcttttgctttgctatcatctcatttgtgcttgcaaggtcagtcatattcatggaagcataatccaccgcatagttatggacagcctttgtgatattcacaacgccagtatcaacgcaatccccgagcattgtgtcataatctgtaaagacaacggctgtatactgagaatcaagaccctctgcccaatatgcgtcattttcgtccttaacgtcaaaaacgcccacgatctctatttttattgacttgttatcatcaaacacgtcggctatctcatatactgtgtttatagcaagctctgtgcttttcatggctttttctgtggcaacgcactcgtaaacgccgtctgaacgcttgcctgcagtgaacattctgccctgctttatgctgatatggtcggaaatatccgtcataccgccgagagtgaatcttgcctgcgaattgccatctgaaacggcaagtgaacgcacatagagatactcgtcacttatatacttcttatcaagcttttcaggcagaccaagctccttgaacttagcctccactttgttattataattctcaacagctttctgctgctcactgcctgagatatccattttcaatccatagctagtattatacgcaccggggtagatatcatattctgtctggaacgactcaagatcctttacaagcattctttgcagagaagcgttcatataaatagggatagtgctcatcatggcagacgccataacaaagcctatcagcaggcaaagcaccatccatttggtgtttcgcattttacggaacaataaggtgaacataagcttatcctttcaaacctatctgataacaatttcgtcgccctctttaagacccgactttatctcggtctgagagcctgtagaaagtcctgtttccacttcaacggcagttttttcaccgtttttcagcacataaactacctttgtgccgtcaaccttttttatcagattatttgatataacgatagcgtcctttacgctgtcaaggacaagtatcgtatctgcaagctgacccactgtttccgcaggggcggtatccttgaaacgaacatagatagtatccgcctgataatctatacctgtatcgtcaacattattgtgatcctctttctgctcttcctgataatcagcaagctttttaggagtcataaaaacaacaccgtcataataatcctcgcctatccttatctgcacttctgtgtcgatatcatactgggtgaggtcgtcaggctgtattgcgatataaagagccgaagtatctataacagttgcgatagtctgacccggatttacgttgtcgcctgctcttacgtcagagagtgacgaaacaacgccgtctataggcgatttcaggcttgaatcctccttctgagcctgaagcttttcaagctctttttcaagaagctgaacgtcaacataagcagagtctatctctgcctgggagccgccgccttcataaattatatcaacattaagctttgctttttcgagataaagctgtttttcttctatctgatagtcaaggtcatatgtatcaaggtcacagataacatcaccctttttgaccttatcgcctgcttttacataaaattttgacactgtgccactctgcttttcataagaaagagtatactgattttccgctgtgacagtgcccgttgcgactatcttcttttcaaggtcttttttctttgccgtcactgtggaatatgtaacatcgcttgccttcacggtcggcgcatcgaggacttcctcctcgtcaggaagcagatagcaaccccctgcggagaggcacattatcgctgatactgcggcagcaaaaagcttttttaaatcaacttttatattcatgttcagactcctaactgaatatttttataaacaacttaccatgggcaataatacccaaagtaattatatcaaaaaaaagatgttttttctatacacgattgtactaaattaacctgacatttcaaagcaatatgcacaattgcgttgctttatatatgtacaaatttaataagtcttaaatatatgaacataaaaaagggcttcacgcaaaaaaagtcccgcaccgaagtgcaggacttttgataagcttatttgcaaattagtttgcaagacctgatctttcaacaccctcgataaagtatctctggagaaatacatacataataaggataggtgtgatagaaagcagacaacctgcttcaagccatacgattatctgtcttacagataccgcctgaccgtcgaagagctgctgagtcaggtttgtattcaggttcttcagcataagagcaacagtgtcgttctgtgtgaagaatgatgatgatacatagtagtcgttccaataccaaacgatagagaacaggaatactgtcaggaacgatgactttgcgttaggacacatgataacaaggaatgttttcagtgggctgcagccgtcgaggtatgcagcatcttcaagctccttaggaagtcctctgaagaactgacggaagatgaagataaacagacctgcacggagtccgtttgcaaacaatgcaggaagatacattgtccaaccgctgttgataagcgatgttgatttgccaagtgtgaataccttagcgagccacgctggcttgaagtaagcatactggaggtaaagtgggatagttgtgatctgtggaggtacgatgatcataagaacaacgataccgaacaggattcccttacctttgaacttaaatctagcgaagccgtagcctgtgatagagcaggtgataacctgaaggacagaggccacgaggttaaggataacggtgtttacaacagtatcttcaaacttcattactccccaaacgtccttgatgttatcaagtgtgaagctcttagggatccaaactactgatgggtcgttcatctgctcatttggtctgaacgcagttgaaagcatgaatatcagtggatagaggattacgaagcacagaccaaacaggataaggaacctgaagaacggccaaaccattccgatcgctcttcttcttctgttatagctgatctgctcaggggtgagatatttctcaagaccctcctctttcatcttcttataacgggctttaatagcagcctttcgttctttttcgaactctttttcttcttttttagttgccacttaaatccccccttattctacttcatagtaaacgaacttattaacaagtgctacgacaagtgcaaggaatactgctacgataaggaagtatgcccaagccattgccgctgagtagccatgctcccagttgcttgccttgttaagaacgatcgtcataacttcgttctgtggatcgacgaatgagtcaacgattgtataaaccacgcttgaaagtatcattgggctgatataaggaattgtgactttccagaagaactcccatgaagttgcaccctcgatctgggctgcttccttagctgagagcgggataccctgaagtgctgaaagcaccagaagtatctggatacctgagttccatacaaggttcaggatgtcggtggtcagcgagtttattatcatagtgagcttatcactgatgttgtagataccgaggaagttcagcaactggtcaacgaggtcagcctcgaacattgagctgaactgctcagatccgcctgcgtatccgcctgtgctcatgttaccgttgatgatgtcgataacaggacctgtagcgatgataacagggaggaagaatactgatcttgcgaatgttcttcccttgaatttctgattaaggataactgcgataaagatagagaatatgaggataagaggagttctcaaaaccgtattctcgatcattgccaccagagccttggaataatcctgatccttacggaaagcgtttacatagtttttccaaccgataaaggacattttcattccgccctgagttacctcagttttgttgaatgagtaaatgagagattctataagaggcaggataaagaagtagatagtacccagcgcccagatcgctataaatccgtagccgtaaagtccttttcttttttcataagaaagtctgtgcttcttttccttcatcacaggtgcaggagcgactgcctcagcggcaggctcttctgcgattatctcctctgttgaaatttcttctgtaacagcctcagcgtcattttccttttcgactgtatcttcaagatcctcagccttaacagcctcgatctcttcaggagtgtttttgatctcttcgctcattattctgtcaaacctccttctatacaatctgcaaggtcatagacctctgtgcctacggtagctgttgcgttcttcttatcaacactgataacaacgtctgaagctccgtcctttgaataagttgtggtaagaacgttcttgtcatcgctcagctcatactttgtgatcgtataatctgaaacgcctgaaagtatgctgcttacctttttgtactgattagccgcaagatctgtccagcctgcatagtttgaataatacaggtcgtcatattctgtatcctgaagcgtatcagcgtcagcgtatgtcatatcatagtgtatctgtgagcctgaagccagtgaaagcaggaatgtttcatctgaatttgagctcttattgataggtgttgaagcgtagtcaacatatccgtgaatgaccatctgatagaacgggatatcgaaatctgttacgttgaatccactggagtaaacaggaacgtttgaaacgtttgttacatatgggagaacgtaagagttcgcaccgtctgcgaatactgtacttatcttctcgctcgcactcttatagccgtcaacgacagtattcatggtcttgcttctgcttgaaggatccttctttgaatagtcagaaacaagctttgttgaataatcaccgaagccgatagaagtgagcttttcatcagtatagctctcgagcatttctgtgaacacattcgagtacttgtttggtgtgagcagagcaggtgaaactcccttttctgcaacaccgaaggccgggctgtatgatgactgtcttgaataagcatttgaaactctgatagctgtgcttgtaagagtcatatatccccatgaaccactgtccatcttgaagttgttcattgaaggaacgatcttcatattatcgtcctttgagataagcttatcgaatgcgcttgaaccaccaagcttgccggacggagatacctctgtggatatcttgttcttgatagagtcatttgtccagtcattatagttgacagttatgttgtcaactccgccgtccttgaggatatcaagtatgtcggaagcctgatcgaagccagtgatctctgttttaagattgaatgggataccgagaatagaagtatccttcataacgccgccataaaggtcaacgtaaagatcgctcttatttgcctgagccttagctgtaagacccctattattgataaggtagtttctgtagacctcagcgcagtcagcgtagttaagatcctcgccgttgtctgaatcaacaggataataacgaactccaaatctctcggtctttattccgttcttctcgaacactgtgatcttgtttgagttatcaccgctcatgaagaatgagtctgagcttcttgtttcaaactcgaagtaacaagtgttgtaagcctgcttttcctgtccgcatacctgagcgtgagcataaacgtttgactcaccgtcagaagcaacgcaaacaagtccagatgaaccgcttactgttgcaaggaccggcatataagcctgctgagtggttcttggagctgttattggaacggctgtataatctctgccgaatacctgctgattatagtcagcgtactcggtcttgccgttgttgtagtttattacagcaccgcttccgtcaggaactatcatatagcctgtcgcagttgaatcagcagcgccgaagttagggcagaactcgatctttgtaagcacctttccgtctacctgagaagtgtttttctcctcgatctcatctgaatcgcagtaaacatagaggttatcgtcctcaagaacatagtgtatcttgagcttcacaccatcagaaacgtagttatatgtagcaacaacgccgtctgaatttttctcccattttacttttgccttgttggaataaaccggagcaggggactctgttctcttttcctgtctaaggtcaccgactctgatagcggcacttgcagcgatctgctttctctgggcatttttcattgctgtgcccttaactgtgtcgataattgtctggtcagcctgaacatttataggcgaagtccaccaatacttacctgaagcctttacataaagacaaagtctttcgttttcttcgtcaagataaagagctatcttgtcgttctctgttatcttttcgcacattgcaagagcttcttcgtcagttataggctgaacctcgtcgtccttgcttgctgtagtagttgttttctcatcggctgctgagtcttcagcaactttatcgctgctttcatcggcagtagctgctgcgtcggaagcgtcagctgagcttgtatcatcagccgctgaatcgacactgctgtcagtatcctttactgcggcgcttgaatcagcctggcttgaactctcgtcagtggaagaaaccaccattgaccccagaggcatcagcattgtaaggcagatagcaaagacaactgctttcttgtaacttttgttatgcatttattatttacaccaccgtttctgttttagcctctgatcctgtacatgatctcagtataaactgagtaaccgaatacatatacctgctggaacaatgaaaggagaagtatcgcaaggaacaatataagaagcattgcgatgatcgtaccaataattgaagcaagtgtttttccgaatgaatactggtgaacggctctcattgcctgcaccataaggataacagaccagccgatgccaagatactggatagctgtgatccaaatcgactcgtcctgtaccagaacgtttgagaagatcactgcgataaatgtgcaaacgatgtaaggaacaagagaatatgcagaatagatgcagatctttttaagtgtaccttcaccgtcgagaagtgtgcatattgcccagttgccgagtacccaagtgaagaagtaaactacagactgaacgataagcggaacaacgttgaatactttaacgtagctgtcattgaactggaagcctgtgagctgtctgtcaacgaccattgcaataaagaggaagagaactatgagcatcgatattttcattgagccttgtttcttccatctcaggtcctcaaagccctcaacagggtggaaaacacaatgcttgagccaacctaccggagtaaattcatacatatcagtttccctccttctttttgcgcttgatgagctttatgccctttttcttgagaactgcctttacgatgagcagagcgatcaaaacgataataactatcattatcactgtgaagttatctctgagccattcttctcttgcatatttgaatgccttatcgtaatcgtcctgatcgtaagctgttttgaagtaatcaagagccttcatatactcgccatcgttaaggcaagccttaccaagtccgacataagccattgcatagccgccgtctctctttataacttcttcccagtcagctcttgcgtctgagtatctaccctcgtcatagaggagaactgctctgtgaacgacattaccgaaagttgtttcagtataaactgtgatatcgttctttgttccgtcaaggatatagacctcgttgcctcttgcttcgatagcgtttggtccaaggaagcttcctgcctgatcagaagtggagttctttgtaccaaagatgcaaagaagattacagagcttatcatactggaacactctaccgttttcatagtcaagaacatttattgttccgttgtcagaaacgcagatatctgtaagtctgcacttataagttttatttgttgttgaatcatactctgaagcaacgtcaccaaatgaatactcatcgccgactgcgttatcccagatgttataacctgctgggttaagtttcttaacagcgtcggtcgtagtatttgcagcctcagtaacagtgtagataaatccgtctgcgtcgatatcgaagtttgcatactcgacaggaacgtttcttgtcattgctgagatctgctcgtttgaagcgatctttctccacagcttctgagcgataacggcagctgttacctcaactcggttcgcaccgtagaatccctggaactcgccgtccttattgaactgaacagaacctgtgtttactgacttacaaacaacgtagatattctctgccttatctgcaagtatctttgaagggttgaatgtttcggaatcataaagctttgtgtcaggctttgtgtattcctgcaccagagtcatttctgtgcctgactcaacagtacacttaacagcccttgaattgtctgtatctgcgatgtaaacataaagcttatcatcaaagatgctctttttgacatatatgccgttaggattaaggaaggtcgatcttccgtcctcgcctacagatatttctgtagagcctgtgaatccggtataacagcctgttaccttaagatcagtatcaagacggagtattctgttgttgcctgaatcgcacacccagaaagtatcgttgtcctgatcgtaaaagaggtcttttgcatctgagagctttgcaggagcgtcatcgcttatataaagcgggtcgctcggatctgaaagcctgtcaagacccatatctgcacctgttacagtcttttctacacggtaggcactctgcgatgggatcgcatcgtcccaatagtcgtagttataggctgtataaggctcatctgcgaaagcagtcacggtcatggtcagcgccagacctgctgcaagtgccgcagagatcattcgttttagagagattttatttctcgacactacttatcaccttttttccttttctataatctaagttcaaattaatccttcatacctgagttagccattgtttccatgacgttgccctgagctacaaggaatacgatcagtggtggtatcagaagtacaactgctgcggcaaatgtaacgccctgacgagcaagacctgctgctgtgatctgctgtacaactgtaggtagtgttttgagctgctcggagtagataagtgctccgccctgaatgttccatgctccctggaaagcgaagatgataagtgtcatcaaagctggctttgagtttggaacgacgatctgccaacagatcctgaacagacctgcgccgtccaccttagccgcttccaccatggagtcgtggatggttgtcatgctctgacgcatgaggtaaagacccattgatgttgaaatgcttgggaggatcaatgcccagtatgtatcgatcatatggagcttagccattacgaggaactgcatgatccatgttgcatttgaggagaacaggagggcaataacgatgatctggttaatgaccttgtttcctgggaatttacactttgcaagaacgaatgctgcgcagcagcaaacgaaaaggttgcagatacaaattactattgtaataaagaagctgttgaagatatatcttgacagcggtacctgccatgagcttgcggctaccttgaacatatctgagaagttgttggtagtcggattcagtacataaagctttggagggaacacgaacagctcctcaacaggcttcatagactggataactgagtaatacagcgggaacaccatgaatgcaccaaggagacagaggaatacgaaaataactatatctccgccaagagaaccattgactctcgcctttttctctttgaccttcagcttttcaatagactgctgcttttttctttttctagccattttatatactcccctcctttagtcaagatacttgcctaagagccagttgatacccttattggcaaggagcattgcagcgaacaatacgaaacatattgctgacgcataacccatttcgtaacgaatgttaccatagtctgttgcgtggttcatgatcgtgtgagctgcatagtctgttgaaggcagacctacgaggttctgaccaacaacaccgactgtgaacgatgctgagatctggataacggcagcgaacagaagctgtggtcccattgaagggatagtgatgtagaaaagctcctgccatctgttcttgataccctcgatagcacctgcttcgtacattgacttatcaatgttctggaagcctgcacggatagcaaggaagcctgcacccattgacatccaaagctgaacgatgataacaactgtaaggatatagtttgtatctgtgagccactgtgcaggttcgttcaggatacccagatcgataagcacagcgttcaggtaaccgtaggagtcacctgacaggataagctgccaggtaacatatacggaagttgtcatagaaggtgcatagaacacgaatgtgaagaaggttttgaggaatgcgttcatctcgtttatcagccaagcaatgataaagctgaggatataagagaacggtcctgtgaatatcgcaaagataagagtgtttcttactgcgataaggaatacgtcgtcgttaaggaacagcgtatagaaatttgaaagtcctacgaacttaggagtttcgatcatgttaaagtttgtaaagcccattggcagcgacattacgacaggcactaccgtgaagataatgaacaaagacatgaaaggcaggagcattgcatagcaagccttgttggttttcatcatgtgccatgtgtacttccacttgccctgttttatcataggcgcttcaggattggttttggccattagttactcccctttcattaattgtcgtacagaccaagatcttcaagcttacgagtgatctcgtcattgatatccttattgtaccagaacagtgtatcacgagcgttgtcgtagtcattaactacagctctgaatgcgttcataacgtttcttgttacaccgtaagatgcaggaatgatcgggatctctacctgtgaattaagctggtcaagaagaagatttacttctgaagttgtccaagacaactgctgaagagcttcttcgttagctgttgcatatctacccattgtaccaaggatagactcgatgttgttaccatacttgacctgagcgtcagttgaggtgaaccacttgatgaagtcccaagcgccctcctgatctgctgcctttgtgaagataatagcacctgaaccattggagtttgctgcatggttgatagttccgtcttcctgaacagtaccaggaactggctggaatccccagcagcccttgatctcaggagcggctacagaaagctggttatagaatgtgtagttctggataactactggcatatcacctgttctgaaacgtgtgaatgcgtcatatgtctgctggaagctgtatgttgtatagaactttgtccaagtatcgaaagcgtttacggcttcctgagtatcgaatgttgtctttgtctgctcttcgttgtagtagttaagaccctgctggagaaggagcatagcgaatgtgttaccaggctctgtgatagcagatacctgagttgttccgcctgtacttgtcattacagggaggataagaccaacttcaaggtagtttctctgaagtgttggcagacagttaagaagtccgtcccaagtattaagatctgttgctgggtcgatatcgtactcgctgaggatatcagaacgatagaacagcattgggaaggtctggtcacatggaagaccgtatgtaccgccgttgtactgataaagaacagtagcgtcgtctgcaaaacgtgactttacctcgtcaaagtcgctgaatgtggtgagatctgtaagaacgccacgggctgcaagctggatagggaagtcgccgcccatgaagagagcgaggtcaggacccttgcctgcaaatgtggcctcaacgataccaccctgaacgagcttaagattgatctttgttttagctgttggattgtattcacttgaaatgagctgctggagagcctcagcgttatcacgaccgagcattacccagcactccatagcgctttcgtcctcatcggacagtgcgttgtagtcctcaaagaatgaaccgataaagcccttgaagccgaagccaagtgatccaaagaatgacttgtcacatgaagtgaaatcctgatcggaagtagctacctcgatcatatcgacctcaagaggctgctcacgatactggtttacgaaagaagaaaccgatgtgatgttatccttgatctgtgacatcatctcagggataaggtcaggcttctttatacacttatcaagaacgatagccattttctcaagagtttcagcctcagttccgcctgaacctgaaagcttctcgatctcagccttcttatctctcaatgtcttagcatattccttgaaatcaggaacgatagaaggaatggctgtgtcgatcatgtagttgttgtattcatcaggatcaggacctgtgatctgtctgatctgtctatagtagctgtttatgttataaacaagctcgtccagatcgcccatgatctcaccgatctcaccaggaactgcttccagagaaatagtgtttgtgcctgcctggaggtagaaataaagatcgtcgccattttcagactttggcgttgtgatgctccagtctgtatcgtagtagaactttatctgattagcttcaaggcaaggtacttcaccattgacataaagacgtctgttggagtacatacctctcatctgatcctgtctgcctcttatacctatcttatagtagccagccttgtcaacattgaactcccatgttactgtctgagttgactgcgtccagcttcctgaaccgatagtattatatcttgttttagtagggcttgagccgtttgcgctcgatgtgagataagagctcttatctgatgtaggataaagagttcttgatgacttgtaggcagcagtttcaccctcaagagtgaccttctgtccctgagcctgtgtcagatcgctgtctgatggtgctgtgtaagcagcaggtgcctcatactgatagaaagtaaagctcttgacagcaaactcagccttttcagattcaaatgttatcgtatgttcgcctgcctccatatagaactccaacggctcgttaaacagtccgtcgatgtcctccagaggagtttcctgccagcatggagtcgatatctgtccaggacggatatcgttctgtcttgaatcctgtttgatctcagattcgttgatccatctcttgctcagcgtgattcttgacgctgttgcatatgggctttcgccgtcgataagcaacgaaaactcaacgtcgtttgtgttgctttcaagtgcctcatatatcatcttgatattgtagacacctgtttcaggaatgttcaccgtccaagaaactgaaccctcctgatttgcccactgcataacatcattctctccatctactgtagttacagtgatctgagcgtctgttactgaagcaggatcgtaatcctttcccaagacctcgactgtctggtcaggtcttgcagcgtcggcatacttctttacatagttagtataagaagtctgacggatcgaatcggtacccgtcgtggcagcggagcttccgtcgcctgttgcagaatcatcagcagttgcctgcgtgcctagagtgctgtcgtccgccgcttcactgtctgcaaatgctggaactgatgcgcttgcacacagagcaagtgccaatgcggaagcaataacacgcctaaacattgtgtctttcactatgaatccacctttctaaataaattgcttttggttttgcgagaatcaagcctacttaattacattctaatataaatagtatagaacctcttcattatgtgatcccccacgggaaataaagaaaataaagcttacgtcccccccgatctgaacagcacaagcttttcgccgttctcatcaagttcgaccttgaccttatcgccgccttttatctcaagagcgtccataaagtccttcgggagttgcagccgtccagatctgtcgaggacgataagctcttcatgagccgtttcctcgctgttctcaaccagcacgatatctcccatttcattaagctcctccacataagaacgctttcttacgatctcagagcttgttcttccatctctgatagccaccactctgtcgatatgatcggcaagcttaaggtcatgggtaacgatcactatagtgatcttctcatctttattaagctccttgaatatatcaagtatcatattggaagtctttgtatccaccgagcctgtaggttcatcagccaacagtaatctcggatcgtttgccaatgcaatagcaattgcaactctttgctgttcgcctcccgacatctggtcgagcctgctgttttttcttttcagcagtcccactctgtcaagcagctccagtgctttctgccgtcttttatgctcgccgttgagcagcataggaagctcaacattctgtacagccgtaagatacggcacaagatttcttgcattattctgccacacaaagcctacggtgttccttttatactccatataatccttatcggtaaacttcagaagatccttaccgtccacataaaggtttcccgccgaaggcttatcaagtcctccaagcatattgagcagtgtggatttaccacttcctgagtttccgacgatcgccataagttctccacgctcgacatccaggtcaagtccttggagcgccaccacctcaacatcagaagttttgtagatcttcaccagattttcacaccgtatcatatatttatcattgtcggcagctacaatagtatcaagttcatcactcaactatctcaccgtcctctaatgtataaaccttatcagctatatctatcatgctggggtcgtgagtggtcattatgatagtcatctcatctctcgccaccagctctttgaaaagctttacaacgtggagcgcagttgccgtatcaagctcggcagtaggctcgtccgcaaaaattatgtcaggcttatgtgcgatagctcttgctatagcaactcgctgctgttcaccaccggacatttcccccggtcggtggaacattcgcttttcaagtcccacgcttcgcagacattcccttgtgcgcttatccctttcttcatatggatatttcgcaagtcttagaccaaagtcaacgttttcataagcggtcattcccgacatgagtgccacagattggaacacgaacgccattttataccgtcgtatatcatctctggctctttcagaaagccttgtaatatcccgtccgccaaacatgaccttgcccttcgttggcttgtcaagcgctccaagaatattgataagagtagtcttaccgcttcctgaacgtcctctaaggatcgtcagcttgcccttttctatttcaatgttgatatttttcagcgcattcacaacgcttccgtcgccgatcttaaagtcacggcacagatcttcagttgaaagtatagtgtccataccgcatggctcctttatcacatcaaacagggtcttcgccctcatcacatccactgtattggtcattttgacctatgtaatatactcaaacaaaaggttaaaatatttgtgcattattcacatatcgtgtcagaagcacacaacgaccacaacatattgtatttcttgtacaatatgttcaaatttcgggcgataaattatgcaaatcagcccacaattttatgtaaaatgccaaaatgggttcattcagctaatcttaattatatcaatttctctgtattttgtcaaggatgttaaacgtttaagataacataaaaacgaggcttgcggaggatttagtcaccttaaacaaactataaaatcattttttgtgcatttcgcaataaatcttgtcaaaaaaggttgaaaactctgtagccgtcaagattttagctttcaattaataataattttacattttgaagaataaaatccgaaaaatttctaccgatatgcacaaaaaacatttgatatatttatttaaaatatgcaaaagcaaaactgttcttaacattatgtaaaaggaggcaaaaaaaaactatacaaaaaggcatttgtgcaatttgaacctatagaaaaagccaaatatgaaagaaataagcctgcaatatgacgtaatattcccgtaaaaaacattaaacattgtcctatttatcatacagttttcacataaacaagtataatattagataacgaaacaagaaagccccacaagggggcggttaaaattgactaccacggctcacgccgctgacataccaggaggttttcatcatgaatgaatacggaaacaacaacttcaatgataacaataataacaattttgagaacagctatacacagcaaaacggatataatcaatatcaggctcaggcaggcagcgtgaatgagttcacatacaatcctaataagaaaaagtcaaagggcaagaaggtgctttcaggcattattgcagtgctttgcgttgcagctatcggaactacttccattgtaggctacaatcttgttacaggaaagaacgctgtaggctcttcaaacaacggcacagttgtttcaaaggacgacagctcatcaaacagtgcaaaaagcactgttgaccgttcaaatctgccaactatccagcagctctcaactccgtccgacgcactgactatccctgagatagtaaagaaggtctcaccttctgttgtaggcatctcctgtatcctttcaaacggcactgcaacaggttcaggtatcgtaatgagtgaggacggctacatcgtaaccaacgcacacgttgttgacggtgcacagtctatttcagttgtgcttcctgacagctacaacgatacttcaagcaaatcagatagcagcaaatcaagctctgacagcagctctgatgacgatgaggacaacctcacatacacagctactcttgtaggcaaagacactcagactgatattgcagttttgaagatagacgcaaagggacttacagccgctgagttcggcacatctgcagatcttcaggtaggtgaagcttctatcgtaataggcaacccacttggcttctcacttgcaaactctgtaacagcaggtataatctccgcaacagacagaacgctcactgttgaggacaggacaatgaatcttatccagacagacgcttctatcaacagcggtaactcaggtggaccactcatcaacgcatatggtcaggtaataggcatcacctctgcaaaggtatcatcatctgtgggcgagggacttgggtttgcaatccctatcgacgaggcgctccctattgttgaggaccttatgaagaacggttacgttacaggcagacctagccttggaatttcaggcacagacatcacaagcgcatattcatcatactacggtatcccacagggcttccttgtaaagagcgttactaagggaagcggctctgaaaaggctggtattcaggaaaatgatatcgttataggcataaacggaactgttatatcaaacatcagcgagctgaatgagataaagaacaagtgcaaagtcggtgacactgttcagcttactatatacagaaacaagaaaatgataaatgttgacgttgttctcggcgagtccacagaggacacttctgagtcaaatgacaacgaccagaacaacaataacaataataataacaataacaacgacgactacaacgattactatggaaactatggcaatggtcttggcggctataattacggctacggtttctaaataacaaagctttcttcatatttttcatattcttttacttcagggaaagagctgttccgagagatcgggacagcttttttcttgactttcttcttgacagagggtcaaagcagtgttattataataaggtatactattaaggcaaagcccgcctgacggtattgccttaaacgagtacacttctttattttgcaaaggtcggtgattttatgacaaaagaagaatatcttgacttttgcggctctattgcaggtgcgacatatgaccagcctttcaacgaggactttcagtccactgcactgcgccactgggacacgaaaaagtggttcgggcttttgatgctccacaatgacaggtggatagtaaacttaaagctaaaacccgaagaagtgctgttttacagggatatctacaagggcgtgacggaagcttatcacatgaacaaggtccactggataacattgtatctcgacagcgacgtgccaacagaggagatagaagatcttaccctcagaagctttgagcttacaaagagtaaagataaaaagaaaaccaaaaagcgaaaggaagctttataaaatgagaactttttcaaaatcaagcaagcttgataacgtgtgttatgatataagaggtcctgttatggacgaagcaaatgaaatgatagcaaagggagagaagatattcaagctcaatatcggaaaccctgctccgtttgcattcaatgcccctgacgagataatacaggcaatgacagacaatctgagaaacgctcagggctattccgactcaaagggcataacagaagcaagacaggctatttatgattatgcacactttaagggcatacctgttgaaagtcttaacgatatctacaccggaaacggtgtttccgagcttatcacaatggtaatgcagggtcttctcaacaacggcgacgaggtgcttgttcctgcccctgactatccgctgtggacagcttccgttactcttgcaggcggtactgccgttcactatatttgtgatgaaagctccgaatggtatcctgaccttgaagacatggaaaagaagataacagacaagacaaaggctatcgttatcatcaaccctaacaacccgacaggtgcggtatatccaaaagagatacttgaaaagatagcagacatggcaagacgtcatgagcttatcatattctcagacgagatatacgacagacttcttatggacggcgttgagcatacttctatcgcttcactttgccctgacgttttctgcatcactcttaacggactttcaaagtcacatcgtatcgcaggcttccgtgtaggctggatgacccttagcggtgataagagcagagtaaaaggctacatagagggtcttaatatgctttcaagcatgaggctttgttcaaatgtaccgagccagtatataatcaaatatgctcttggtgattacacaaaaactgacgatctgctcctgccggggggacgtatctacgatcagagagagtatatctacaacgcacttaacagcattgacggtctgtcggctgtaaagcctaaggcggcattctatatcttccctaagatagacgcaaagcgtttcaacatcacaaatgacgagcagttcgtgcttgattttctccgtgataagaagatacttcttgttcatggcggcggcttccactgggaacagcctgaccatttcaggatagtttatcttcctaagcttgaagatcttgaatactccatgaatgaaatgagagatttcctcaaagactacaagcagaaataaaactgtagagcggacagtgttcgcccaatatgcttttatgctcataccatacatctacaaacacagacacgaggtacaaaaatgtcaaaactttgcaaatcatgtggaaactattatgagggagatcactgcgacaagtgcggctatggcgacccaaacttaaagacccacgccgccgacaaatacaaaaagcccacaaagcctgaacgtttcaggacggaggaggaaaaagagctttacgccgagtgggaaaaggagaaaaaagaggacactgagataaagcgtcactatgatcccaacgcaggcaaaaagacccttgccattgtggcggtagttgttataggcgttatcgtggctgtgctatacaaaagcggagttattttcagctccacaaagacagaggtaatagaaaaatacttcaagtccatacagacaagcgatttcgactcattcgtggagtgctttccaaaagagatgaagaacgaatacgaacagcagcgaaccgaaggcggatatggcaaagagcaggtcatgaaagaagtcctttacggtgatttcattgaaagctatggttctgattacactattgacgtatctttcggaagagaaacaaagcttaaaaaatctgaatatgacctgagcgaatacaaaagcttttacggctctgcaccgaatgtttcagaggcttatgagatagtaacgaacgtgactttcaaaggctcaaagggcagtgaggacgcaaagctttacatctacgttggaaaatgcagcggaaaatggtgtattttcaatatcacgcaggataacggcattgttgacgaggacacggggcttaaaacttcagaaaattaaatagcacaaagcaaaaccgccacggagaaagatccgcagcggtttttttgttttgcgataaaacctatatggtgggacgtcgtatttctgtaaaacagaaattgagtcgctcccctacatataagtagggtaattatacgcttctatgtgatattatctcttcttaaaagcaaatgactttcttgttctctgctttccgcctattgacattgtgaatatcttgtcgctcatgaagattttcagtgcgacagtcatgcacactacaagaagtactatctgatagataagtccccctgcataaaagctgtagttgccaaacatcacgttctcgcttgccataaaagtatgggtgaacggtatagcatagacgatatactttataacaggtgaaagcgttctgatatcaactaccattgcaagaagatatgatatcattgcggagaaggttataggcaaaagcattgtctgggcagatttttcgtcttttgcaagtgctcctaataccatcgagagtgacaatgagataaggatagacacaaacatctgtattcccacaagaacatactgtccgatgctcatagtaaggccaaggttttccattgcagattcatatgctgaggtatctcccatgccctcagtaagaccgcctgtcattttgctcatgccgaacatatagaccacagcctgcaaagccgcaacaacacctgcggcaagcatttttgacgcaaggactgaaagtcttgaaacaggtgcggaaagaagcgtctcaagggtcttgtctattttctcggtagagatcgcgctaagtatcatctgagccgagaacattataagaacgaacattattataggcactaccatgctctgtgccgagcaaagggacatcactacagaactgctcaccttatctgacttatcgcccaccacggtggtctcagtcagctcaacagggtcttcaagctggttcatttcttcctctgtcattgcaccgcttgccagcttatcctgatagatagtggctttcaccgcctgctggataacagccagtgcggtatcagagcctgtgtttatatttgacattgttgccattgaggtcattctctgaacaaactcaacgtctgcttttttatgctgttttacctgctctgtaaagccctttgggattattacaacgctgtcctgatcgagccttttaagctctgcggcatagtcgtcagactttatatccacaactgttatcttgccgtccccagcctcggcagtagctttcagagagtttaaaacgctttctgtgaactctgttttgtcaaggtcgcagatagtaaggtcggaagccttttcggcactgtcgcttattgcccctgacattgcctgacctgccataacaagcaccactactgtgactatcattgttataatagtttgcaggctgagcatttcctttaattccttgcggaaaagactataaaacttcacggtcaagcaccaccctttcaaagacttcttcaaggttctgagcgccatatttttcaataagctccgcaggcttgccgacctccagcaactcaccctttgcaattataccaactctgtctgaaacatactctatttcaagcatattgtgggaagaaagcagaaagctcatgccctcagaagcaagctttcttatcattcttcttatttcaagggcatttatgatatcaagtcccgaagtcggctcgtcaaggatagccagtgcagggagcggcattatcgcccttgcaaggagaagctttcttgccataccacgggaataatttgatattttatcattaagcctgtcaccaagctcgcatatctcacagccacgcttaacaaactcgtaagcctgttctccgttgtcggcatagatagaagccatgaactccagatattctctgcctgtcatggtcttatacgcaccagcctcgtcagggaggtatgtaatgctttttcttaccatatcaggttcagtgagaatactatgacctgccacgatagcgtcgccctctgttgcctgcaaaagtgttgatatcattcttattgttgttgtctttcctgcaccgtttggacctatcagcgcaaatatctcgccctttccaacatcaaaagtgacgttatgggaggcgtaaatgccttttttgtactgctttgaaagccctttgacctgtaaaacagtttccatcgtttccccattcctttctttgtctgtatcattgtattttttttgtgaataaatcaagtatagcacaccacgttccaactgtcaattgacatttgtcatgtactgttatgtaaatatgatttactaacagtatacactgtctatggcacgatgtcaatagcggttttcaccaaaacaggcatgatttttattatttatgcgttataatataaaattcacttactttgtgagataaagtaaaccacgttacacaatgattacaaatcaaataatattctgtacattttcaactctttcaagtacgtttttttggatatcacaatgtaatgatttgattacattttggttacagacaagggtaaaaaaacggacgattgttgaaaactttataattttcaacaccaaattgctgttatagcatgagttttaaacattttcaacatagttttcaacattttcaaaagttttcaactgtagttttcaactgtccaaaaaagctcttgttaccgttttttaatcatttgtaatttattcatttttcgtacttctatagtaaatagggaggatttattacattttcaccaatgaacgaatttaaaatttgtgaagtatttaagttttaaaataggcttttgctgtttacaaatgaatgaaaatatgttaaacttataatgaatatgaatgaaaagttacaatattcattattggaggaaaaattatgggaaaattaactagcctgaagaaagccgccgctgtgctgctgacttcggtaacactcatgtcggctgcggcggcactgcctgctgtggacgaaacgccgcttctttcacagacggcgataactgttgaggcggcaagcgtcggaaaagtcacagggcttacttcaaaaacacttagcaacagcgagataaagcttagctggaaaaaggtcagcggagcttcgggatactcagtttgtatgagaaaaagcggtaaatatccgcagatcgcagacgtaaaaagtggctcgaccctcacatacactgtgaaaaatctgccaaatgctacccgtgaaaacttcaaggtaagagcctacaagaccgtgaaaggaaaaaaggtatacggcgcatattcaaacaactggaacaccgccacgaacccacagcctgcaaagggtcttaaagtatcaagcgtttcctataacagcgtaaagctttcatggacaaagataggatgcacaaattacagagtatttcagcttaaaaatggtcagtggaaagagatcgcgaagaccacaggcacaagctacactgtaaaaaatctcagccagaagaccacatacaagttcaagataagagcctgcaagacagacgacaagaaagccaaccactacggaaaatattccgcagaggtatccgctactacatctaaagctcctgctgttgtgacacctgtttcacagcatggtcagctttctgtaaagggtgcgaacattgttgacaagaacggcaaggtattcaagataaagggtatgtcaactcacggcatcatgtgggaggatttttccgatatccttacaaaggactcacttaaagttctcagagatgactggaaggtcaacaccataagaatcgcaatgtatacttatgaatggggcggctactgcaccgagaacggcaagtatcaggcgcaggcaaagcagaaagtcaagacaggcgttgagaatgcaaaatctcttggtatgtatgctataatcgactggcacgttctcaacgacagaaacccaaacacctacaaagctgacgctataaagttcttcacggaaatggctcagacttataaggattatgacaacgttatttacgagatctgcaacgagcctaacggcggaatcacatggacaggcggaataaagagttattgtcagagcgttgtaagcactatcagaaaatacgacagtgacgctatcataatttgcggtacaggcacatggagtcaggacatagatcaggtgcttggcaacaagctttcagacaaaaactgcgtttatgctcttcacttctatgcaaactctcacactgaatggctgagaaacagacttaagaactgctacaacaagggacttcctgttcttgtatctgagttcggaacttgcgacgcaagcggaaacggcggatataactcaacagaaagcacaaaatggctcaagcttctcgactcactaaaagtaggctacgtaaactggtcagcctgcggaaagagcgaaacggcttccgcattcgttagcggtacgaacctcaaagctataaagagcggcacttcacagctcacagcaagcggcaagttcgttcgtaattggtacagaaaccactgataacacaaaagacctctcttggtgggaggtcttttttttgcacagaaactaacgataagcgggcgactcaaggtcgcctctacactttaaaaacatagccgaggggcatttacctctcggctattgttattttatatcatatcacaaagaacagtgctgttcttataacggctgtaaaaagcatagcatagaacgacgtgccaagcaaaagctgatttgcccagaatatatcgttaggctcgcatggctttagatttctgcctataacaggctttcttacaagctgtccgccgtaatactcatcactgccaagctggatacccaatgcacctgcacacaccgactgagtttgcgctgaattaggactaggggattttcttctgtcttttttgtatacctgagaagcgttcttgctgtcaagatgaagataagaaacgttcattttcataagcagggcggctattcttgcaggtataaagctgagaacgtcgtctagctttgcagggaatttgccgaagtttatgtatgtgtctgttttatagcccactgtgttgtcgataatattcactgttctgtagagtattccgcccagaccgccgaatatcgcagaccagaaaataggtgcgaccgcccaatctgtggtattctctgcaaccgactccaccgtactttttataacagcgtcaatgttcatatcgtcggtgtcacggaaggtcactttttttaccttgcgctgtgccgaagaaagattgcctgcccttgcagcacgcatcactccccctgccgcagttttaagtgactttacagaaagtgctgaccagcacattatgccctcgaggaagatgccaagtgcggcatttagcttatagcccacgaatagaagaagcaatgccacagcggcaactataagaagcactatcacagtcatcataagacctgccatgcgctgtgcttcgggggtgtttttatagctgtttctgaaagacttatcaagctttgccacaagcttttttataaaatactgaggatagaccactacttcagggtcgccaaggagcatatccagcgcaaagccaagcgcaagcgccgccagtgaatttatcaacatatatacatatcctttcttcaggcaataattacttatgataattatatcacaacattttctgattttcaatacctttatgctctgattttaagggataaggcacaaaaaagggcggtcagagccgcccgaacaaaagtctttcaaaaaaatcagaaactaaggtgcgaacactgtttgcccctacactgaatagatatatccataagcttttgtgataactatattatttgcatatctccgaaagcttttcaatcataagctccatttcctcgtctgtgccgatagtaattctcaggaagttatctattctcggcttgttgaaatatctcacgaagataccattttcacggaggtatgtgaagatctcctttgcagagagtttttcatgctgtgcaaagagaaaattcgtttcgctgtcaaggacgttgaagcccatttcacgcattttttccgctgttctatcccttgttgccttgaccttttcaactgtcgccttgaaataatcctcgtcagaaaggcttgcaacggcagtttctatggctatctggtcgagaggataggaattgtatgagtccttcacagcctgcatatagctgataagctcggcacttgcgaacgccatgccaactctcatgcctgcaagggaacgtgactttgagaaagtctgcgttacaacgagattatcgtactctttcacaagctccacgcaggaatacctgccgaaatccacatatgcctcgtcgattataacaatgctgtcctgattgttttcaagaagttctcttataaatttctcacccacaccaaggcttgtcggagcattagggtttggtataacaacgccgccgttaggctctttgaagtcgtctatatttataacaaaattttcgtcaacgctcttagtcttgtaaggtattttcagaagctcacaccacacaggatagaacgaataagttatatcaggataaagtataggcttatcagagttgaaaaacgctctgaaagctgtggcaagcacatcgtctgagccgtttccgcagaaaacattttcgctcttcagtcccacacgctccgcaagcgctgccctaagaacagaagcgtcggcactagggtattttctaagctctgcaatagttttcccctccaatatcgcctttacctttgatgacggcggataagggttttcatttgcattgagctttattatcttatcgtttttaggctgttcccctgcaacgtaaggttctatatttataaggttttttctccaaagcttttcgctcattttacattatcctctctatattttatcatagtaaagtattaatataaaatattatagcacataccgcttatgttgtcaaataaaagccgcctagctttcaaagttagcctgtatagactgcaaaacgccgtcatagtaatatgcgttcacgctcatggaatcgctctcccaatcaagaaactgatctttgccgtttctgtcgctgacctcaggtgtgccgagaatcgcagccatctcctcaggagttgaattttttgttataccgaatattgagcagtcgctttcggtggcgaaactcattcttatcttatggagggtatgatcgctgttgagccagaagtcgaagatgatgatattatccacagtcgagcttgtttttccgtagcaaagagcagaatcgtattcatcgtcaggggtatccaccatttcttctcttacatcatcaataagctcagtgcctgtgaaaacgtggtctatgcccttatagcttacgcttatatccttaggcagagcagcgtctgaagtaaggtcaagggtcttgaggtcatcatatacctttactctgttctcatcagtgtttacagtgctctcgcccggtgttgttatgcctgtatactcagatgtgaaaacagcctctccgtctttttcgtgtatttcttcctgcggatagtttttgctgtagtatgtgaaatcggaaaccgagaagtaatcaagcactacgtcatactcttcgtaattttcatatgtttccaccacaccgagtgaaattgtatagtcaacgttctcccaatacattgtatagcatttgtaattgtccatgccgtcatattcgctgttcatataaatgcttgtagggcagcccattttgtcgattattttatcaagatcttctttattgctgtagcagccgtagctttcatactcccagccggaggtatccacagcctcttctaaaggtatggtaatgctccagctgttttccttgagaatgtcagccacacttgcgtcacggtcaaatgggtttgcaccggtaagatcgtagtttgtttggctctcatctgatgaaacgaaggttatctcaacgtcactgttttcacctatcattttatcaacgctcataatatcactagatctgccaatatcgtcgccgtacattttcatattggcattgccgccgtctatggcactaaggtcaacaggcactgatattttgctgccgaaaatatcctgcggcaaagtatctgacggcgtgccgccctgaaagctgtctatccaatataagtcgctgtctttgttatccttagcggtatcagacacgtcttcatcgccctttgaagctgtgctgtcattttgtgaagaagcaacaacaatatcattattatcgtcgtcatcactattatttgaactgagcatcaccgccgctgtgatacctccgcctacaactgccacggcacaaacgcctgctattacttttgcttttactgttgaaaacattccttttcctcccgatatagtttttgttgatgttacgctatcgggaactgcattagcggctgaggctgagcctgtgaaaacggtaagtttcggaagaacggtgtttgaagcctctttattaagaagctttgaaagaataaatacaggcacggcagcatgaagtctgtcgttgttgttttcctcgtatataagcaccgcctcctttatcttttttcttgcggcactaaggcgggaagttactgtacctgtggtgcagttcattacctctgctatctcaggcactgtgagcatatcgaaataatacagtatcaccgaacgcctttgctcttctgtgagaacagtgtcgataatatccattattatctttcttttagcgtcattgctcacatattcctccgggataagcccctcgtcagggatctcctctattatctcctctgagttgtcctcaggggcggaattgtttctaaagtgcattttgcagagatttatccctatcctgtttacccatgctggaaaattctcaggctgtgcaagagtgccaagcttttgaagggctgtaagataagtttcctgagtgatatcctctgcaagctgtgggtcgccaagaagcttcaggcagctaaaatacactgttctgcccgtttcttcataaagcgcaccgaacgccgccttgtttccctgtgccgcctgcaatacaagctttttgatatcatctttttccatgtttttgacctgctctttctttccgaattgccgttttctcgtccgctgttttatcagtcccgacattagttagatgcaaaacgcagacgatttgttgagcaaattcagaatcttcatatatagtttacatataattaatacttattattataatattgccgaaataattatatcacatagcaaaatgcctgtcaacgagcaaaaaatatcccccacaaatgtgagggataggtttttcagaacatacctgcaagatacattctgctttcataaagcttttttgaatttgtatcgaaggcaaaatgatatctgtagagaggtgtaagccctgcggcatttttctcacctgtaacatatgcaacgaaaacatcagggtcagtgtcgctgttcacacagtatgttccgctcattgacatatcgccctgtgaataaacataggaaagatagttgcctgaaatgctgttctcgccctttgagatgccctgagaagcaagcatatcctgcactgattgtgctgaataatcgtctatgttgtcatatatctcatcaagcttctttgtgcttgtgacatcatagcaaagccttgttggcataccggtcggtatccaagcaggggtgtaaatatcgtttgacataggcgtttcctctgcccataccacatagctgtctgcaagagatacctgtccgtcagggtttgttagatttgcaacatagaccgttatctcatctccctgcggctcgacctttgggataagggtcatgtaatagctatcccaccattcaccgccgaaatagttgtcagcacctacacgataattgagcatttcgccctttttatcctcatagtgacctccatcgcagtatacaaagctatactcgtcagcatattttgcatagaaatcagacgtctttatatatccgcccacctgcatgatgtcaccattgagctgaacaagacctgacgaaagatcagcattttttatctcgtcagacacagtgtaaacagccatttcaagctcgctgtttgaatttgtaccgcttgcatcatcgtcagtaacattatcttcattatcagcattttcatcaagttcgtttagattgtcctctatctcctgctcgttcacttccccctgtgcgtctgtctgaacggctgtgtttggcttatcagcatctgatgtcttatctctgtttgcaagcaccacccctgtgatacctccgccaactactgccaatgcgactactcctgctattacttttgcttttactgttgaaaacataccttttcctcccgatttacttattgtagtatttttatcgggaacaatatcctcggcggctgccgtgttgctgaaaacggataattcaggcagcttcaaatgctgacattcctgcataaatatctttgacagaacaggtataggcataacagcatgaagcctgtcattgtttttcttttcgtaaataagcaccgcctcccttatcttctttcttgcagcgctaagacgggaagtgacagtgccaacagaacattccattatctctgctatctcagccacgctcatcatatcaaaatagtaaagtattattgtctgacgctgttcgtcagtgagagcggtgtcgataatgttcattattatcctgcgtttttcttcgctgtcggcataatcgtcagggataagctcgctgtcgggcgtatcgtcgattatcttttccgactcctcctccgcagtgcggggatttttcctgaaatacattttgcagttgtttatggcaatgcggtttacccacgctgagaaattctcaggctctttaaggctgtcaagcttttcaagagctttcatgaaagtgtcctgagttatatcctccgcctgctgagcatttccaagaagcttcaggcagttaaaatataccgacctgcccgtttcttcgtaaagctcgccgaaagctgctctgtcaccctgtcctgcctgcaaaacaagacgtcttatcttttccttttccattttttctaccaagctttctttttattatcgaacaaaaaaatatccgttttcagcactcggttattgttccgacatcacttagatgtttgctgaaaacggaatattgagcaaatataaaacttaatatattgtttacaaaatattaatcaacatattctctgactctgagatgtatacccacgctgtcagcaaccgcctgagatttttttatctcctcttcgccgattatatcaaccacagtgagcattacctccggcacgaactctttcactctttttgcaaaagagagcatttcttcaaagcagttcacgcccttgaatgacggtcttgttatctcgtcataagcctttgcgtcagaagcgttaaggcttattgagattatatcaacaagtcccttgaactcagcaggagtttcacgcttgttgataaggtcgctaagaccatttgtgttgatccttataggtgtctttgtaacagattttatatactttgcagtttctttgagtatttccagttcacaggtaggctcgccatagccacagaaaataatttccttgtagctgtcaaggtcacgctttttgatgttgtctattacctcttcggcagtaggctgatgttcaagccacagtgggtcagagccataagcaccgtcaccgttgtgacgaatacagaatgtgcagttgcatgggcacttgtttgtgatgttgagataaagcttatcgcctatctcataagaaatattcatagcttttatcattataattacctcttttttgtaatatatcaaagtatagagtaaacgggcgaacactgttaacccctaaagagagaaatatcatcgccgttaggcgataccttcattcctcattcctcactcctaactcctcattaatatctattctcttatctgtccatttcctgagataagatactttgtggtggtcatttctctaagacccataggacctcttgcgtgaagtttctgtgtggaaatgcctatctcagcaccaagaccgaacattccgccgtctgtaaatcttgttgagcagtttacatatactgccgctgaatcaacacgcttttgaaattcctgtgcggcaaaaaggctttccgtaacgatacactcagaatgtcctgtagaaaatctgtcgatatgttcaagggcttccgccatgtcatcaacgaccttgatagagattatatagtcaagaaactctgttgcataatcgtcatcatcagcaggagtaacgttttcagagccaagtatctgccttgtaagctcacagcctcttatctcaacgtggtgcttgtcaagtctttctttaagctccgggagaaaatcctctgcaatatccctgtgaacaagacagctttcaactgcgttgcatacagacggacgagaggtcttgccgttatcaacaatgttcacagccatttttatatccgcacttgcgtcaacataaacgtgacagtttcctgtgccggtctcgataacaggcacagtggcagactgtacaacagcctttataagctgtgcgcctccccttgggataaggacatcaatataatcattagctttcatcatatcaagagcgatgcctctgtcagtatcctccacaagctgaatgatatcagggctgaagcctgccctttcgacagcctttctcataaggtcagcaagcattttgtttgagtttattgcttcctttccgcccctgagtataacagcgtttccacttttaaggcaaagtatagcgccgtctacagtaacgttaggtctggcttcaaaaataatgcctataacacccattggcactcttactttctcgatcttcatgccgttaggtcttgttgagcctgaaactacctcgcccacagggtcgtcaagctgtgaaagctcctcgcaagcctttgccatgccctctatacggctgtcattgagtgcaagtctgtcaagcattgcctcagacatttttctcattctgccgttttcaaggtccaccttgtttgcttcgataatatcgtccttgcaaactctcaggatatgtgcgatctcaagaagtgcgtcatttttctgtgttgttgaagcgaaggcaatatcctttttgcaagcttttgctttctgtcccaaaatatcgatgtaactcatttttactatacctccccgttagctgtaaaaagtgttcctataggtttgttttcaaataccttatacaaatgtcttggatctctgccattcattattataagatctattccgccatttttgcatatctcagcggcttttatctttgtcgccattccgcctgtgccaagagaagaacctgcaccccctgcaatagcctttatctcctccgttatctcaggcacaacagggataagctcagcgtcatcatacttatgagggtctttgtcaaaaagtccctcgatatcagacattattataagcagatctgcattagcaagcaccgcaacatttgccgcaagagaatcgttctcgcccatttcaagctccagctcatcaatagacaccgtatcgttctcgttcacaatagggatagaaccaagctctataatgcggttaagggcgttctgcacatttatgcgtctgtcctcaagaagaatatactttgtaagcagaagctgagccacattaaggctgtattcagagaaaagattatcgtaaagatacataagctcacactgacccaccgccgcacaagcctgtcttgtaggagtgtcctttggtctttcctttatgcccagctttgctctgccaagacccaccgcaccgcttgatacaaggattatctcatgtcctgcattttgcagatcggcaagagttttaacgagctgttccacacggcgtatattaagaagccccgtgctgtgagtaagagtagaagttcctacctttaccacaactcttttcttttttgtcatatctatcattttcatcatgtccttattgttattttccgttgacaacattctgtggcgtaccctctatccacattttcaagttctgcgcaacagtttcaagaagcctttctctcgtctgctttggcgcccacgctatatgtggggtaacagtgcagttctttgcgtttctgagaggacaatcctcacgcatcggttcattcgtgagcacatctatgcccgcacctgcaatgacttcattttcaagagcctgtgcaagagccttttcgttcacaagaccgccccttgcagtgttgacgaaaaatgctgactttttcatcatgccaaggctttcggcatttatcattttctcattatcctttgtaagaggacaatggagcgtcactatatcagaggtctttagaagttcttcaaggcttaccgcaggcgtgccgtcagttattttctggggtgagcgtgtaaaggtgatgaccttcatgccgaatgctcttgctatctcagcaactttctttcctatgtcgccatagcctactataccaatggtttttcctgcaagctcataggtaggaataccaaaatatgaaaacagcttataattcacccagccgccctcgtcaactttctcggcatattctcttatcttgctgaaatagttgaggataagtgcaaaagtatgctgagcaactgcatttgttgaataggaaggcacattgcagaccactgcgtcatgcctgtctgcggcggagaggtcaacattattatatcccgttgcaaaaagaccgacgtatttcaggtttttgcactttgagaatacctcctctgttataaggcacttgttacatataacagcgtcagcgtcacctatcttttctgcgacctgttcatttggcgtaaagccataaacaatgctttcaccaaggactgttattccctccagcgacacatcgtttcttgaaactgtctcagagtcaagtataactattttcattcttcatcttccttttgagcagtttccgacttttcctcggcattctccaaagctttctgctttttagcaaacctatgggaaataaaagctgttgccgcaagaagcgctacctctgcaccgaaaagcataccgataacaaagctttttgtggtaaactgagtaactatagtaaggtcgatagctatcattaatgtaagataatgataagagccttttcttatgaactgagttatatataaaagcgtagcgataacgcagaatatcatatgcaccttgaaaggcaagggggcataaacgttctgcaaggtcgcagtttccgccgccagtgtttctatcacactatcatctcctaaagcattattttatcatactaagatattataccacagttttacgtcatttgcaatagatttgagcctttataacggctttataaaacaaaaagacagaagtattttttcaaatacctccgcctttttcgggaaaaattcgtcgtaatctttaatttatactattttaagataaattacttgttagcgaaatatctgtcaagcagacccttgaagccgcatccatgtcttgcttcgtccttagccatttcatgaacagtgtcatggatagcgtcatagccaagctcctttgctctcttagcaagcttcatcttgccctcacaagcaccattctcagccatatatctcatctcgagatttttctttgtagaaggtgttacaacctcgcccagaagctctgcgaacttagctgcgtgctctgcctcttcataagctgccttctcatagtacatacctacctcaggatagccttctctgtaagcaactcttgccattgcaagatacatacctacctcagagcactcgccgttgaagttctctctaagacctgcaacaacttcctcatcaagaccctctgcaacgcctaccttatgctcgtcagcccatgtgatagctgtttcttctactttattgaacttttctgctggtgcgtggcagataggacactcctttggagcagcctcgccctcataaacgtaaccgcatactgaacatacaaactttgacataatctttgtcctccttattttaatatcattttttacttttccacagaccagcgttttcgcttatctgcgttattctttgcagcttttcccttgctgtgattaaagtataccacattagtgtacatttgtcaataggttagttttgtctaacaatataaaaatattgcaaaaatttatgacaattttttatgcaatttgacgtagactatactaaccaataatacgtcttgaaaaaaacctaaagctgtgctataatgaaaatcaacatatgacaaaaaaggagtttttttaaatgaataaggaaaaagcagcggcagcaaaggctcttttcatggagggctacaactgttcacaggcggtagtaggcgcatgggctgaggatatcggccttgacagtgaaactgcatacaagatagcttcgggctttggcggcggaataggcagaatgagagaggtctgcggagcatttacaggtgcagtcatggtgcttggattgaaatttggcaacaccataggcagtgacagggcggcaaagggcaaggattatgagcgtgttcagctttttgcaaagcgtttcaaggaagagcttggctctgacactatcatctgccgtgagcttctcggtctgagcggacctagtgaccctgaccctgcaaagcgcacaaaagaatactatcagaagcgtccatgtcctgaaactgtagcaattgcaagcggtcttttgggagaatttatggagtagtttttttcagaaaaaaactttgaaactgtgggtgaacgctgttctctcctacaaaataatgcaaaaaagagcagagaaacgagatctctgctctttttttgtatataaattctattagatacctgcggaatagtttggagcttcctttgtgatataaatatcgtgtgggtgtgactccttaagacctgcgcctgttatcctgatgaacttagccttttcgccaagctctgcaatagtatgacatccgcaatagcccatacctgaacggataccgccaacaagctggaagatagtatctgaaactggacccttataagccacacgaccctcaacgccctctggaacgagcttctttgagtttgtctggaaatatctgtcctttgagcctttattcatagcggcaagagaacccatgcctctgtataccttgaactgtctgccctgatagatctcagtttcgcctggagcttcgtcacagcctgcgaggagtgaaccaagcattacaacgtttgcaccagcggcaagagccttaactatatcgcctgaatacttgataccgccgtcagcaataacaggaatgccatactcagcagcagcgcaagcggcgtcataaactgcagtgacctgaggaacacctataccagcgactacacgggtagtacagatagaaccagggccgataccgacctttatagcgtcagcacctgcttcgcagagcgctctggcggcttcagcagtagcgatattacctgcaataaccggtgtatcagggaaagcggccttaacttttttaagacaatttataacgttcatagaatggccgtgagcagagtcaagaacgaggacgtctacctgagcttcaacgagagcggcaactctttcgagaatatcgttagtcatgccgatagtagcaccgcaaagaagtctgccctttttatctcttgcggaatttggatactgaacagccttttcaatatccttgatagtgataagacccttaagaacgccgtttgcatcaacaagaggaagcttctcaatcttatgcttcataagtatcttctgagcgccttcaagatccgtatcaacaggagcagtaacgaggttttccttagtcataacgtcaccgatcttgatattttcaaaatcagtgataaatctaagatctctgttagtgaggataccctcgagcttgccatccttatcgactataggcacgccggagatcttatacttgcccatgagcttatcagcttcagcaacagttttatcggctgtaagagagaaaggattaacgataacgccgttttcagaacgctttaccttatccacctcttctgcctgctgagcgatagtcatattcttatggataataccgataccgccctctcttgcgatagcgatagccatttttgactctgtgactgtatccatagcagatgtcattataggtgtattgaggactatatccttagtgaggtgtgtatggatatccaccatatcaggtgtacaatccgactcgcctgggataaggagaacgtcatcaaaggtaagaccctctttaccaaacttattgtttacattagtatccagcataaattaacctcccgcaaacattttgaattcttaatttattattcttataatcatacaacatttaattaaacttgtcaacatcattattgagaacttttttttaatttagtctttgctaatcggagttacgttgttttagccaaggtttacgccatggtttgttatgccgcaaaatcgctgcgctcggctctttattttacttaatacttgtgatttgttcagttggctttgccattcctcattcctcactcctcattcctcattcaatttatttttcatcactttcactctcgcaaacaccactgacagcactgttgacacaagccaacctatcggccatgacagccatattcccgttgacccatatggtcttgccaaaacgaacgcaagcactactctgagtatcaagtccgtaaaagttgatatcataaaatactgcattgcacctttaccacggagtgctccgtctgacattatttttatgcccacaaacacatagaaaggcgatattattctcaaaaatgttgtgcctatctcaacggcttttgttccgccgtcgtcaagaaacagatttatcatagtttttggcatacagaaaaagcagagtataaaaggcactgccacgatagccgagataacaagtcctgctttatatccgcttcttatcctatcgttcctgcctgcaccgtaattctgtgcaacaaagcttgaaagcccgtttgaaagcgttgtaaagcttgttatagcaaaggtatttagctttattgcagaagaatatcctgcgatacaagacgagccgaagctgtttacaagatactgcacaaagatatttcccactgagataaaactctgctgtaaaatactaggtatagaataaagggttatctttttaagtatttttcctgaaaacagcggtggtttatcctctgttttaatttctgcggttttcttcaccaaaataagcagtgagaacacgcaagccactccctgagcaataaaagtagcccatgcaacgcctgccacaccccatttaaagaacttcacgaacacatagtcgagaacaacgtttccaactgatgagccgataaggagatacaatggggtctttgagtcgcccattgcgttataaatacctgtacccacgttataaagaaacaggaagataagacctgcgatatagatcttcagataaagctcaccgtcacggaagatgttatcgggcgtgtttatcattctcataagaggagtagaaaacgcaagtccaaaaactgtcagcactgctgcaagtatcgtacatgaaattatagtagtagttgacgcagtttttacctttgagaactcttttccaccaaagaattgagatatcaccacacaacagccaacattgcttcccactgcaaacgccataaatatcattgttataggataagacgcaccaactgctgcaagagcgtcctcgcctgcgaattttcctgctatgatactgtcgaaaatggaatacatctgctgaaatatcacgctcacgaacataggcagggaaaatttccacagcactgtccacggttttcccaccgtcaggtctgtcataaaaacatctccataatataatagttaccattttattatatcataaaaaaacaacctttttcaacgtcatttcgcacagacacttttgatatttctgaaggtttttttagcattttacgctatttgtgatctattaataaaattttctaaatattattagcttaccctcttgctgaaattatctgtaaagaataaagtcacaatgtttttttattgacaaaaaagtgcggatattttatacttgtataagaggtgataaaatgagcagtcaagcagaccacggcggtcacagagagagaatgaggaagcgtttcaaagaatcgggaaatttcaaaggcttttccgagcatgagatacttgaaatgcttttattttacattgtgccgagaaagaacaccaatgatattgcgcacgagcttataaaaaaattcggaagcttaaacagcgttcttaacgcttctgtggaggagctttcttcggtaaaggacatgggcgaaagctctgcaaactcacttttatttttcagagagcttataaactactgctccactgtcacagacagcaggatagacattagaaacatatctgcggcgctgagttttgtaaacaactgtttcagaaacgaaaagcatgagaagttcaaggtaatttgtatcgactctggctttcacataaagagcgtaacagacatatccgcaggcggtgcgagatttacccctgttgattttcgtgagcttacaaaagccgttctcaacagcggcactgatattgttatccttgcccacaatcaccctgactcacccaacaccccctctcaggaggacgttactctcacccgtgaggtcatgagatatatgagatgtttaggtgtgacagttcttgaccattatataacaggcaataacggaactatctccatgcgaaactgcggacttatccatgatatggagtgttaaaaatagaatatcacataaaaaaatggacgatatgtttaacataccgtccataaaattttatcttcttgaagcctttttctttgcgctgcctgtttttgaacctgaatgtgacatctttgcctgatgttttttccaatgtacccacagtgtaggtgcgatacagttagaagaataaacacctgatatcataccgatgataagtgggaaagcaaagctcaggatagatgttactccgcagattatgcagacgatacaaactgtagccatagcaagaactgttgtaacagttgtatggatagaacgtcccattgtctgtgtaatagagaggtttacaagatcctcaagctccattttgttgccaaggagattttcattctctctgattctgtcgtaaatgatgatagttgcgttgatagaatatccaaggatagtcagcagaactgccataaagtttgcgttgatgtcaaatctgcatattacaaagcagccatagaccatgcacatatcgtgtgcaagggcaactactgagaacacacctgctgagataccgcctatcttcttaaatctgaaaccgatatagatgatagtgatgaccattgccagtgcacaagcagcaaggcacttgaagaagaagttcataccacttgaagctgcaacgtcgtttgactcgtaaacttctatgttgttatcaggaaagtccttttcaagggctgttttcagggtgttctgcttatcatcgcttataccctttgttgatgagaattttatttctactgtctttcctgcgtttcctgtgttttcgccaagagttactgtacatttatctccgatactgtcagaaacggtatttgaaacgtcagaagtctttatatcgccctcatatgtataagtcaaaactgtaccgcctttgaactcgatagccacgttaagacctataacgaatgtaagaatgataaaaattgcgataagtgcgcatgatatggaataaaataacttgctgtgacccacaacattcagggtctttctttctttactcatttatttcagcacctccgtaaagcttgcgtttcttaaagcacttgaactttgagagggacgaaagcataagtcttgaacagaagataccgaatacaaagttcaggaggatacctacaaggagagtatatccaagtgaatagatagtacctgctgtgcttgcgccgaatactgagaatacagggctgagaagtgttccgaaaacgctgtctgtaggtccgaaggcacccataaggattattgcaacgaatactactgtgatgtttccgtcgaatactgcgctccatgctctcttatagccaagctcgatagctccgttaagggtcttgccgttgttaagctcttcctttattctctcggctgtgataacgttagcgtcaacgcccataccgatagaaaggataatacctgcgataccagggatagtcagcgtaaagctgtcgatatttccaaagaagcctgtgatgcaggcgatagagcctattacctgacctataagtgcgatagacgcaacaaagcccggcagcttatagataacgatgatatatgcagcgataacgataaatgcgataagtcctgcgatgaccattgcattttttgcaccctcacccaatgtaggtgaaatgatgttcgtacttgttgttttaaggtcgaatgggatagaacctgcatttatcttatctgaaagagcttttgcagaatcgtatgtgaaattgccctcgataacgcactcaccgtcagtgatagctgaatttacgcttggggcagaaatgcacttatcgtccatccagatagagataaagccttttccggcaagctcagttgtagcgtcagcaaaagcttttttaccgctgttattgagtgtcaggcttacaacatacttgatatttcctgttgtttcgtcctgagtttgtcttacctcagcctttttaacgtcatttcctgtaagcacctgttcgcctttttcttctttaccctttctgaatacaagctttgcagtttcgccaagctcagaaacggcagcctcagggtcaaagctttcttcgttagcctgccatgggaatgaaaccattaccttatttttcttatagtctacatagacctcgctgtctgtgatattaaggcttacaagtctttgctcgataacagcctttgcagcgtccatttcttcctttgtggcgtcgtaattatcggcaggttcaaacgtagcatttacgccaccctgaatatcgataccccagcggatatcttcaacgcccttgatatagcttgtttttatatctccgtactgagtatgtattcctgcataagtaagatatccaaatgcaattatacacaaaagcacgataaaaaacacgggttttttaacttttcgcacctttaatcctcctgataaatttattaagcccagaggcttttttgccgtcaggacacaatacgcccataacgaacacattcaccttataattataaaacgtttgatacaaaatgtcaatagtttttatgaaattcgcactgttacttatatcatgattgtatttcatctatgaaataatttctctcaaaacctgtttcaaaagcctgttttaaaggggctttgtcttgacaaaatctccttttagtgatattattaaaaggataaatattgcgacgtaaggaatttttttgcgtcagctaaaaggagtatgtaaaatgatagatattaagcttatccgtacaaatcctgagcttgtcaaggaaaacatcaaaaagaagtttcaggacgaaaagctcgttcttgttgacgaggtagctcagtttgacgaggaatacagagcagccaagacaaaggctgacgagctgagaaataaaagaaaggtaatgagcaagcagataggcggtcttatggctaagggtcagaaggacgaagctgagaaagtaaaggctgaggtttccgctatcggtgctgagcttgacgctatggctgaaaaggaaaaagaccttgaagctaagatacgtgagagaatgctcgttatccctaacataatcgacccaagcgttcctataggcaaggacgacagcgagaacgtagagattgaaaaattcggagagcctgttgttcctgattatgagatcccatatcacgttgacattatggaaagctttaacggcattgatcttgacagtgcaagaagaacatcaggaaacggcttctattatcttatgggtgacattgcaagacttcattctgcaattctttcatatgccagagatttcatgatagacagaggtttcacatatttcattcctccttacatgatacgttcagacgttgttacaggcgttatgagcttttctgaaatggaaggcatgatgtacaagatagagggagaggatctttatcttatcggtacttctgagcattcaatgataggcagatttatcgacactatcattccagagggtgagcttccaaaaactctcacaagctattcaccatgcttcagaaaagaagttggcgcacacggcatcgaagagagaggtgtttacagaatacaccagtttgaaaagcaggaaatgatagttgtctgcaagcctgaagatagcatggcatggtatgacaagctgtggaagaattctgttgatttcttccgttcacttgatatccctgtaagaacacttgagtgctgctcaggcgaccttgcagacctcaaggtaaagagctgtgacgttgaggcatggagcccaagacagaagaagtattttgaagttggttcatgctcaaatcttggcgacgcacaggcaagacgtcttggcataagaataaaggcagaggacggcacaaagtattttgctcacactcttaacaacacagttgttgcacctccaagaatgcttatcgcattcctcgagaacaatctcaatgctgacggaacagttaatatccctgagccactgagaatgtacatgggcggcaaggacaagataacaaagtaatttgaatatgcaaaaaggtgaacggtcatgtgccgctcacctttttttgtatgtttattatatcttcgttccaatctctaaggatatttgaatcaaataatctttgtatttgtctcatataatttgaaattgaatatacactattttttatatctatttttataagttcacctacttcttgtgaaatttcttggcttgttttacttattattgcattattatttttaagttctaacatttttttcttttcaatatttaaaatatatccattattcatataggttattaaattttctaaattatcaaatatctttacaaaccccatggttggtgaattataaaatgtcaccttttgatcaagtggatttatcataatatgattgcaaaaatctaaatctacaatacaaccatgtacatctccacaataacctaagaattttacttcactcgccatttgatttatatatttccaataaggtgcaaatagttctatatatttatttaccattttatcgaaaattttatcaaaatgttcgatatcactacaattactaatcgtttttatttttccaccaatacaaattttagtgtttatatggcttatgaggaaaaatacatacttacctttgtgttttatcatataaaacttttccccatagttttttatttgattttctatgagtcttgttccttgaatacgctcttttgaataattataaaattttgcataatcttcagtggttataacatgatagccgtctttatagtcgaaaaatggattgctagctacacctaaatttactgatttcattttaaaacaattattatagtatcctatttgattatctgcataaatattcttttgcaataaattttgattttgatgagtgtgtcctgtaaaataagaacaatgcaaatcagtcacataatttagcgaccaatctcttactggataatgacttactactattaattttttcttttgatttatagcattatctaatctatttttatactccttaaaaaacaaatctgattcttttatttcttcttttctcgaaaataatctgggtccacacaaactatctgcattatatctttcattatacttagcaaaacctataccaccaaaaataatataatcatcattttcataagaattattatgcaaaagcttaattccaagtgaatcataaagagatttataataattatacgcttgacttaaagtatcaaagtttgagatttcatgatttcctaacgttacaaatataggaagttttgttttaataaaagtgaatttttctcttttttcaacatatggaataatataatcatttataaaccttatttcataatcacatttcgtaattttttctataatatttataacatattcaggcaatttcatttttttgatacttttatcaagatcagaaatgtctaatgacagaagtttttcacatagatttttctttttatataattttccaattttatttaatctatctatttgctgatctcgaattttttcatatgcttttacttcttcatcaggtaatatcttagattgatttactttatatcttttataaagtacataattccacctaaggataaactgattaaaaaataatgacacaaattctgcattatcagcgatatctccattaaataaaacaactaaattattcattgataaatctgatttaaaatcatcactaaataaatctttaactattttatttatttgcttttgaatggatatctcatagttaaaatgatgttctaaatgcatatcagatatataatatacctttagttctttttcatcactaaatggtttgtcttctttaaataaagataatccattctcgacttcgctaatgtcaaaaatttgtgtcatattattcattctttattcttccgtgttctcagaatcctcattctcaacgctttcggtattatcttcaatgacctcagcgttttcctcagcctgagcctctgctatctcctcggcagtagccttttccacctctgccgtttcaacatcatcgtcatgctcagttcttgtgaatgaaaccactctgccgtcctcgccgactctcataagtcttacgccacgggaatatctgctcatcatactgatatcgcaggctcttattctgataacaatgccgtctgtggatatcatgatgatatcatcttcatcatcaacgacctttattccgcatactccgccactcttatagttcataagaccgtagccgcctctgttctgtaccttataagactccagcggaacacgtcttccaagaccattttctgcaacagtgagaacgcttgcaccctctcttactcttgccattgatacaacatagtcgctgcccctgagtttaatagcctttacgccatgtgcaactcttgacatctctcttatgtcagtttctcttatcctgatagcataaccattatgcgttgcaacgataacctcattgtcgccaaaggtcattcttactcctgctatctcatcgccctcatcaagaccgattgcaataagaccattctttcttacatttctgtaggaagtcagcggagttctctttatcttgccgttctttgttaccattacgatatacttgccctcgtcaaaatcggcagtttttatcattgcggctatcttctcgccctcgcccagttcaagaagatttactatatttgtgcctcttgaagcctttgagccttccggaagctcatagcatttgagcttatacattatgcccttattggagataaagagtatattgtcatgtgaagaacaggtctgaagctcgtcgatataatcgtcctcacgctgtttcatacccgttacaccacgtccgccacgcttctgagccttatactctgaaacaggcattctctttatatatcctgcatttgtataggtaacaacgctttcctcaacagggataaggtcttcgatatcaacttcaccgctgacattttctatctgagttcttctctcgtcaccgaacttatcctgaatagcctcgacctcttcaatgattatatcaagtattctctgatgatttgcaagaatatcttcaaggtcagctatcttgacttcgatctcagccaactcgtctattatcttctgtctttccataccggtcagacggccgagagtcatgtttgcgatatggtcagcctgaatatctgtcagaccaaaacgctgattaagtctttgcttagcctcagggatattcttagaagttttcattatctcgataacttcgtcgatattgtcaagtgcgataacaagaccctttaagacatgctctctttccttagccttgttaaggtcgaacttagttcttcttgtgataacatcgacctgaaagtctatatactgctcaagcatttccttgagggtcagcaccttagggataccgttcacaagagcaagcattataacgcccacagtatcctgaagctgtgtatagctgaacagcttgttgagaactacctgcggattagcgtcctttttaagctcgataacgatcctcattccgtccttgccggattcatcgttgatataatgtattccgtcgatacgcttttccttaacaaggtcagcgatagactcaacaagtcttgccttgtttaccatgtaaggtatctcagtgacgataatgcagtttctgccctttatctcctcgatagaggtctttgaacgcagtgttatcttgcctcggccagtaccgtaagccgctctgataccggacctgcccatgatgataccgcctgtagggaagtcaggaccctttatgctctgcataagctcatcaagtgtgcaatcagggtttttcatgacagttttcatgccctcgataacttcatgaaggttatgaggagggatattcgttgccatgccgacagcgatacctactgagccgttacaaagaagatttggaaatcttgacggcagcacaacaggctctttcagtctgtcatcatagtttgactgaaaatcaacagttgttttgtttatatctgtcagcatatttactgacatcttagccattttagcctcagtataacggtaggcagccggagggtcgccgtcaacggaaccaaagtttccgtgaccgtcaacaagaggatatctcattgagaacttctgagcaagtcttacaagtgcgtcataaactgatgcgtcaccgtgtgggtgatatttaccaagcacagaacctactgtgtcagcacattttctgtaagcttgatcaggtgtaagaccattttcatacatggtatataaaattcttctgtgaacaggtttaagtccgtcccttacatcaggtaaggctctggatacaattaccgccattgaatattgaatgaaagattctttcattatcgcttcaacatcagtgtcaataacgttataatcgctcactttatccactcctttttaacctttcggtttactttgaaaagaacatatcctgttcttatttattatctatcatttcataatcgctatcaagcagctctgaaaaagtttttctcagtgtttcctgctgctgctcgttcataactctttttgcaagcacataaatagtttcctttttgagtattataataaacatttcgtcattttccaaaacgttcagtgagatatcctcaaaaccaactatcctcggtggaacaggggtaaagtcctcctcctgcttttcctcctctgtcggcagcgtttctattttgaagctgtcatcatagagggtgaaaacatacttgtcgtcctcaagaggtttaagtgcctgcataagatattttcttattcttctggtgttataccatgtgagaacgattattgcaaggcatatgaacgccagcacccagttaagatatcccgaagggtttctcactatggacactataaaaagcaccgcaacaacgccgaaagccgctgttatcttccagttatgcgcataaacgaattttctctgaaaggctaaaaaagctctttcctcttcctcgtttttcacatcatactcaaagctcaaaacaggctctttttctatctgtgcttcttccacctcatcagcattatcaacagctttctcagccgtttcaacagcttcctctgtttttacctcttcaagctctgtttcctgatttttattttcgttgttatccaaagcagtatcctttctttaaacgtcaagatcctttacatactctgcatttttctctataaattcttttctcggtgcgaccttatcgcccataagaatagtgaatatctcgtccgccttaacagcgtcctccattgtcacctttatcatagttcttctttcaggatccatggttgtttcccaaagctgttcagggtccatctcaccaagacctttatatctctgaacgtttaccttcaggttgttttcacccgaaagctcagaaatatactgatctctctctgcgtctgagaaagcatatctgacctgcttgccccttgcgaccttgaaaagcggcggctgagcaagatagatatgaccatcctcgataagaggacgcataaatctaaagaagaatgtaagcagaagcgttctgatatgagaaccgtccacatcggcatcggccatgattataactttgccgtaacgaagctttgaaaggtcaaagtcctcgcctattgatgttcccagtgcggtaacaacaggcataagcttttcattgccgtataccttgtctatcctagccttttcaacgttgagcatttttccccacaaaggaagtatagcctgatattttctatctctgccttcctttgcagagccgcccgcagaatctccctcgacgatataaatttcggtgagtgaagcatctctctcagaacagtcggcaagcttgccaggcaatgaagaggattcaagagcagattttcttcttgtaagctctcttgctttctttgcagcttctcttgccttttgtgcctgaacggacttatcaaatatagcctttgctacagtagggttttcctcgaagtagttcataagcttttcggtaactatcttgtcaacgaaaggtcttacctcaggatttccaagtctgccctttgtctgtccctcaaactcgcagtttgtgagcttaacggaaactatagccgtcagaccttctcttacatcgtcgccaagaagcttatcgtcgtctttaagatagccgaacttcttaccgtagttatttattacctttgtaagagcatttttgaagcctgtttcatgagtaccgccgtcaggagtatggatattattagcaaatgaaagtataaggtcattataagtatcgttatactgcaaagctatctcggcgaaagtatcgccctccatgccgttgacatagataacttcctcagaaagcggagtaacgcctcttgttttgtggatatgctccacaaactgtcttataccgccctcataatggagagtttcgcccacaggctctgattcatttctcttatcagtgaatattatctttataccagcgttaagaaatgcctgttctctaagtcttttaagcagtgtttcatagtcaaacactgttgtttcctgaaagatctcagggtcaggcttaaagagaacggaagtacctgttttatcagtatcgccgattattttcagcggctctgaataattacctctgtcaaacctctgaaaatgaatatgttttccgtcataaactgtaagctcaagatattccgagagggcgtttactacagacgcaccaacgccgtgaagtccgcctgctaccttatatccgccgccgccgaactttccgcctgcgtggagaatggtataaactaccgttgcagcagatattttctcctttgggtgtatacctgtagggataccacgtccgttatcggtaactctgataatgtccccgggaagtatctctacttctatctcagtgcaatatcctgccaatgcctcatcgatagcgttgtcaactatctcgtagacaaggtggtgaagtccctttggacctgttgatccgatatacataccaggtctttttcttaccgcctcaagaccctccagcacctgtatctgattttcattataatcattttgcttatccaccatggatatttcctcggtgttctggatctcgatctcgttgttattttccaaaaaataaccccctcatcacttggtttttttatcttatcatcttatatctttgattcatcattcaggcattcttttgcttcttttcaaaagtgtggcacagctcatctgacttatatacacagtttccgtaaagtctttatcaaggcacaccacaaagcttttaggcatttcatatgtgcagttcacaacacgtctgttttttgccgcaaaattaagaaattcctttgtgttggcagaaacagaggtattctctatatcgaagatccctatgatatctttagtattgactaaatagttatttcctaaatgcagaaacatcacttattctcctgaactatcattccgttttctatattgaatatctttccatggcttttctcgtcaaaggggatattcctgtcacagcaggttataaagacctgcatatcgtgtattttcgagataacgaacttctgccttgagaggtcaagctcgctcaaaacatcatcgagaagtatacacgggctgtcgtctatctcctcggcaagtatataagcctgcgaaagcttcaaaataagagcaagagagcggtgctgtccctgagaagcgaactgtctaactgccagtccgtttatttttccagcaagatcgtctctgtgaacgcccttctgtgtaaatcctgctcttatatcgtcatcaagattattttgcagacagcttagatactcttcagccatttctcctgcataatcttttctgccctccagatttgaatacacagtggaataatattcaagctccaacctttctctgccctctgatatatcctcataaagcttttttgcgaacatatcgagctttttggtataattatatcttaaaagcgagatataagccccaagctgagcaagctggatatcccacacttcaagctcttctctttttgatctgccgtaacatatattttttaacaatatatttctctgctctataagatcatcatattttgagataacagagctgtaggaattttttatctgtgacactgaaaggtcaagaaactgccgtctgttttcgggagagccttttgaaagctccagatcctcaggagtaaagataacacaatcaaggcttccgaaaagctttgagggagttttcagttttacgccgttcaaggtgacgtttttttctctcacattaggtctagccattgcaaaatgtatatcctgactgcggaagctgtttttaaatgaaatgtcgatattcatgaactgtccgtttatatctatcatttctctgtcttttgtgttgcgaaaagacctcactccgctgcaaagccatatagcttctataagatttgttttgccctgagcattctttccgcagaaaatattcattttctcatgaggatatatctcgacttttttgagatttttaaatccgtctgcggaaattttggttatcaccattttattttaccactatctctgtagctatctcgtctatctgcaccttatccccggggcggatcttctttcccctcattgtgcagacctcaccatttactttaattctctcttcgaggattatctccttgccaatgccgcctgtttccacaacgcctgcatatttaagcagagaatcgagctttataaactctgattttatatttacatctatctgttgatatttcatattcttattcctttgctagtcttacagggagaacgaggtaagtataagcgtcgccctcacacggaactatcttcataggcagcagacttccgctcatctgcaatttgaccttatcttcctttatgaccttcagagggtcaagaagatatttgcacttgaagcctatctcgataacaggacctgctatatcagcctttatctcgtctgttatctttccaacgcttgttgagcagtttatttttatagaattattttcaaaatagcatcttgcaggtgacggtgttctgtcacttataagtatcaaacttctttcaagagcggcaataagctctttcctgtcaacaatgacctcagttgtgcaagtagttggtatagctgacttataagggtggaactcgccctcgataagtcttgaataaacaagatagccgtttaattcaaacacaacatgattttttgagagataaacggaggctgtttcttcgtcattatctcccagaagtgcagctatctcagagagagtttttgcaggcacgacgaatttaagacttccgtcatactttataggctcatatctcacagcaagtctgtatccgtcaagggcaacaagagtaagagtaccgttttcgatctcaaaaagctcgcccttaagaacaggcttaaggtctgtaacagccacggcaaactttgtctgatttatcatatccttaagaacaggctgagaaatagttatcttgttttcctcttctttcttaggtagtgcaggatattcctctgctgatgttgcagggatattgaatgtggtaactcctcctgagatcgttacctgaaaattttcagaaacctctatcaggatctcttcagaaggcattttccttatcatttcagcaaaaagtcttgcattgagtataaattctcccgaatcgtcgctctttactggtataacagtttttatacctatctcaaggtcatagccggtaagctccagcattgagttttcaagcttgaattttattccctcaagagatttaagtgcagcacgttctgacactgcttttgaaacatttgttactgctccgcaaagtgaagcattattacacagaattttcatagcaatttcctttctaaaaaattacatttatctgacttttgtttttttcaacatatgaatttctcaaacttatattttttgctctgataatatataaataaatcaatattaaattagtattagtagtagagtgtgttgaaatggttgaaaagtcattcaaagccttttgcagacttgttttgcttttcaagtttattttaacatcacttcaactgtgttttcaaaaacttttttcgtgtttgaaaagttgaaaaaatgtttgttgaatgtttattattatcgcaaaaaatgttgaaacctgaaaatcggtgtttgattttataacaccattgtttaaacttcattgtgcaaagttttgaaaaacattccgcaaagctttatatatccaagtccggatattcaacaaaattgttgaaaactatgttgaaaatgttgaaatagtccgtttaattgtccttgaggtttttgattatgtcgtcaacggtatcttttagctgtttgttctctttaagatttttaacaacgtcctgatagtgtatggtcatagttgaatgatttttgttaagctcatttcctatctgtataaaggtcatgccctttacgtccttgaagagatagatcgctatttttcttgcaagggatacgtttgcacgtctgtttgttgattttatgtcgtcagcagtaacgtcaaatgccgccgctacctcctgaagtatcctgtcaaccgttatctcagcagggtgattttcaatgattatttccttgattatcctctgagccatagatatggacgggctttcatttgtataaatggtaagagcctttattttatttacagttccctcaagctgacgtatgttcgtctttatcttctctgctattatccttacgacattgtcagaaagctgtaagtccagcatatcagcctttttctttacgatagccattcttgtttcaaaatcaggcggtgtaacgtctacctgaacgcctagtgaaaatctggtaagtatcctgttttgaagcttcgatatctttgacggtgcaatatccgatgtgagaactatctgcttgcccgcattgtaaagatcgttgaaggtatggaaaaactcctcctgcatacgctccttgcctgcaatggtctgtatatcgtctaccataagatagtcggcattcctgtatttatcatgaaatttattagtttcctttgactcgatagctttaacgagctggtttataaaggattcacctgtggtgtaaataatttttagctcagggtgatttttctttacttcatgctcgatagctttcataaggtgagtttttccaagtcccgaatcaccgtatatgatgagagggttgaatatagtatttgtgttagacggcgttttctgatcttcgtcatacttatgtgcgacagccgtgctgaaagcataggcaagatcattcgatttacctttgataaagttatcaaaggtaagattgttgttttcttcatcagaaaagtcagccaccttgacttctatatccttttcctcagtttcattaacttcttctttgtctttaacaagtatttttatatcaacctcaaagcccaaagtgttgagaaaagcttcttttaaaagattctcataggcgttcatagtgatatctcttgaaaaatcagaatcagtgagaagataagccacattgttttcaagcttcatcggttcaagtatctttatccatttgttatatcccggctcgctgatacttttgcagtttcggcaatatttcaggacctcctgaaatacgtcattaaaggaatccattgtttttccataacctcctagaaaatagctctgcctgtgcggtgtttccgctgtccgccgtgaccactgtcaaacagacggcaggtcagagttttaaaaaaaatataaacaggcataattaatcaattctatactattatagcacacttgacttaaaatttcaagtcctatatattatatataaggaaagaaataaggataaaaagtatgtttttcaaagataagaaaaaacacttaatacagataaaatttatatttggcacacaatatattgtatgctcataaaaaatgaggacgtaagcggcaggtttttcggacagtaagcccctcaaagcaaagaaaaataatatcaaaaaaaatataaaaatattgtgaacaggcttgacaaatggtgtgtgaatgagctataatattaaattacaagggcttttttcatagcgatattgtaatttgctgtgaccctataagtttaaacatctccgaggacgtttttttgtataaaatgacggagtgttgaaagcggaaggaggagaattcgatgaaaagaacatatcagcctaaaaagcttcagagaaagaaagttcacggcttcatgaagagaatgtctactgctaacggcagaaaggtactcgcaagaagaagagcaaagggcagagctagactcagctactaagagatacaggcagtttctgatgataagtctgacaggcattattcaggcggttagttacgcctgaatcgatgtccctaggcagttgtatttaagcgtcgttggacgctgcctcagatgacctatataccattcattgatttgcatggtattgggtctttatctttttttggcaaaattgccgtgaaaaggcgaaaagagtaaaaacagtacacaatggggaaatgaagatgctgttcacaacggttttaaaggataacaaggcatttttaaggtgctataaaaagggaagattttgtgcagacagttttgtagcagcatatttttatcccaacggcagcccatacaacaggcttggaataacggcgggcaaaaagcagggctgtgcggtaacaagaaacagaattaagagaatagtaagagccgcctacagacttaacgaggcggaatttccgctgggctatgatatagtttttgtgggaagaaacgatataggggaaaagaaaactcaggatattgaaagatttataaaaaaaagactcataaaagagatgaataagcctgttccaaagaataacaggtcaggcagggcaaagagaaagtaaaatgagtaaactggctcagctgctgataaggttttatcagcgatttataagtcctcttttcggaccaaggtgcaagtattatccaagctgttcggcatatgcgctggaggcttacagaaaacacggcttttttaaaggcacgctgctcactgtatggagattgcttagatgcaacccgtggagtctgggaggggttgactatgttcctgacaagcttaccactgagtattttaaaatcagaaaaaaataagcctgagagcttaatcagatatataggttatcaatatgacaaataattgatctggaggatattaaatgggtattattgcgacccctttgggctggataatgaagggctgctattttgtatgcaagaactacggaatagcactgctgcttttcactatccttacaagacttatagtatttccgcttaacgtcaagcagcagaagagcatggcaagaatgaccatgcttcagcctgagcttgaaaagataaagaagaaatacgctaaaaaccagcagaagatgcaggaagagcagatgaacctttacgccaaggcgggtgtaaaccctatggcaagctgtttgccaatggtcatcacaatggtcattctgtttgctcttatccctgttatttacggacctcttacctacgtttcaaacgcagataaagaggagcttacagactcaaacaacatgatatcgaatctttatgttgtcagtgctgaggtaaaaagcaaggatactactatagaaaagcttattgaaaagtttgagaaagacggtgctactgaggacgaagcttatgaaaagcttgaaaagctttttacagacaaggacaagtatccaaagtctgcaaaggcactttctaatgacaacaagatatcgaacgttatggatgctattaaggctcataatgatatagatacttttattcttaacgagaattacttctccacaaacctcattcagtcaagacctgagcttatgactttcgttttcactgaaaaagagggcggacagtatgcagatgtgcttccaacaagcgtaaaggctgcggctgaagatttcaactacagcattttcggacttttccttggaaagataccaacaatgaaggatctttcctgcattatccctattgtatcagcacttttgcagcttgtagtgacattcgtttcacagcattttgcaaaaaagaacaatcctgacgctgcaaatatgggcggaatgggaatgaagataatgctttatggtatgcctatcttctcactgtggatcggtttcagctatccggcaggtcttggtctttactggtgctattcttcactgtttgcacttggacagactatcgtactcaataagatctacacacctgaacacgttgcagagcttgttcagaaggatatagcaaagcagaaaaagaagggcaagcctactcttatggagaaaatggctgaggctcagatgatacaggctggtaaggatcctgctgagatcagaaagtcactttctgacgatgaggattacgatgagcctaagaagaaaacaaagacggagcttaaagacgagcagagaagacgtcttaacgaagccagaaagagaatggctgagaaatacggcgacgaatatgacgattcacaggattgacctgttgttgactaaacttttttagcgagaggagcagaaaaaatgaaacagatctttacagccgcaactgtagacgaagcaaaaaacaaggcggcagttgaatttggaacagaagtagaaaagatcactttcacagttcttgaagagcctaaaaagggctttttcggaaagatcaagggtgaggcaaaggtagaagctgaatatgagcctgaaacaaaggtagaaactgtaactgaaaaaacagaggctgttgaagaaaaggcagaagttcaggaagaagtcaaggcagaggcagagtggagcgacactttgcagaaaaaggctgactgtgcgaaggaatatatactcaacgttataaaggcaatgggcatagaagacacagagatcgaggtaacaaagcttgaaaacggcgcactttttgagataaagagcgaagagttcgagaagcttattggcaagaagggcgatatccttgattcacttcagtatcttgcatcacttgtatgcaacaggatagacagagaatatttcagaatatccacagattgcaatggtttcagggcaagaagaaagacccagcttgaagagcttgcaagaaagatagcaaacaacgtaaagagaagcggtcgttcatcagctctcgagccaatgaatccatatgagagaagaatcattcacgctgctgtatcagagattgagggtgtaacatctcagtcaaagggtgaagagccatggagaaaggtaataatcagctctacaacacctagaaaatatgacaacagaggcggctacaagaagaacggcggcagaagaagaaacaataataatcgccgctcaaagggttttgacatcacaacaagctttgaaaaggactacaagaagccaaagccagaggacacaatgaaggattcaggtctttactcaaagatagagttctaaattaaaaatgacaataagaaaacacgctgaattttggttcagcgtgtttttttgtgcatatattcgtattataattttttctttttcatttgacccttgttgcgtggatatttctcaggcgtttcagatacttttcttataaggataagcgttctgccgtcgcctgttggaagttcatagtcaaagacctcttcgacctttcctcccagtatcttaatagcatttttagcctctttcagctcatcatttcctcctgagcctttcaatgcaacgaaatatccgccgacttttacaaaaggcaggcaatactcgcataggtcgctgaggtttgccactgctcttgctgtggcaatgtcaaattgttcacggcactctatgcttctgccaagctcctctgctctgccgtgtatgcaggtcgcaccaaggtcaagactgtctgaaagctgtgcaagaaaatttatcctcttattaaggctatccaaaagtgtaagctttatatcgtcacggacgattttcagtggacaggacggaaatcctgctcctgtgccgacatctattaccgttgcattttcttttacctcgaaaagtgtgaaaggataaacgctgtcaaaaaaatgctttattgaaattccctcagggtcagtgatagcagtaagatttattttctcgttccattcacaaagcagatctgcataagcttcaaagcgtgaataatcgctgtcagatattgttatatcataattatcaaaaagctttataaaatcgtccttagaaataagctttgacatactattcctccctatggtcattctttgatgagagccataccaaaagcacacctacgtccgcagggtttactccgctgattcggcttgcctgaccaactgatacaggctttatcttattgagcttttcaattgcttcaagtctaagactttttatatcattatagtcaatatcaacaggcaaagcctttttctctagctttcgcatagcctccacctgttcaagctgtatctttatatagccgtcatattttatctgcaattctacctgctcttttacctctgctgaaagctcaggtcgttccttatcaaaaggagcaagaccatcatatgacacctgtggtctgcggataagctgagcaagctttatgccgttgttgagagggtcagtgcctacagattcaagataggcatttatctcaggatttggcgcaatatttatctttgaaacacgctttatctcagcggctatctgtgcatttttgtcaagcaaatgctgatatctttcgtctgagataagccctatctcatgtcctataggcgtgagccttatgtcagcgttatcttgtcttagcaaaagtctgtattcgcttcttgatgtgagcattctgtaagggtctgaacaaccctttgtcacaaggtcgtcaataagagtgcctatgtatgatgacgctctgtcaagaataagctgttttctgccgagaattttcagtgcggcatttattcctgcaataagaccctgtgcggcggcttcttcatatcccgaagtgccgttgaactgacctgcgccgtaaagaccgtcaaaagccttgaactccagcgtagcagaaagctctgtagggtcgcagcaatcatattctatggcataggcatttcgcattatctcaacgtgttcaagtccttttatagtgtgcaaaaattggagctgaacgaactcaggcagtgatgacgacataccttgcagataatattcgtcagtgtcaagacccattggctcaataaaaagctgatgccttggcttatccgaaaatctcattattttgtcctcgatagacggacagtatctaggaccaatagcgtgtatcctacccgaatatataggtgaaagatgtatgttatctcttattaccttgtgtgtttcttcatttgtataagccacatagcatttgactttattttcaagcttttcatgattatcaaaagaaaatggcgttatatcatcgtcaccgcactgaacttcaagcttgtcaaaatctatggaacgcttgtgtacacgggcaggagtgcctgttttgaaacgtcttattgtcattcctgcctttttaagacactctgtaaggctaagtgcaggcaaagttgcgtcaggaccgcttgaatatgatactgcacccacatggacagtgccgccaaggtaagttcccgttgagatgacaacagccttgcaatcgtactcagtgccaagctttgtacgcacaccacggacagttttgccgtcctcctcaaataaaatatcagttatctcagcctgcttcagataaagcccgtcagtatcttcgatagtctttttcataagcttatgatattcaacacggtctatctgcgccctcagactatgaacggcaggaccttttccacggttgagtatcctgctttgcagaaaagttttatccgccgccttgcccatttcgccgcccaaagcgtctatctcacgaacaagatgtccctttgcagttccgcctatagaggggttgcatggcatattggcaacaccgtcaagtgttatggtaaaaagtgccgtctttagtccaaggcgtgccgccgccaaagccgcttcacagcctgcgtgacctgcacctaccacaataatatcaaaatattccttttgcataataaaaccacctgtctgaaaataagaccatataaattactttcctacgcagaattttgaaaatacctcgtctaccaccgcttctgtagctttttctcctgtcagctccaaaagtgcatttgcgccattgtctatcatcacagtaacagcgtccaaagtctctcccatatcaaggctttcaagagccatggcaagatattttcttgcacgttctgcacaggctatttgacgctcgtttgcaaaaatcgtgctgtcagcgtcatatccgccaatgcccaaaagcttctctgtggctttttgcagctcttctctgccctcgtcaagcttcgcagaaatctctatcacatagtctgaatatttttcaagctgagacctttcaacaacattttcaaggtcagacttgttgagaactatgataactttctttccaagctttttcacatattcaagaagctccaagtcttcctcgtcaagctctcttgaaatgtcgaaaacttctatcacaagcatagcgtttttaagctttttctttgcgatatcaacgcctattttttcaacttcatcatcagtttcatgtatacctgcagtgtcggaaagcttcaaaataagctcgccaagctttgcactttcttcgataacatctcgtgtagtgcctgccacatttgtgactatggagcggtcatatcccaacagcatattcatgagggtcgattttccaacgttcggtttgcctgtgataacagtgtcaacaccgtttttcagtatcataccgctgtcatgatctgctattattttatcaagccctgtcaaagcgtttttaaggctctctctgagattatcctcagatatctcaggcaagtcctcctctggataatccacccatgccgcaagttcacctagtattgtgacaaactttcttgacatatcagaaatcagcctgaaaagcctgccctcctttgtgaggtttgcagaattaagtgcatattctccctgagcggagatagtttccattacgccctcagcctgagtaagtgaaagctttccgttgagaaaagccctctttgtgaactcgcccctctgagcaagctccgcaccctgttcaatgcaaagtctgagaactttttttgtaacatatattccgccatggcatgatatctcgcagacgttttctccggtgtatgacttaggcgcacggaaaaccgtcagaacgccgtcatcaacttctctgccgtttttgtcaactatttttccgtatgcacaagaatagcctgccatgttttcaacacttttgcatgacagcggtttaaaaacttttgcacctatgcttatggcattatcaccgcttattcttatgactgatattccgccctcagcgagtggtgtcgaaactgcacatatatctttcatttttacctctttttactccgacagagcctttccctgccatgaatttcttcttcccatttccttgtctatttcgttcataacgcagaattttttcaaactccacaaaggtgcaacaaggtcgtcctttgcaccgtcccctgtcacacgctgtattactatctcagcaggcagaagctccaactggtcgcagacgatattaacatactcgtccatatccaaagcccgaaattctccacgctcatacatctgtgcaagcacagtgccttttaaaacgtgcagaagatgtatcttaatgctttgtatatcgagctgaccgagagttttagccgtttcaagcatcatatccctatcctcaccgggaagcccgtcgatgatatgcacgcacacattcacattgcgttttctcagcatttcatagcctttgagaaaatccgcaaaagtatgacagcggttcattttcaaagccgtttcgtcatgtatagtctgtaagccaagctctacagtaagaaaagtcttttccgcaagctcaccgagcaggtcggctttttcttcgttgatgcaatccgcccttgttgcgatagaaagccctgccgtattttcaaatgacagggctgtataaaacatttttctcagcgtttcaacgtcagcataggtgtttgagcctgcctgaaaatacggtatgcacagacccttgctccactttttgctcattttctcccttatctctctgtactgagtaaggatatcctcatgagggtcgcctgcaaaatctccgctcatttttgccgagcagaacacacagccccccacaccttttgtgccgtctctgttcggacagtcaaggtcaatattaagtggtatcttaaaaaccttagtgccgaacttgtgccttagataataattgtaggtatgatatcttttattgtcatcagaatagggaaaagggttatcaaatctgctattcatctgacggtccctcagtttgctcagtggtaggttctgtagtttctgtcggccgagttgtggtctcaggtgcctttgttgtggtcgtggtagtagtaggaccaggctgtactataggctcagtttcggtgacagtatagtaaggcttgtcattatttgtggtagtggaagccgttgaagtcgttgtggtgcttttagtttcctctggtctgtcaatagcagtggtagttgttgtttttttcttgtcctcttttttctttgtggtagttacttcaccgtcctgcggttttgcagtggtggtgataacattttcgtcaggatcatcactgtcattattagtcggatgatcgaagctgttgtggttagaatcagtattgtcaggagtttcctttatagggtcagtgaccttattgccgataccataaataagagagatacgctcctcaacagctttcatggcgtcaggaaaaggtatactattattataagagtcctccaatgcctgagtgtaatcccctgaaaagaaagtcttgaatgttaaagacagattgttgtcctccacaatgtcgcttcctgaaactgaaataaagaatatgcaggcaaatagcattatgaccgctatggaaagaagatttataaagctgtaatgctcctccaaattcgttttggcaagctcttcagccgcttcctccgcagcctcacattcctccggtatctcatattcattgtcaccgtgaacgatattgaatcgtgtagttttcttatccattagtattttcctctttttatgccgcatattccgccgcaagtgttataacgctcactgcaaaaacaagcactgtcataatggtctttgttatcataactctgccataagccgcctgagacttctgtgaaagctttttaaaaatcttgcagaaagccctttttgcaggtgggcagacaataaagaacgatattactataagggtgatatttttcagcactgcactttttacagacacgctcaaggtgtatttcacatttactcctgcaagtgcaaagagccattttttgtagccatagaagctgtcaaaataaagtccgccaaaaataacgagagctgtcagcaaaagataaatatacttcacaaggtcaggcagctttgaaagcggtctttcaagaaacagcttttcaaggatacaaagcactgccgcacaaagtccgacgataatgaaattcacctttgcctgataccatatagaaagtgccagaccgcaaagtatatagcacacaaaagtaaataccttgttcatgttttttttgcagcagaaaacctcgctgaaaaagtcaacaacagttgtattgaagctttttatcataccagtgaaaagtccgtcagcctcaatgtttgtgtagttgtcaggataaacaaagccgtttgtaagaccaagaccctttgccatatccgaaagtcctgtgaaaagaaaataatactgagccaagaatgacagcataccaagccaacagccaagggtagttatctctttgccgttaagtcctgcaagctttatctgttcaaaaacgcctgcaagaagcaccaccttgccaaaaccaaaaactatcttattaagcccctggttgagctttgctcctgtgatctcacgatgccttatctgtggctcaatatcaccgtatctcacaagaggtcccacaagcatgaaatgcagtgacaccatataagtcaaaaggcagaaaatgtttttttctgctttgcagttgcccttgaaaacgtcatagacataagaaattcctctgagcatataataacccataccaagtggaagtatggcggcgtcaaaactgagcttttttaccttattataaaggatattctgaccgaatattagcataagagatacattcattataatatccagcgccaaaactatcccgcaaagggctttgttctcacggttttttgaaataataagaccaaatatccaatcgaggataactgacaggaaaataagacagaacacaaaaggtctgccccaactgaaaaacagcagggaacaaactatcagaatgaggtttttatattctgcacttctgtcgaaaagcgaaataatggtcattatcgggaacattcccagtataaatataagatcggaataaaccaaaataaattgctccttaatatttttatatgtaaaatattttttatatttttttgtttatgatttatacctataattttatcacaattcactaaatatagcaagcaaaattataaagaaaatctaaatttttcagttttcttcaaaaagtatttgcaattaataaaaactgtggtataattatagtaaataaatgtgcaattctacttggggaaggagtggcagagttggcttcaattttagttacaggagcaagcggaatgataggcttgtaccttacatccagcttactgcacaaaaagcatcgtgtattcggtatagatacacgcaaaaatgagtttattggaactgatccaaactatacttttatccagtgtgatattacagataaggacgctattacaaatgtaatcgatagtaacaagatcgacgttgtcgtgcatctggcaaattctgtagataacgatatagatccatatgtaacagacgctgagatgaaaaagagcaagatatgtgataagttcatatatgcggctgcaaacaaggctgaggtaaggagctttatcctgctcagcacaacagcaatatatggtgtacagaaaggcagagaaccaataagggaaactgctcctgaaaagggaaattcaaactatgcggatcttaagatgacatctgagaagataatgcagaaggaatttaaaaagtctgaaactatacctgttattgccagagtagctcctatttatgacgctgagtatacacaaaatctgagagacagagtatttgacgcaaaggaaaatgttgcatacatattcaatgatggagaatacggtttttcattctgttgtgtattcaatcttatcgactttataaatggtattatcaatgtaccgtcaggaagatatgagggaatctacaatcttgctgattcaaggctgataacggcaaaagagataattgattatgaaaaggaacatcaccgcataggtgcagttatccagaaatcacctggaatgggactaagcatcaacaaaggtaagatgaaaactgattatcgctattttgacccatctatcacattcaacaactggaacatagacaacacaagggcaaagagaatagcacctttcagatggacactttcaaacacaaaataaactcacaaaggcagtcctagggctgccttttttgtattgttccatgtggaacattcgataaaacaggagagctaagatatcatggaaagcaataggttagttaaaatattatgtgttgtctgtgcggcaggctgttgtctttcctcttgcggaagcacaggggaagaaaagcccaaaaaactttcaagcgtcagcacaggagtcaccacaactgtgaccacaaataaaaagtctgccgaaactatcacgggttcagtgactactatacaaacagcagcgacttgtacaaagatagtttttgatggcggctataccctttttgcaaatgtgcagggtggatatactcttataaacagttcaaatgagatagtgaactcttttgagataactgatgataacggtgataagcttgtactgacttgtgacggaaatactgtcactgtcactaaaaacggaaaaaaggtaaactcgttcagttataaaggcacaaggataataatatcagccaacgaggtctactatgcaaacacaaaggtgacatatgttgatgaaagcttcagcagctttaacgtaactgacaaggtgattataagctgtatcgcagagaacaagtttgaaattgtaaaagacggcaagacagtaaagaaagctactgtaaaagatgtgaacggctcgaagtatgtgcttgaagccatggataagggcatggagataacaaacactgataatgagcttatggaatccatagtggtaggcaataactacataagcgtgtcaggggataaggtggtcataaacggaaagaccatgcgaccacctcacagtgcagatataaaagctgtgactacaactgttactacaacaacgacaacggctactactacaacaacgacttcaaagaaaactgaaaagaaaacagaaacgcaaactgaaactgttaccgagcctgtgcaggaagaacagccctctgctcctcagcctgccgaacctgctgaacctgattcaagcacgaatatgtcaaatagaaatctttctgctgaaacatccgaaatgcttggctatgtaaatgaagtcagaaaacagtatggtttaagagagcttgagggacttgagcttctcgactctgcggcagatgtgcgagcgaacgaacttctggaaaattattctcatgacagacctgacggcaattcatacatcacagctatagaagaaattgaccttcctgaatggcgtgcggcggctgaaaatatcgcatatggtatgaacagcatgatcactgtgaaagaggctttcgacgcatggatggattcaccgcctcatagagaaaatatcctcaaccctgatgtgcgttacatggcgtgtgcaaaagccacaaagtcagacaacggggaatacacctattgggaacagcttttttacagcgatatataaaaaaatttggacagactttcgagcctgtccgattttttttgttccatgtggaacattttattctgcctgcttttccgatggtatctttataatatattcgatataatcctcatggtcgatacgttttgcgtcagcgttcactcctgccattctcataacatctatcgccttattgacactgttgaaaaacaatctaacatcttttaacatagccgctcttttgtgatagcttgcacgcttttcatcatctttcagaagcttggcaatatatttttccaatgtgtcaactgtccacccactttcagtcgctttgtttaacacagcaagcctgcggtcattatctgtgatctttagcaaagcccttgcgtgacgttctgacatattgttatcgagaattattttgcattcctcagcgttaagtttcagaatacgaagcttgttagcaactgtggattgagcaagtcccagacgaatagccgcagattcctgagtcatgccatattttgtgatgagctgagagatcgcttcggcttcttcaaaaaagttcaggtcacaacgttggatattctctataagtgcaatgacctgcgaacgttcctctgtggcattgataagtatacacggcactgaccttaatcctgcaagctttgccgcacgcaaacgccgttcacctgacacaagctcaaaagtgccttttacacgcctcactgtgagaggttgtatgatcccgtcctgagaaatgctttttgcaaggcttgttagttcggcaggtgagaaatatcgccttggctgaacagggttcggccttatctctcctatggaaatgtcgattattttgcctaacgtctgatagggtgaagccctttgtgattcgtcagtttcttcggtgaaagcttttgctaatgtttttgggaaaatactcatattttatacctccgtttcgttttaaaataatcataacacttcacgatcctcaattctatattttattcagaaaacttttctgctctttatgaccttgattttgatattggtactttattctttgtattgttttctaaattgtcatgggctttgtcggataaagtaaaaatctgatttgttccatgtggaacattttcaagaaaatttgtaaaagggtcttttcaaaagtgaaaaattgtagtataataaatatgatataattctactaagaaaagaggtcaagaatatggggaaaataattgccgtttcaaatcagaaaggcggcgttggaaaatctactactgttgtaaatcttgcagcggtttttggactaaagggcaaaaaagtcctgatcgttgactttgacccacagggcaatactaccacaagctttggcataaagaaaaaaagtatcagaaatacagtgtttgatgtaatatttgaagaatgttcgatatttgaagctgtcgtgccaacttcctgccgtggagtttcagttgtgccgacaactcaggatctttcaggtgcatctgtgtcacttgtgaatgaaaaggacagagcaatgaagcttcgcaacgctcttatgcctgcaaaagaattttatgactacatatttatagattgtcccccaactctcgatatgctcacaataaatgcacttgcggcggctgattctgtacttatccctctacaatgtgagtttctttctttggagggtcttgttgagcttcacaatactatcaacagagtaaaagtttctttcaatcctgaccttgatattgagggcattttgtttacaatgtgcgttgaaagatataagataacaggtcagataataagcgaggtcaaaaagcattttgcaaaggaagtctttgaaactaccataccgagaaacgttgccttgtcggaagccccaagctttggtgagccagctatttattatgataagaaggcaaaaggctcaaaggcatatgaaaatcttgcaaaagaaatagctaaaagagaaaagaaaaaagcggcaaaaaataaagaaaaataaagaaaaaataacgttccacatggaacattgtatcttataatgtgaaaggaaaatacaatggctaaaaaaagcaaaatggacagaggcttggatagcctgttctttgataattctatagatgagatcgcacgatctgatagtgaatcggtaaaaaatgatgatggtgaaaatggcatttccacagtaaggatatctcttattgagcctgacaaaaatcagccgcgttctgagttcgatgaggatgctcttaatgagcttgcagaaaatatcagacagcatggtgttttgcagcctatacttgtaagacctcttgataatggaggatataaaatagttgcaggcgagcgcaggtggcgtgcggcacgtctggctggacttgatgagatacctgtttacataaaggagcttacagatcttgaagccgctgagatatcccttattgaaaatatccagcgtaaagaccttacacctcttgaagaggccgcagcttatcagactcttatggaaacctatggtcttactcagcaacaagtggcagaagctgttggacgttcacgttccgctgtggcaaactctatcagacttctttcccttagcgaaaatgtgcaggaaatgctccgtgacaaaaagctcaccgagggtcacgcaaaggtgcttgcaggcgttgcggataaggatactcaggaaaagcttgccaacgagtgtatagaaaagggctggacggtaagagagcttgaaaaagctatcgccactttggaaacaaataaaaaagctgaaaagaaaataaagcgtactatcacaaatcctatgtacactgagtttgagataagagtaaatcaagctaccaataagcttcgtgtaagtttaagcgaggataaaaaaggcggctcaaagcttgatgtaaaattcagctctgatgttgatgtggataagatactcaatgccctcgctgaacttcttatgaactgctagttttataatttaaatatatgaaaaatgtctgtttcggcaggcatttttttatctccgtaatacagcacgtctgaaatatgaggaagtcataactaaccgaaaatagggggtttacagcgtataaatcaagaaaaaatgtggtaaaaggtctttacaaattgaaaaataagtggtatactataagagttaaaacagatgtatcctgagaaagtttgttacagcttacttttgaagaaaatatctgctgtccttaaacagacgtgcttgaaaaagtacgctaaaaaaggaaatttgagttttgagcttttgcttgaaatatcgagaaaggaatgattctaaaatggcaagaaaaatgaaaaccatggacggaaacaacgctgctgcttgggcgtcatacccatttacagaagttgctgctatctatccaatcacaccatcatctgttatggcagaagtaacagaccagtgggctgccaagggtaaggaaaacctgtttggcactcctgtaaagcttgcagaaatgcagtctgaggcaggtgcttcaggtacagtacacggctcacttgcagccggtgcgctcacaacaacatatacagcatcacagggacttcttcttatgatccctaacctgtataagatcgcaggtgagcttctcccttgcgttatccatgtatctgcaagatgtgtagcttcacacgcacttaatattttcggcgaccattctgacatctatgcttgccgtcagacaggttttgctatgctttgttcttcaaatgtacaggaggtaatggatctgggtacagttgctcacctctcaactatcgagggcagagtaccattcatccacttctttgacggattcagaacatctcacgagatccagaagatcgagacatgggatatggaagacgtaagagatatggttgactttgagaaggtggaggagttcagaaagagagctcttaaccctgagcatcctgtacttagaggtacagctcagaaccctgatatcttcttccaggcaagagaagcttgtaacccatactatgacgctatccctggcatcgtagaggattacatgaacaaggtaaacgaaaagatcggcacaaactacaagctgttcaactactacggcgcaccagacgctacacacgttatcgtagctatgggttctgtttgtgacactatcgaagaaacaattgattacctcaacgagaaggaaggcacaaagctcggtcttgttaaggttagactttacagacctttccgtgctgacaagctcgttgaagctatcccttcaacttgtgagcagatctcagttcttgacagaactaaggagccaggttctgagggcgagcctctttatcttgacgttgttgctgctcttaagggtacacagttccatgatgtagctatcgcttcaggcagatatggtcttggttctaaggatacaactcctgcacagatcaaggctgtttactggaatgcaagctggaaggatacatataagccaagatttactatcggtatcgaagacgatgttacaaacctctctctcgaaactgagggcaagcttgactctgctccagcaggcacaactgcttgtaagttctggggtcttggcgctgacggtactgttggtgcaaacaagaactctatcaagatcattggtgaccatacagatctgtatgctcaggcatactttgcatatgactctaagaagtcaggcggtgtaacagtttctcacctgagattcggtaagacacctatcaagtcaacataccttatcaatcaggctgactttgttgcttgccataatgagtcttatatcactaagtacaacatggtacaggatatcaagccaggcggaacattccttctgaactgccagtgggagcatgaagagctggataagcacctcccaggtcaggtaaagagatatatcgctgagaacaacatcaagttctatactatcaacggcgttaagatcggtaaggagatcggtctgggcaacagaataaacactgttcttcagtctgcattcttcaagcttgctaacatcattcctatcgacgacgctatcaagtacatgaaggacgctgctacagcttcttattctaagaagggcgacgctatcgttaagatgaaccatgacgctatcgacgctggatgtcagcaggttcacgaagttaaggttcctgcatcttggaagaagtgcaaggatactccaatgggtatgcctgccgctaagtgcgcagataagacacttcaggacttcgtaaacaacattcagatcccttgcaacgctcaggagggcgacaagctccctgtttcaacattcacaggtatggcagacggtacattcccacagggttctgctgcatttgagaagagaggtatcgctgttgacgttcctgcatggaatggtgacaactgtatccagtgtaacttctgttcatatgtatgtccacacgcagttatcagacctgttgtaatgacagacgctgagctgaagaaggctcctaagcttgctcaggagaaggcagtagctatgacaggtatgcctggttacaacttcgtaatgacaatgtctgctctggactgcacaggctgcggttcttgcgtaaatgtttgtcctggtaagaagggcaacaaggctctcagcatgatgccacttgaaactcagctcgctgagcaggaagtattcaactatggtcttacacttgctgaaaagccagaagtattcgagaagttcaaggcaacaacagttaagggctcacagttcaagcagccactgcttgaattctcaggcgcttgcgcaggctgcggtgaaacaccttatgctaagctcatcacacagctctttggtgacagaatgtacattgctaacgcaacaggctgttcatcaatctggggtggttcagctccttcaactccatacacagtaaacaaggacggcaagggtccagcttgggctaactcactgttcgaggataacgctgagtatggttacggtatgttccttgcacagtcaactatcagaaacagaactatcgctaaggttcttgagctgtctaagacaactaaggctgcagctctcaagaaggcttgcgaagagtatcttgaaacagtagacgacggcgagaagaactcagcagctacagataaccttatcgctgctcttaagaagacaaagaataaggctactgaggagatccttaaggacgctgactatctgagaaagaagtcaatgtggatcttcggcggcgacggctgggcttacgatatcggattctcaggcgttgaccacgttatcgctcagggcgaggacgtaaacatcttcgtattcgatactgaggtttactcaaatacaggcggacagtcatctaagtcaactccaacaggtgctatcgctcagttcgcagcagctggtaaggaagttaagaagaaggatctcgcaggtatcgcaatgtcttacggctatgtatatgtagctcacgttgcaatgggtgctgattacaatcagtgcatcaaggctatccacgaggcagagtcttatcacggtccttcaatcatcatcggttatgctccatgtatcaaccatggtatcaagggtggtatgtcaattgctcagacagaggagaagaaggctgttcaggctggttactggcatctgtacagattcgacccacgtcttaaggcagagggcaagaatccatttatccttgattctaaggctccaacagctgactataaggacttcatcatgggcgaggtacgttacaacgcacttgctagacagaatcctgagagagctgagaagctctttggtaaggctgttcagaacgctaaggacagatatgattatctgctcagatacgctaagctttacaatactgaggaaaagtaatctaagttactataaaaaagacgctcatgcacttcggtgcgtgggcgctcttttttcaccacaaaaaaagggtactgccacgttgacagtaccctttatatatgcagtggcgaacagcgttcgaccgtttcttttatcgcatggttaaaatattatggactacatatcctttttgatgagataagttttcagtatagccgcagttgtctttgcgtcagggaacttgttttccatgaccattttgtaagcttcttcaagaggcatttttgttacgtcaaggaactcgccctcgtcaaggtgctgctcaccgaaatcaagtccctctgccatatacatatggattatctcggtatcataagccactgtaggataaatacagccaagataagtcattttttctgcggttgcacctatctcctctttaagctcacgctttccgcactccaaatgatcttcaccatattcaagctttcctgcaggtatctccataagtgcggtcttgaaaggatagcggaactgcttcacaaaataaacattctcgtcctcgtcaagagcaacgatgcaaactccgccagggtgatgaatgacctctcttagcgtcttgtagccgttttcaagctccacttcatcacaagtcaggtgaacgaccctgcccttgtatatctctttttcactgatagttttttcgttctgatacattttatatcctccctttcaggtttatgcgttcttttcaacaggctgagcttcttcttttttctttctgcctgtaaatctcactgcgccaaggtaaacgataagcgagccgaagccaacggctgttattaccttgccccagaaaagtccctttgtttcgtaggtgaactgtatgtcgtttgaccccgcaggacaaagaacagccataaagccgtaatccaccttttctatttccacgtcctgaccattcacctttgcgctccagccgtcatcatatggaactgagaagaacacaaggttatccttgtcaaggtcgatcttggcgttgaaaccgtaagagtcataactgaatgatgaacaactgtttgcacgtctgtcaaggcagttctgataatactgatctgttgagtagtcagtacccttaaagctgtagtagctgagaatattattgtattttgcagcttgttcaggggtaagcacaatggctttcatgagcattgaggtcttgtctacctctgaagccttctgaatgtcgctgtcaaggcagtagtaatcataagtgaagcccattggtacataatatttgttttcgtaaatgttgaaaccgttctgagtatcaacatattcaaagccgtagagatttgcaagagtttcaggcttcgatacctctgtgataccttttctctcactttcagtaagttcattgaaatagtattttacggaaaacaggcttcttagcggatagaccttagtttccattcttgatgcaacatctctcgtttgtccgatagagctgtagaaatccatgatagatgttgaaacaacgctgtggaagcatctcattgatgaaagcttccagaacatacaccagttgtcaacattttctgaggtatctattctgtagaaattattgtcagcattgtagttctctgatccagactccagcttatccatgttgatgttgtcgccaccgtttattgctctgttgatgtagtcggtgttgtcagtaccctggcttacgccgtatacgatagaagaagtcatgcagatgaccaccgcaaccgccgtcattgcagaagcgatcttcatgtagtcgagcttcttctctgcgaccacatatataagcgtgccaagcattattatcattactatagtaacgatagcctgaatgtagtaaagttcaatatattcagggactttgccataggatacaacgccgttttcgtttgtcggaagcagaccgatgccaataaatatcgcacatactacacaaacaggcacaaatccctttttcagatcgtccttgttttctgcgatgacctttgctgtcataaggcacataagcagtataggcatataataccatcttgcataatatgacgcattgaaaaggacgaaagaggagttcaatataggcacgcaagccattataccgaacacgataatagcctttgtaagccaactgtctttgcctttctttctcgttctcataaacgctataacgcctgccattgagaacataggcagatagcctgccattgaagcccatcttgccttgtctgagttaagaatatttattcttgcaggcatatcggaaagcataaagaacgattggataattcttggtattcttacattttcaccgtatataacaaggtcaagtccataaagtctttcgttcacacggtagttgcccattacgctaagcgctgacggcaggaagataacagcggatatcatcacaccgataacagcctcaaggataagcagaccgaacttcttcatgtcaatttcaaagtccttgtcaaggcatctcaggaagaagtagataacaatgaatacgacctcgcaggcaaagaagaaatagcttatggttgcacatatagctaccgctaccgcaaacggacccttcttgttcttttgaaccaacagttcaaatcctaaaagcatgagagggaagaacgcagttgcgtcgtggaagtggttgaagaaaacattgtaggtctggaagcctgagaaagcgtaaagcagaccgcctataaagcaggcgcttgtgttgtcaacaaaaaatctgatgtaagcgtaggctgttattgcggcgatagccgttttcagcgcaaggagccatggtatcagataaggcactgcacctgatgggaaaagtgtagtgagccagaaaaatggcgagccaaggagatagaaagcatatgagccaacaaagctcgagcctaagtccgttccccaatcccagcccatgtttccgctgcgaacagcgtcatgacagtgctgatagaacatcatctgctgtgagttgaagtcgccatagtagagaaagatgcccttgttcactatcattgacggtatgaacgagatcatcatgccgataaaagccaccgcaaacagcagcagatacttttcttttggcttgctgtcagggctttttagaagtccgtttttcttaaacattgtcttgtcctctttttctttactgataatatattggtaaaaaaccatacacaattcattataacacagctacatataaaaatcaacattttaaacagtctttaggacgattttgaataaaaaagctcatatgcaataagcacatgagccagtctgttgcaaaaatgtcaaatcaacgggcgaacactgttcgcccctacatacaaacaacgtgaatatgcaaaagcatatgagcatagttacaatattatttattcccttttctctgaacaatgaagatacctgagcatacaaggataagtgcggctatcccctgaacgccaaaaatgcctttttcaccaagcaggatagttgaaagcaacactccgcacacagggttcataaagccgaaaatcgccacctttgaaacagggttgtgcttcaaaagcactgcccacagcgaatatgccgccgctgatacaaaggcaagatacaaaagcatgagaaaagcctttgcactcatgtgaccgagtctgccgcccattaaaaagcctatgacagtgagaactgctccaccgaaaacgaactgccagccgctaagcataacagggtcttctgtttcggaatagcgcttcatatacaccgatgaaaaagcgtatgcacaggtgcaaagaaaaataaatccgtccccgagaaaattgaagcttacccccgaaagtcccccaagatttataatgattatccccgaaaaaccaagtatacagcctgctattttcacagcggtgagcttttcaagcttgtataaaagcgatgacacaagtatcgcaataaaaacgtttgccccaactattatcgctgcctttacccccgttgtgtgggcaagacctatgtagtaaaaaaaatactgcaaaattgtctgaaaaaggcttattatcattatctttggtatagaagtttttgtggggagcaaaacttttctctccgctccgcttcccatggcaagagccattagccctgccacaaaaaatcttatgcccccaaacacaagctgagagccgctgtcattggtggttatgttcataaggctgtagcctattttcacgcaggaaaatgcacttccccacagcatacagcatatggacgcaaggacagccactacccatgtttttgtcagaatatcttttttctcgttcatacattatcctatctatagcaaatcgtggatcttcacagaaagaccgcagcggcgtaaaatgctgctgcggtcgaaagttactttttgtctttttttgctttcttttcctttttgcgtttcttcttgttttcctttattatcttcaaagggtcgccgaaacgttccttatcgtccttgacaggctcgatagtttcgctctttgtcatgatatccgtcatttgctgtaaaagcatcgactcctcgaacatatccacagcttcctcgcaggtgtcagccttgccgtccacaagaaactgttttatctgctgaacgttcttcatatagtcaagtgacatgaaaggcactctcttttcaagagccttgtagtaatcatctctctgacgttctacctgctttattctgtcatcaagcattattatctgttcgtttatgccctcgttcacttcaacctgcttctgttcagcagcagtaagtctgtatttgttcagtgcgataccgaaaacgcctgcaccgataaaaataagtgcacctgcaataatgcccactataataagctttgtgccaaggagcagccacagcagcaggaaagccgccaatccaatgccgatgcttatgcctaaagacttaattattttattttttatattgaagtttttaacaacataatcgttgtcatggatataggttttgagatattccttgttttccttgctgaccgttacagcgtcctcaaactcaaaatatctttcaaagtattcggcagcacggtcaattttttcaagctcagtttcgttagccatatatactccctcagatcacgaaaaaatttctaaaagcagaaccttttagtcttttgcgtggtgcgtgatagtgaacactgcacaaataacacgctttatttcccaccatattactacaattataacacacggcataatttttgtcaaccatattaagcatagttttcgtaaaaataagacacggacttctgtaattagatttttatagacaggtaaaaaaagaggacgaacacagtccgtcctccagatatgcttaagtatcttactctgctgtttcgttgtttgtaacagtaatgtcaggagcttcgccattttcagcagcttctctagccgccttgcgctcctttgctacccttatgagagtctgcttgatagactccagcatttcctgagtgaaaggaaggttctcgccaaatgggtttacaacaaagccctgtacctttggcgtctgctcagtgagagcagctatatcctgaaatctcattgcaaagctctggaaaggcttgtcatactgaagttttttagcctcctcaggggaagtaaaaacagggaaaaatgtgccgtttgttttgttgttgttgagaagaatgaacttagccttgctcttgtcctcaaaattaacatggttttcagcgtcggcaacaagctctgttgtcttttctaccattgcaggcacgagaaatgtgcaggcaagtgctgtgtttattaccttgttttgagtttcggcacagaaattctttctcatttctgcgatagcttctataagcttagggttgttgtcgaaatttggtttctgattgttagccttgagttctgccatttttaattactccttgtctgtttcttcaagatttgtttcgattataaatttaggtctagcctttgtttccaaatagatcttgcctatatattctccgataatgcctatagccaaaagctgaagtccgcctatcgcccatatagacgtgatagttgaagcccagccctgaacagtgtgccccactgcccatgttataaggaaatatataagcattataagtgatactaaaaatactattataccgatagtggtgataaatcttataggctttacagaaagtgaggttattccctcaactgcaaaggaaagcatttttttcagcggatatttagattcgcccgccacacgctcgtttcttacatacttaacgatgtcgctcttgaagccaaccataggcacaagacctctcagaaacagatttacttccttaaactctgccagagcgtctatagcctttttgctcataagtctgtaatcagcgtgattatatgttatctcaacgcccatatgctccaaaagcttgtaatatgcctgagcagttccacgcttgaaagcggtatccttttctctcgatgaacgaacgccgtaaacaatatcacagccctctgccctcttatcaaggaagccgtcaatagcgtttatatcgtcctgcaagtcagcgtccatggaaacaacgatatcagcatagtttctcgccgtcataagaccagccagcagtgcgttctgatgacctttgtttcttgaaagcttaagacccgtgaaaacagggcttgcttcgtggagcttctgtattatctcccacgttttgtcctttgagccgtcgtcaacgaacatgaccttgctgttctgtgcgatacgaccttctgccttcagctcatcgagtttttttataagcgctttcgctgtgataggcaacatttgttcctcattgtagcatggtatcactacatacatagtttctgtcattttgttctcttatcctttctcatattcgatcccgaacaggcggcaagcgtttctatttgtaatgtcaagcacttcctgcggatcaagtttttttatctcagccacgacctttgccacttcttctatcatagggctttcgcacctctgtcctctgtaaggagggggcgccatgtaagggcagtccgtttcaagaagaagtctgtccattgggacaacttcaagagcacgtttggcttttttagcatttttaaaagcaagcgcacctgtaaacccgatgtacataccaagcccaagcactatctctgcggtctctgccgagcctgaaaagcagtgaactacacctgacggcgtatatttgttcagcacgtcaaggcagtcctgagtggcttcacggcagtgaactataacaggcagacttttcttcacagcatattccacctgcttgtcaaaaagctttatctgtctttctttgtcatatccctcataatgatagtcaagccctatctcaccaaccgcaacaagcttgtgagtagagcaggctttcaaataaagctcgtcaagcacctgcatataattttcaggaagagtatccatacactcagggtgaaagcccacagaggtatagaaattctcatattttttcgcagtttcgattccgaacaaagacgacctttcgtccgttgcggcatggcagaccttgtctacaggagagtcagggtcgcaaagaagcctgtcaaggacctcgtatctgtcctcatcgaaagcgtgatcgtcatagtgacaatgtgagtcaaatatattttttatggcaaggacgtcctttcgtaaaaatatacaaacatattatatcacaactcgccaattttgtaaagctttttattgtaaaaacgggcgaacaaaccgttcgcccgcaaagatctttattttactagaaagctatcttcttttcgatataagctatcagctcgtcgatcttgatacgctcctgctccattgtatctctgtctcttactgttacacagccgtcctcaacagaatcaaagtcatatgtgatgcagaatggtgtaccgatctcgtcctgacggcgatatctcttaccgatagagcctgcctcgtcatagtcaacaaggaagtgctttgaaagctctgcataaagctcgcctgcctgctcgctgagcttcttggaaagcggaagaatgcaagccttgaaaggagcaagtgcagggtggaaacgcataacagttctaacgtcaggcttctcctctgtgccgatgttttcctcgtcatatgcttcgcaaacaactgtcaggaacaatctctcaacgccaagggaaggctcgataacgtatggaacatatctctcgtttgtttcagggtcaaagtaatcaaggctcttgccgcttgtcttgatgtgctgattaaggtcataatcagttctgtcggcaacgccccaaagctcgccccagccaaatgggaagagatactcaaagtcagttgtagcctttgaatagaagcaaagctcctcaggtgaatgatctctcaggcggaggttttcttccttgatgttaaggctaaggagccaatccttgcagaagcctctccagtagttgaaccactcaaggtctgtgccaggtttgcagaagaactcaagctccatctgctcgaactcacgaacacggaaaataaagttacccggagtgatctcatttctgaatgacttacctacctgtgcaacgccgaaaggtactttctttcttgttgttctctggatatttgcaaagtttacaaagatgccctgtgcagtttcaggacgcagataaagctcagactttgagtcctcagttacaccctgaaatgtcttgaacataaggttgaactgacggatatcagtgaagttgtggctgccgcaatctgggcatgggatctgtttttccttgatgtagtccatcatctgctcgtttgtccagcctgcaacgttagtgccgtcgaaatcttcgataaggttgtccgctctgtgacgtgtcttacagtccttgcagtccataagagggtcagagaaaccgccaatgtgacctgaagccacccaagtctgcggattcataaggatagcggagtcaagaccaacgttgtacttgttctcctgaatgaacttctttctccaagcgttcttgatgttagttttcagctcaacgccaagcggaccgtagtcccaagtgtttgcaagaccgccgtagatctcgcttccggggtatacaaagcctctgtttttacagagagccacgatcttatccatggttttttcagaattattcatgaaacattctccttatacaaaatataatactaccattatattttatagcaaaattccgcaaatgtcaaggcgtttcagcgatttattactttgtgtagttatatggctttttatcgttgcaaaaaatcacgcattgtgttataataaaatagtatcgctatgactattcatgtattggaacatattaggagaatttgacttgatgaacagtttttttatcggaaacgttgaaatagaaaagaccgccgcattagcacccatggcgtcggtggcagataaatcatatcgccttatgtgcaaagagtatggtgcgtcatatcttgtgagcgaaatgatatcctctaagggtctgtgctttggcgacaaaaagacggcacgtctttgcgagatagagagtgaggaacgcccctatgctttgcagctttttggggaagacccttattatatgggaaaagcggcttataagctaaacgattattcccctgatatcattgatataaacatgggctgtcctgtgcctaagatagtaggcaacggcagtggctctgcacttatgaagctttctgacactgcggcggagatatgcagagaagtggtaaaaaacgcaaactgccctgttacagtgaaatttcgtgcaggctgggacgaaaacagcataaatgcagtggagtttgcaaaacttatcgagcaggcaggggcaagcgccgtcacctgtcacggcaggacgagaacgcagttttattcaggcaaagccgattgggatataataaagcaggtaaaagccaacgttaagatacccgttataggcaacggcgacgttgttgacggagaaagcgcaaaggcaatgtatgagcagactgtctgtgaccttgtgatgataggaagaggaagctacggcagaccatgggttttccgtgacgtgaagcattatcttgaaacaggggaaaagcttcctgaggtgagcatagaagaaaaaatggcagtgatgaaaaagcactgcgagcttatatgcaaatacaagggcgaacgtcagggcatgaaagaagccagaaaaaactgcgcatggtatgttaaagggctgaaaggctctgcaaggctaagagcgcagtgcggtgggcttaataccatttctgacctttatgagatgatagaccacatacttgcaaacgagttaggagaataaacaatgggaattttatccgtagtaggaacgcctataggcaaccttggagatatgacataccgtgcagttgagaccctagaaaaggctgattttatctgtgccgaggacacaagagttaccgcaaagcttctcaattattttgacataaaaacgccacttgtgagctatcacgaacacaatgcaaaacaggtgggcgagagcattttgaacaggataatggcaggcgagaacgccgctatcgtcacagacgctggtatgccctgcatttcagaccctggggagcttcttgtgaagctgtgcgctgaaaacggtgtgaaagtggaggtagtaccaggtccgtcagcggtggtatcagcacttgccataagcggacttgacactgcaagatttcagttcgagggctttttgtcaaccaccaagaagcaaagattaaatcatcttgcctcggtaaaaaactgcacgaacactcttattttctatgaagcgccccacaagctcatctatactttgaaggatatgctggaatatttcggtgacagaagaatatctctttgcagggagcttacaaagatacacgaagaagttttccgcaccacccttgcgcaggctgtggagtattatgaagccaacaagccaaagggcgaatttgtgcttgttatcgagggtgcaaaagaggacgagctttgccctgcggagaatatagaggaagctttggaacaagtaaaagcccttgtggaaaagggtatgcgtggagctgacgcctgccgtgagatagcaaaggcgacgggtttttctaagggggagctttacggacgcttgtttaaatgaggaatgaggagtgaggaatgaggaattaaggtatcgcctgcggcgatgtttatttcttgttttttcgcatttgtattatatatcaatttagattttttgaggtgattttatgagcataaaagaatacataggcggacagtgtggtaatccagagggattgggcggtatagcctgtgcaaaattcatgaactttttcaatgcagagcactacagagcggtgaaaaaatttgtctgcaagcttgacggtgcaaggatattggatataggctttggaaacggtgtgactatcaaaaagcttagcaagaatataaacgctaagttctatggagttgacatttctgcggatatggtggaaaaagccaagcgagaaaaccgtgacggagtgaataccaacaaggtgatcttacagcagggaaaagctgaggagcttccttataatgacgatttttttgacactgtttacactgtgaacaccatttatttctgggaggacaccgcaaaagttcttgacgaggtaaggcgagttctcaaagacggcggcaattttatctgcacattctatacaaagggctaccttgataagctcccgtactgcgacacaggttttgacaagttcactcctcagcaggtgcgttcaatggctagagagcgtggcttccatgatgtaaaagtcaaaattctgagcgactgcaaagcgtattgccttgttggcacgaaaatagagggcgaataaggtggcagatgtgaccattgtgcctctttcagaggaaaacgtacagcttttttcacaaactgcggcgaaaattttgcccgaagcttggagttttgaaacctacaaaaaacagctttcaaaccctgacgatatatcgtttcttgccctttgtaatggcgaagccgcaggctttataagcgtgtggtgcgtctgcggagaagctgagataaacaatataggcgttttggagaagttccgcagaatgggcattgcaaaagccctttttgacagcgcatacaatgccgcaaaggctgaaaaatggtatcttgaagtgcgggagtcaaaccttggggctataagcttttacgaaaaattgggctttgagagggtaggcatgagaaaaaatttctacaccgcccccactgaaaatgctgttttaatggcacttcaacccactgaaaatggagaaataaatgacatataacgattttacatttgagtccttgggcgagggcattgagatatgtatatctgacgaacaccgctttggtactgacgcctttctgcttgcggatttttcatcaggacggcacaaggatatctgcgcagacctttgcacagggagcggcatagtagcgcttcttctgcacaaattttacaagccgcagaagatatatgctgttgagatacagaaaaaggctcacgaacagcttaaagtatctcttgagaggtcgaaaatagacactatccagcctgttttgggcgacttgaatgattggagaagcgaaaaagagcttgatcttatcacctgcaatccgccctacaagataaacaacacaggtgcgaaaaatgacagcgaagcggtttctatcgcacggcatgaaatgctctgcactattgatgacgtgtgcagatgtgcaaagaaaaatctgaaattcggtggcagactttgcatatgcaaccgccccgagcgcctatgcgatataatgacggcaatgagagccagcggcatcgagccgaagcgtttgcggacagttcacaaaaacccagagtgtcccccatggcttattctcgttgagggcaaaaagggcggaaagccttttgtacagatagaaaagccgttgtatgtgcgttccgcagacggtggaaactcggctgaaatgaagagaatatacggactggaatagtgaggaatgaggagtgaggaatgaggaattaaggtatcgcctgcggcgatgattattttttcgtaggggcgacctttggtcgcctgcttgttccaatttgtctgcttattaaatgtatatgatatgcttatatttacgaaataaaaagagggtaataaaatgaagattttaggaatagaaagctcctgcgatgaaacagcctgctctgttgttgaagacggaaaaacggtgctttcaaatatagttgcaagtcagatagacgaacacaggctttatggtggagttgtgcctgagatagcctcacgccgccatgcggagaacataacatgggtaacaaaagccgctcttgaagaagcaaactgcacaatggacgacatcgacgctgttgcagtgacctatgctccgggacttatcggtgcacttctcgtgggagtgagctttgcaaagggacttgccatgagtgcaggcaagcctcttgtgcctgttcaccatatcgcaggacacattgccgcaaattatatttcacaccctgagcttaaaccgccttatctttgcttggtcgtgtcaggaggacattcacatattgtagaggtgcttgattattcaagatatcatgttataggcagaacaagagatgatgccgcaggcgagtgctttgacaaggtagcgagaacattgggctttgaatacccgggcggaaagtttatcgacaatgccgcaaagtcaggtgatcctaatgcctataagctccctcacccaaaggtacagggcagtgaatatgacttctctttcagcggactaaaaactgccgttataaaccttgtgcataatgccgcacaaaagggcgaaactgtcaatgtgaacgatatggcggcttcgttccagaacaccatatccgacattcttgtagacaaagcaatgcttgccgcaaaagatcttggttatactaccatagggcttgcaggcggcgtttcggcaaactcaggtgtaagagagaagcttcagaaagcctgtgacaagcgtggctataagctttatatgcctgagttcaaatactgcggcgataacggagcaatgatagcctgtcagggatattttgactatcttgcaggcagacgagcagacgaaagccttaacggcattgcaacgctgtcgctggataagatttcggaataatcttatggataaacctgtaaggaaaatcataagacttgaaaattatgattattcaaaaaatggactttattttattaccatatgtactgtccacaaaaacgagttgttgtgggcaacagatgtaggggacggcgcccccgacgtcccgttatgttgcgcacacgctgtcggaaaggtctatctttcaagctttggtaaaattatcagagataatatccacagagcaaacagtgtctatgatgacaaaaagatattgcaatatgtcataatgccaaatcatatccattttatactgaaaatcggtgcgggagtcagcgggacgtcgagggcgccgtcccctacaaacgagatagttccacagtatgtgtcaatgttgaaaagatttataaataaggatattggttttaatatttttcagcgttcatattatgaccatatcatcagaaaccaaaaagaatatatagcaatttcaaaatacatacacaataaccctatcaagtgggacgttgacgagtataatccaagaaatgagaacaataaagcggaggtgcttggaatagaatgaaactactagccatagacggaaacagcataatgaacagggctttttacggaataaagctgctgtcaaattcaaagggacagttcacgaatgcccttacggggtttatgaatatttacctcaaggagataggcgaggtaaagcctgactgcgtggcagtggctttcgaccttaaagcccctactttcagacacaaggcgaatgccgcatacaaagccaaccgaaagggtatgcctgaggagcttgctcagcaaatgcctgttataaaagagcttttgggcgaccttggtataaagatagtacagtgcgagggctatgaagcagacgatattcttggtacgctctcaaaagccgccgcagattcaggcaacgagtgctatattctcactggtgacagggacagctttcagctcgtttccgaccgtgtgacagtacgtcttgccaccacaaaggaaacaaagatatatacccctgacaggataatggaagaatacggcgttacccctcgtcagatgatcgaggtaaaggctcttatgggagatacttcagacaatatctcaggtgtaaagggcataggcgaaaagaccgccctttcccttatcaagcaggagggcgatgtcaagaccctttatgaacaccttgcagatatcaagcttaccccgtctgtgcgtacaaagcttgaaaatggtcatcaggacgctatagacagccgtttccttgccgaaatatgtcttgaagcccctgttgataaagctacagagttttataagctgggcgaggtcgataccgagaaaacaaaggctctccttgccgaccttgaaatgatgcgccttatagacagattgggtcttagcggaaaaactgtggaaagcgctgacagcgcagtgcaggaaagcaagctcaagctttccgacctgcctaagtttgaggtcaagccacttgatgagagcgttatatctgttctcggcaaggacaaaacagtgtattttatctttgccgacaataaactttctatcctctgtaacgatgttatctacaccaccgaggacaatgcaattatcacagctttcatgggaacagcctgcgaaaaaataacctttgagggcaaaactgcccataagtttgcgttctcaaatggcactcaccttgaaaacctcactttctgctgcgaccttgcaggatatcttctcaattcacagtcaagcgagtatacagcggaaaatctttgtctttcatataagtgcctttaccgctctgatatgggcgaatatgcagacctttcaagcctgcctgctcttagtgaaaatctgaaaaaacagcttgaaatgacagaaatgacaaagctattcgacgatatcgaaatgccactttgcgaagtgcttgcatcaatggagttttacggtgtaaaggctgacgcagagggcataaaggctttcggtgaggacttgaaaataaagatagacgagcttacctcgcagatatatatgtatgcaggcaaggagttcaatatagcttccacaaaacagcttggggatgtgcttttcgaggacttaggtctgcctgcaaagaagaaaacaaagtcgggctattccactaatgcggatgttcttgaaagccttatggacaagcaccctatcgtgcctcttatcgttgaataccgcaccctcacaaagctcaattccacctatgttgacggacttttgaagcttatccaccctgacggaagagtccattctgttttcaagcagaccgaaacaagaacaggaaggatatcctccaccgagcctaatatgcaaaatatccccgtgagaaaagagataggcaggaatatgcgtaaattctttgttgccgaggagggatacactcttcttgacgctgactacagccagatcgagcttagagtgcttgcttccgtgtgcggtgacaaaaatatgcaggaagctttctcagagggcagagatatccatacctcaacggcggcacaggtctttgatatccccgaggattttgtcacccctgaaatgagaagtgcggcaaaggctgtaaactttggtataatctatggcataggagcattttctttgtcgaaagatatcggcgtgaccgttgcggaagcaaaaagatacatcaagaattatcttgacaacttcccgaaagtatctgaatttatggataagacagttgatgacggcataaaaaacggctatgtcaccacccttttcggcagaagaagatatatccctgagctttctgcttcaaacaaggtcttgcaggcttttggaaagagggcggcaatgaacgcacctatccaaggtgctgcggctgatatcataaagatagcaatggtaagagtatacaaaaagcttagagaagaagatcttgacgcaagacttattttgcaggtgcatgacgagcttattatagaagcggctgaaaaagacaaggatagagccgaaaagatactcaaagatgaaatggagaacgctgtaaagcttgctgtgccaatgacagtggacgtaaacagcggcagaagctggtttgaggcgaaagactgattttttagtgaggaatgaggagtgaggaatgaggaattaaggtatcgcctgcggcgatgatcttgatttctatatgtaggggcgaacagcgatcacccgtttatccatattgcttattttatatgttttgcccttattatctttgtcaccttcgtggtttggctgacaatttgtttgtgattgttgacgactttttgacggttgtcgcaataatacttgacttttgtgaaatttgtggtataattctctatgtaaaaagtgtgtaagaaagatagataaaaagtagaataataggaatttgaaaaacgaaaaggggctgggaaaatgaaaaaattgctttttgtgttcaacccccatgctggcaagggacagataaaagataacctttgcgacattgtggatatttttacaaagggcggctatgaggtagtcacctaccctacgcaggctaagcttgacggctataacaagctttgcaagtgcggtcaggattatgatatgatagtcatatcaggcggtgacggaacattgtctgaggctgtcaaggcaatgatgacatttgataagaaaataccgcttggatatattcctgccggttcaacaaatgattgtgctcagtctttgagcataccgaaaaaaatgcttgacgccgcaagggagatagttgacggcgtgtattttgattatgacgttggtaagttcaacggtcagtattttgtgtatgtagcaggctttggcgctttcactgacgtttcttatgaaacctcacaaacgctgaaaaacaagtttggtcatgccgcatatgtggctgaggggataaaaaggctttcaaagataacaggtcagcaaatgagagtggagcatgacggcgaggtaatagaaggaagctttatactcggtcttatctcaaacactatctcagtgggcggaatgaaaaagcttatcgcttccggggtgtgttttgacgatggacttttcgaggtggttctggtaaagacccctaagaacgctatcgagcttagcaacacaataaacgaggcggtgcttaataagctcaacgataagcattttgtgactttcaagacctcaaaggtcacattcacaagcgtgaacgaagtgccttggacgctggacggagagtcgggcggaaagcatacatatgtagagatagaaaactgcaagcaggcaataaggttcaaactcaaacccaatgacataaccgcagagcagacggctgttcagtgcagtgcaggggatatgataatgaccgaggacggtcaccctgttgtcattgaggatcagtcggagatcgaagattaagctgttttgtaggggcgacctttggtcgcataccttttaacagaattttgacagaacaaaagcggacgagttttttcgtccgctttttgcatatgcctattttttgtttttctgccgaaactgtgagggggtcatattgtatctgcgtttgaactgccgcatgaaatgcacgtcattttcgtatccgcatacggcggcaatgtttttcactgtcatgtcagtgctgagaagataatactctgcgtttttcattcttgcacagagtatatcctcataacagctcacaccgaaacgtgaggtgtaaagatactgaaagtgggaggggcttacgctgagagttttcgccatatcggcaatgttcctgctcccagagggagagctgtagatgtcagccctgagccgctcaagtgcgtcagcgtagtgactgcgctttcttggcggctgaccgctcttgctgagagaatattcctctccaagtcttatgagcagcattctgagcataagctcgatataatcctcacgcctgccgctttcagataagctgagtctgcttatggtggataaaatatcctcagttttctctgcgtctgataacataaaaatcgtatcatatgggagtgaatagtcacgggtgagcatatcgtcgcaatcaaaatgaagccagtggttaatgtaaaatcccttgcaggcacggtatatctgctcagtgccttttttgtatagtattgcgctgtcaggggaaactgagtattccctgccgtgcaaacgcaccaccgcagaggatttgaatataagcagaagattatcccccgaaccgtttggacggcgtatatcaaaagacccgtcatggctgtagtttagtcccaaagcgtgaagttccataggtttttcctttctaatttcgtatgatgtatcagtataataataggatatatcattgttgtttttttgtcaagtgataaaatataattgaaactaaaatcatacacttttaggaggtcacaatgaagaatatttcaatgcttatcaataccgcagacaaacgttcccacatcaacccggagatatacggacacttctccgaacatcttggcagatgtatctataacggaatgtacgttggcgaaaattctgagataccgaacataaacggcgtaagaaaagacgttatcgaagctttcaaggagataaaaatgcctgttctccgctggccgggaggctgctttgctgacgagtatcattggaaagacggtatcggcgaaaaaacacagcgcaagaaaatgataaacaccaactggggcggcgtgacagaggataactctttcggcacaaatgagttctttgacttgtgcgaagagataggctgcgaaccgtatcttgcaggaaatctcggaagcggcactgttcaggagctttccgagtggatagaatatatcacctttgacggcgtttcccctatggctgacctgagaagaaaaaacggcagagaaaagccttggaagcttaaatatcttggtataggcaacgaaaactggggctgcggcggctcgatgcgtcctgagtattactgcgatgaatacagaagatatcagagcttttgcaagaatttcagcggtaatgagctttacaaaattgcctgcggaccaaattccaacgattataactggacggacgttgtaatgtcaaaccttggtgagtggcacacaaaggctatctctttgcactattacaccgttcctacaggagattggaacaaaaagggcagtgcaactgagttttcagacgaggagtattacgaaactatatcaaaaactctatatatggacgagcttataaaacgtcacagcgagataatgtcacgccgtgatccagagggtaagataggtcttatcgttgacgagtggggctgttggtatgacgttgaggagggcacaaacccaggtttcctctatcagcagaacacaatgcgtgacgctatcgtggcggcttgcaatttgaacatcttcaataaccacagcgacaaggtagtaatggcaaatcttgcgcaggctgtgaacgttttgcagtctcttatcctcacagagggcgagaaaatggtaaagacgcctacctatcacgtctttgatcttttcaaaactcatcagggaggcgagctttgctacagctatgccaacaattgtcaggcaggcggaaagataccgatgatatcacaatctgcctcagtaaaggacggcgtcctcactgtcactatagcgaactgctctatagatgatgacgctcatatctgctgtgatatagcaggagaaaattatcagaacattgagtgcaggatacttgacaatgaagtaagggactataacgattttgataattgtgataaggtcgcaccaaaagagtacagtgcgaaaatgacagaaaagggctttgagatagacctgccaaaatgctccgttgtagttgtgacaatgagataaggactataaggagagtcaaaaatgacagtaaaagataaaattttgcagggaagaacatatcttggcatagaacttggctcaacaagaataaaggctgttcttatagacgatagcttttctgttatcgcatcagggtcgaagcagtgggaaaaccgctttgagaacggctgttggacatattctcttgatgatatccacgggggcatacaagcctgctataaagaccttgcagaaaacgtaaaggcacagtatggcatttatcctgaaacatacggtgcaatgggtatttctgctatgatgcacggctatatggcttttgataagaatgacaagtttcttgtgcctttcagaacatggcgcaataccatgacagctcaggcggcaggagagcttacaaaattgctgggcttcaatatcccgcagcgttggagcatcgctcatctttatcaggcggtgcttaacaaagaagcccatgttccttatatcgcttatatcaatacccttgcaggctatgtgcataaaaggcttacagaccgctttgaagttggcgttggcgaagcttcaggtatcttccctgtggagagcataggataccaaaaagagtatttggagcttacagaaaaaagccttgcagaaaaaggctttgaccataagctgaaagatatccttcctgctgtgagaaacgcaggagaaaagggcgcaattcttacagaagagggcgcaagattccttgactcggagggacgcctcaaagcaggcgtgccggtctgcccgcctgagggtgacgcaggcacaggcatggtggcaacggacagcgttctgaaaaagaccggaaacatctccgcaggcacttccatatttgcaatgctcgtcctcgaaaagccacttaacggtgtttacgaggagatagacgttgttaccacccctgacggctcgcctgtggcaatggtgcattgcaataactgctgttcagagcttgacgcatgggtgaatatgttcggtgagttcgcaaagctcacaggcaatgagatagacaagagcaggctttatgaaactctctataaaaacgccatgacagccgacagctcatgcggtggcgtgacagcctataactgtctttcgggcgaacctgttataaagcttgacgagggcagaccaatgtatttccgcactcccgacagcactttgaccttgggcagctttttcagagcacagctttattcttctttcaccgcactgaaaataggcatggatatcctctttgacaaagagcaggtaaaagctgaaaagataacaggtcacggaggacttttcaaggtcagcggagtggcttcacagcttatggcagacgcactttctacccctgtttcagtaatgaaaacagcaggcgaaggcggagcatggggcatggctatccttgcggcatatatggagctttcaaatggcgaaaagcttgcagacttccttgacaaaaaggtgttcgctgatatggaagtgacaacttctcagcctgagcagacaggctcagagggctataaaaaattcctggaaagatataaaaagggattggcggcggaaaaaaacgcacagttctgaaaaaatcatagaaaatcatagatagatcgtagtggcgacctgaggtcgcccgccaaccaactgtctgctcagactgtcggtgagctattcacttggacggaaaatgagcagacaaaaggtgcatttaccaaatcagagaaaggagaatcttatgcttgaagaattaaaacaacaggtgtgcgaagcaaatctgcttcttccgaaatatggacttgtcacattcacatggggaaatgtttctgctatcgacagagaaaagggccttgtagtcataaagccctcaggcgtgccttatgagggcatgacagccgatgatatggtggtagttgatcttgaaagcggcaaggttgtggagggaaaatataagccttccagcgatactccaacacatttggagctttacaaagcctttgatatcggcggaatagtacatacccacagtcgctgggcaacatcttttgctcaggcaggaaagggcataataccaatgggcacaactcacgcagattatttttacggcgagataccatgcacaagagcaatgacccctgaggagattgcaggtgagtatgaaaaggaaacaggcactgttataatcgaggctttcaaaggtcttgacgcaactcagatacctgccgttctggtaaaaagccatggcccctttacatggggaaaggacgccgcagaagccgttcataatgcagtcgttctcgaagaagccgcatttatgaacttccacgcaatgatgctgaaccctgagataggtcatatgcagcaggagcttcttgacaagcacttccttagaaagcacggaaagaacgcatattacggacagaattgatgtcaatgcctcaaaaagcatgatataagtccgttgaaaaaatgagtcaaataacgggcgaacactgttcgcccctacatataaaagatttgtttagcacatcctcgataaaatagcgccccgattttcggggcgtttttttgcgcctttgctcacatattgtgcaaaatgtatattatatgtacgctgatttgtacaaaagggtagttttttgtacttgttataagtaaattcttgacttatgttttaataatatgttataattaaaataatgtcacggtaatatttattgtgtcacagcggaaatgaatggaatatagtatagatattacctcaaggcaatgccatgcaaggtttgccttagaaacgaggaacggaggcttgtaatgaaaaagcaaattgattacggcagctatgcgtcctataaggaaacggtaaagggtcttacagagaacctgaaatcgctgcttggattgagcgaggagatcgctcttgtcaatactgcggaatctattcgggaaacattggagaaaactgccgaggagcattttgaggtcgctatagtgggcgagttcaagagaggaaagagtacccttatcaacgcaatgctgggtcaggaggtacttcctgctgacgtgctgcctgcaacggctacccttaacagagttacttatagcgaagagccgtatgtgcaggtggaatacaaaaacggcaaaagtgaaagggtggatataaacaagctggaggactatgtaacaaagcttacagcagagtcggaggaaagagccgaaactgtcaaggaagccactgtttattatgataccgagttctgtaagaacaacgtggatatcatagacactccaggtcttaacgatgatgatcagatgaccaacgttactctgtctatcctgccgaaaatagacgcagccgttttcgttatcagtgcaaactcccctttctcacagtttgagaaagagtttttggaaaagaaaatgctcacttccgatgtgggaaggattattttcgttgtaaactgcttcggtactttctcacaggcagacgagaacaagatagtcgaaactgtaagaggacgtatcggaaaatacgttatggaaaaggctaaaaaggtcatgggcgaggattcccgtgagtttgcggtctataaaagaaagataggaactccgagagttatcggtgtttatgcaaagcaggctcttaatgccaaggaaacaggggataaggaagcccttgaaaagagtaacttccctgagtttgaaaaggctcttgaaaccatgctcacaaaagagcgtggcgttatcgcattgcagatacttgcaaataagataacaaattcgggtactgagatactcagaagcgttgttatgcaggaaaacgcactcatgatggctaacgatgagttcatggaaaagtatgacgaggctatcaaagagataggcgagataagaaataagaaaagacaggaatttgtcaagatcaatgatgccgcaaatcaggtgttcaatgacctgcagccagttctggacagctattggacaaacatcgagcagacagctatggaggttatagacaacttccagatgtcctctgacgatttcaagaaagaccagctcaagctcgttaccgcaaagctcaccgagaaaataaaggagagcatagaggcaagagcgcagataatctgcgagcagatacagaacagcatcaacttcgctgtttcctgcgaggctgaaagacttcaggaatttgaggacgagttcttcgagtccgttacaaagatacagcagatgttcactatctccgacagagtttcaaagaatggcggcgtaatggataagataatcggcgttgctatcggctcttacggcgtcggaggattgttcctgggcttcagagagtctggcgtaaagggcgcacttttgggcggagcaacaggctttgcaggattttatgctacttattatacagctatattctttgcaggcttctttggcatcaccgctaccctgccagtgaccctctgccttatggctcttgcaggcattgcaggtacttttacttcaaactttgccgttgataagatacttgttaaggaaagaatagataagtataagtcaaactttaaaactcaggtgagaaagcagttccacgaaatgaagctcaataatgacttcactgaaactgttcgccgtcaggtattctcagcatttgagggtctgaagggcaagatcgagagcgaaacagagataatcctccgtgatactcaggaaacacttgataatcttaatgatcttaaaactgaaaagagcaacatttctcagaaggaaatggaacgtctccatgatattgccgagagcgcaagcgctatagttcaggaagcatatcaggtaagacgtgtgcttaccgaagctatggaaagctgacggtcatataaaaatattattttaggatcaagggaggacaggtcatgagtacaaatacaacggaaagggaaaatccgctgctacagattgacacaagcttccgcacatatttgaacgcttatacaagaagctatcagaaccatatagttgacggcgtgcttgactatgcttttgagtccgactttgccgtaaggcagaagataatgggacttgggggctggggaaagctcgtcaaggcggcaggctcgcaggacgtttctgccgaagcaaagcacctgtttcttaagtgcgagcaggttggcccgcttaaatatcctgatatctatgacattgtgaagaagtgtgccgagcggctagagcttgttgtgcctatcgtctttgtcagaggggatatggataaagcacaggtctactctgtggcaagcgatatcatcgagccttgtatcgtgctttcaaagcaggtagtggaaatgtgcagcaaggaggagcttatgttccttataggctgcgagtgtggaagaatacagaacaatcattgtgcctataatatggcatttacatatctcaattacaataagtatacttacagacccgttgaaaggtcatataagcagactgtgaacaatcagctttatacagcgcttgttcagtgggtgaagtatgctgatataactgcaaatagagcaggcattatctgcctcgataagccgggaatgttcataagcgtcataacagggctttataacaagggctatatcgacttttatggcagacagcagaagaatatggataccgacggacttatcaaaaaggctgagagcgtccatgcagtttcttcaagaaatctgaaaacagataatactatgagcgagcttgaaaagcttgttgtcgcagctactgagtttctgtattgctcagttctttatgaatggcgtggcgacgcagaggattctgacagacaccttgtttcaggtcagatatgtgatgtgcgcagcagtattataatcggaaacggaggcgtgataggtggatagtgctaatatcaatacagcggagcagaatattgcacaggtaaagaccgctcttaaagcctttgttgaaaatgaaaagatagcgaaaatgctcggcaaggattttgtcagcgaaatgaacgattgggaagctcttatcgagaaaaaaagcgaagagcctttcacgctggtcatacttggcgagttcaaaaggggaaaaagcaccattataaacgccctgctgggcaaggagcttgcacctataaacgttacacctgaaacttatactataaacgagatatctttcggtcatacgcagtatgtggaagctatccttgaaaacggcatgagagtgccgctgtcgctggaggatatcacaagagaaaagcttgagcagagaatgaagcttttccctgcaaaaataagctatgttcagataaaggacaacgcccctatactcaaagagataaggatagtggataccccgggcctttctgacttggagagccttgacaagcaggtaatggattatattgttaatgccgacgctatcatgtatgcggcatcatgcctgctgcctttttctgaaagcgagcagttgtttcttgcaagccatgtccagcctcagcgatttggtatgctctatatcctcgtgaatatgatagacgcaatgaactctcagaaggacgctgataaaatactaaagcgtgtgagaaacatatccgagaggatagtgcctaacgctatcgtatacggcataagcggtgcagacgagcttagccgaaagcttggcagagaaagaccgctggacaagggtacaagagagttttacgaaactcagtttttccagttcgagctgtctttgcagcgtgatataatcatgcagaaggacgttatacgttcaaagcgtgttcttacaatgctttcgcagatgtgcgacgaaacagccgcaaagcttagacttataagcgatatggcagagcttgacaagcagaagcttgccgacagagcaaaagagtttgaggagcagtgtgaaaagctttcaaaggctctggaggagaaaaagcctgctttgcacctttctattatcgaaatgcagcaggaggccgaagcttggatgtatgagttcttctcaaagctgagagcaagcattttggactgccgtggaaaagacgcagacggaaacgacctttacagctctgaggatatagaaaagcatttctattcgttccttatggaaaaggtgggcgaagcatatcgaaattgtatcgagagccatagagataggatagccgagatagtggaaggcacaggcagagagcttgcctccgcccttggcatagacgatctttcaaaggcggcaaaggctccgtcagtggaaatgataatgacctccctgaacaagaacgtaacacgttctgttatgggcgttcagcttttcggcaccagcgaaacctttcctcctgccacaatgtcagttttcagccttatccttaaaaagaaaaagcagaccgatataattgatatcgctcttgaaaactatgatgatataagaaataatatcgtcaaggatataaagacagtttatcaggaccttgaaacaaaggcagccgcaaggctcgacagcctttatcagtatcaggtggaaatgggcagagaagccctcaatcaggctcagcagctcatgatggtttatgataatgacgagataaggcagacccttgtggaagcaaagcaaatgcttgccgagccacagaggatactggcagagagcaaattataacaaaaaataaaaacgtcccattaagttggggcgtttttttgataatggcgtaaatatgcttcttgacaaaaaaacaggctgtttttgcagcctgtttggaatgtctaaaaaagtattaaatcaacgggcgacctcaggtcgccgctacattttgtatgcggtaaattatttgtctttgtattgctcaacattgttttctatcttgtcaacagagtttctttctgttatgtcaacacgatagttgtactgagcgttctttgtgacagtgttttcagtgaagtattcaagttcaccgtctttatcgaaaaaataggttgtggaaaagccctttgtgcctatctcctcagcgtcctttcctagctttgaaacgtcataaacatacgtcacagtaacagagccgtcatcaccgataatgtcagaaacagactcaacagctttcggtgcaaacatcagcataccctcgtcagcttgtgggtgctttgcctttcttgtgtactttgaaaagcccttgtcgccctttaccaaatgtgagtattctccgttatcataagtgtagctctcgattccgttgttatactgagcgtattcctttccaccgttcttggcgtagtaagaataggtcagcacatccttttcgtcatacttgaaagtgaactcctgctcgatatcaccagtgtcctcgttggttataacgacttttgcggagtcaagcgccgcatagtcctcccttgcctgatataccaatgtgtcatgctttagctcaggcgtaccgcaggaagtgcataaaaggcagacagccaccgttaaagctactgctgctgtttttagaaatctcattttaaaatttactctccttaaagccccttgcaggtctttgagaacactataagcgccgcagcaatagtgaatatctgcgagatagttgcatggaccataagacctatattgaattttatcacatacaggtctatagcaaagctttcaatgcctacattttttccccatgcaagccagcccacataatccttgccctcacagacgtaagctatgaacgcaccaagtattattcctgccagcatgaaaaatataaacgcaaaagtctttttgaaatttttcatgactgaatatcctctgttttatgtatcggtatctattttcttcttgacggagattttctcttgttgtcaatgacttttttcagatcagaaaatctctcctcgcttgacgccttgaacttgctgagcatatcctcaaaatcagcgtttcctgaattgctgtcagcattgtataccggaggcggatttttagcaaaatcctgtggcgctctgtctctgttgtgatccctgttatagtcgtttctaggtctgccctgaaaattgcctccctgacggttgaaatttctctgaccaccgttaggtctgccctctctgccaccctggtgaccgttctctcttggctttctctgtggcgcaggctgagccttcttgatagaaagcgatatctttccgtcgtcgcctaaattaagcacctttaccttgacggtctgaccctcggtaagatgatcctttatctcgtttacgaatgtgttcgcaacctccgagatgtggaccattcctgtcgtatccttgtcaagctccacaaatgctccgaattttgtgatacctgttacttttccttcataaatttttcctacttcaagctgcatttgatctttgtgtcctctctgcaataaaaattctgctatatgaacggtcaaaagaccgtgtttgccttagtcgctgttgtttacaatataaaatctgcgctcattaggataagcatagcccagcttttcaatagctatcttctccatatactccgcctcgtcgtcagaactgagcagccttgtgtattcatcattgagctgcttggcggcggttatctttttatttatagcgtctgactcttttctgagctgtgctatctgcgcctgctgtgagatgataatcacccctgaataaacaacaagagcggcaacagcaaaaatagtcagaagcttaacaaatcttgatcttttcggctttggattttttttagcagcgtccttttcagcgtcagccgtttcggacgttttatttttaaaacctagcattgcgtactccttttttgattacaaaaccgacctttccataagcaataccccaataactgtcatgaggcgttacctatactcttttctattatacactaatcaaaagagagttttcaagtgcttttagaagttttttttcgcagagaggaaattttgcactttttcacaaaacagtccctgaaaccgtctgctcttttggtaataaatttaaccacaggcgaaaacgttttagcaaatagttttctgatgatcgaaaaaaggctcctcatcacggatacaacagcgtttcctacagtaagatgttctatcacagagcctgttagcataccgactaaaacaaaccctcttatagcccccgtcagcccggtgcaaaatgtgaaaagtgcaaagccgtaaagaaatgtgtaaatgatatcctcaaaaaaggtgagtatcttcccatgtggcaaagccgccctgaataccctgaaaatatcatataaaagtcccagcccgcagcccagaaccacagacagcagaaaaagctccctttcaagctctagccccagttgcatttcttccattttctttcccctttctccgacctcttgcactgtgcaatgacattgcatatacttttggcttaaaaaccgcccgaatacacaccccccacttgtaggggcgaacagcgttcgcccgcctgttcgcagttttttcggtgaatagctatccaacaaaaatgcggatataccgaccacaattagcggtcagccaacgggtgacctaaggtcgccattacatatgttatctgaatatcttccctatcgccgagagctttttctttctgtccttttctccataaaccaaagcccagatatctccctccacggaaacatctccagactcaacgcttatttcgtttatgtgcaggtctttgccttttatcgtcagctctccaagctgtgtgaaaagccttatctcatcctcgtcaaagctgtcaacgtccgtcacgcccgaaagctgtaaacgctgtctgttttcaagaatggcattgtgcctgccctgagtatcattcataaaagcaccccctgatatttttcttatctatgtatattcgctccgtgtaaaaatatttctctgaaaacgttttatatccttgacaaaaacgccttgaaaagctaaaataaacatatgcaaaaaaacatagtatcgaaaggatatgaaaaaatggcagagaataaaaagcttataacagcagacaacagctttcttacttatatgggcagaatagacttttccgaaaaaacacgccctgagttttattacgcaggctcaaatgtaaaaatgactttcacaggcacaagcgtatccgccgtgataaaaaaccataagtatttcaacattcaggagcttggctttgttatggacggcaaagagggcaaggtgacttttgataaaaacgacgaggatatcacctttgatatcgcttgtgaccttgaaaaaggcactcataccgttaccctttttaaaaggcaggacgcttcccattactttgagttcgttggctttgaaatagaccccgacggagaagttcttgaaaatcctcctctccctgcaagaaaaatagaatgctatggcgactctgtttctgcaggcgcagtgtgcgaggcagttgactttgttgcaagctgtgaccctgaggatcatcagggagtatacgataacgcatggcatagctatgcaatgataactgcaagaaaccttggcgcacagatccataatatcgcacagggcggtatcgcaattttcgacaacaccggctattatcatgccccgaattatatcggcatggagtctgtatacaataagctttgctattttccagagggtgcaaagggcgtaacgccttgggattttgagaattatacccctgacgttgtgctttttgcagtgggtcagaacgacccgcataacgaaggccatgaagatttcgatatcgccgaccctgactacagagcaaagtggaaaaatgcctacaagagcattatccttgaccttagaagcaagtatccaaacgcaacatttgtgcttctgctgacagttctctgccacggtgaggagtgggataaagccgttgacgagatagcaaacgagcttaatgacgagaagataacacatttcatgttcacaagaacaggcaaggcgacccccggtcacccaagacttcctgagcagtatgaaatggcggaggagcttacagcttatctctcaaacatgggcgataaaatttggggctaaaagctgaaaaaataataggcgctgtaaaaaaagcgcaacaaagcccgtggattccctcgatatggaagcccacgggctttaatatatcacacagcaaaaaagaactatctaatcttgaaaaaagggtacagcaaacacagcggcacaaaaactgcgtttttgccgtgttaaaaatgtggaaaatattttaaatttatgccgctttttttattgcaggctttttcaagtggaatttatgaagattaaatttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgccttttttttgcgataaggcaaaaaggcggtacgtcggggctgtataaaagcagaatatttgtccaataagaatagtataattcattgatgacttattcggaggactgatattcttgaaaaaaattcttactttacttatttgttttttgaccctttgctcttgcggaggtgaggtaaattctcagagggacaggcttgtgactatggaaaaagcatcggtgatacctgtgtgcggagagaaaaactacactgatgtggaaacgtcacacaagcttaattatactgtgcagaaagctatatggatatcctatattgaccttgctgatatgctcaccgggaaaagtgccgaggagtttcgtgtgaatttttctcaggcgtgcgacaacgctttgagtataggttgtaatacgctgtatgttcacgtcagaccttttggcgatgctatatatgattcggaactttatcctgcatcaagatatataacaggcgtggcaggtgagcagggaggctttgacccacttgaagtcatgatacagaccgcacatgataaggggctttcttttcacgcatggataaaccctctcaggtgtgagaatgaggagtgtttccagacttatgacagaagctttcttctgaaaaagtggtatgatgagggtgacggctacctggaacgggttgagggcgacagccatttgtggctcgatcctgcttatgatgaggtaagacagcttatagcagagggtgcagcggagcttgcggaaaattatgatattgacggcttgcacttcgacgattatttttatcccacaacggctgagaactttgacgcacagtgctttgcggctcagacggagtttgacgatctggcaaaatggcggctgaacaatatctcccttatggtgggggagatatatagtgcggtaaaagcagtggataaggatatcctcgtgggagtttcacctcagggaaatatggagaataactatgagtatatgtacgctgatgtgaaaaagtggtgcagcgaggaggggtatgtagactatatctgtccgcagatatacttcggttatgaaaattctgtgaaaccttatgaggataccctacagcagtgggctgatatctgcacaactgatgttacgctggtggcaggtctgggagtatataagatagacagcgagagtgaattttctgaaaatatcggcattatcggcaggcagataaatgacgctgtagttagttataactacgcaggagcggcggtctacggctatgcaagcttgtttggtggcagtgatagaggtgttcaggagcaggagtgtatcgaaattgcttttgataaacttaatacatctgtaaaatgatatgtgatatataaattatggtatgttaaatgtaaacaaattgtgatatattattataaaatttatggaagtaaacaaaaaactattgaaatttctttttaaatatagtataatgttatatgctgtaaggcgataatagaaaatgtttttgtattatttgcctaaaacaatattattttgctaattattcagggagggattttagtgtacaaaatcgtaacaagaagacagctcaacgacgctgttgttcttatggagatcgacgcaccttacattgccgctaaggctgaggctggtcagttcatcatctacagagttgatgagaagggcgagcgtgttccgcttactatcgctgactatgatagagaaaagggcacgatcacaattattttccaggtagtaggtgcatctacaactgagcttgcaagacttaatgagggcgactatatccatgacgttgttggtcctctcggcgttgctacagagtatgacgagggtatcaagagagttgcagtagtaggcggaggcgttggttgtgctatcgcttatccacaggctaagaagctccataacatgggcgttgaagttgatcttatcgcaggcttcagaagcaaggatatcgttatcctcgaggacgaaatgggcaaggcatcttcacatcttcatatctgtacagacgatggttcatacggctatcacggatttgttacaaacaagcttcaggaacttattgacggcggtgcaaagtttgacgaggtcatcgctatcggacctgttccaatgatgaagttcgtttgcaaggtaacaaagccttatgacatcaagactctcgtttcactcaaccctatcatgatcgacggcacaggaatgtgcggcggatgtcgtgtaactgttgacggcaagatcaagtatgcttgcgttgacggccctgactttgacggtcagaaggtagatttcgacgagcttatgagaagaaactcaacttataaggagcaggaaaaggctcacttgtgcagacttactggaggtgtaagataatggctaatatgagtttgacaaagactcctatcgcagagcaggagccaaaggtaagagctagaaacttcaaggaagttactttgggttacacccctgagcaggctatagaagaagctcagagatgtcttaactgcaagcacaagccttgtatgacaggatgtcctgtaagcgttaggattcctgagtttatcgcaaaggtagcagagggcaagtttgaagaagcatatgctatcatcaaaacaacaaacgctctgccggctgtttgcggacgtgtatgtccacaggagcatcagtgtgagggcaagtgcgtaagaggtatcaagggtgagcctgttggtataggcagacttgagagattctgtgcagactatatgatggacaaggcagttgcagttgaaaaggctgagccaaacggtcataaggtagctgttgtcggcggtggtccttcaagccttacagttgcaggcgaccttgctaagcttggttacgatgtaactatctatgaggcattccatacagcaggcggcgttttgatgtatggtatccctgagttcagacttccaaaggctatcgttcagcacgagatagacaatctgacaaacatgggcgtacatatcatgacaaacatggttatcggcagagttctttctatcgacgagcttatgggcatgggctatgaggctgtattcgtaggctcaggcgcaggtcttccaagattcatgggtatcgagggcgaaggtcttgtaggcgtttactctgctaacgagtaccttacaagaatcaaccttatgaaggcatacaaggacgattatgagactcctatcatgaagtctaagaacgtagctgtagtaggtggtggtaacgttgctatggacgctgctcgttctgcaatgagacttggcgctgagcacgtttatatcgtatacagacgttcaatggacgagcttcctgcaagaaaggaagaagttcatcacgctcaggaagagggcatcgagttcctcgttcttaacaaccctgttaagatagttggcgacgagaacggtcatgtaaacggcatggagtgcatcaaaatggagcttggcgagcctgacgcaagcggcagaagacgtcctatccctatcgagggttcaaacttcattcttgacgttgatacagctatcatgtctatcggtacatcacctaacccacttatcagaagtacaactcctggtcttgaaacaaacgatcacggctgccttatcgttgacgagaacgagtcaacaactaaggaaggtgtttacgcaggcggtgacgctgttacaggcgctgctactgttatcctcgctatgggcgcaggcaaaaaggctgctgccgctatcgacgagtatatcaagaacaagaaataatttcttgtaaatgaaaattatttgttaaaaggcttgaagtttgtgcaaatatctgatatactaatatagtattattagatttggaggtcttttgatgaatttgtcagcaattatttcagttttggcagctgagcagagttcacctgcatcacttgccatgacttttatcccactggtactcataatcgtgttcttctatttctttattatccgtccgcagaaaaagcaggataagaaagacgctgagatgagagataaccttgagataggtgacgaggtcgttacaaacggcggaatcgttggtatcgtgttctctatcaaggacgacactgttgttatcgaaacaggcggcgacagaagcaagatacgtgttaaaaagtgggctatcgctaagaacgaaacaattcatgacggtgacgcaaagtaaatatcgcttttaagggacgggtagttttatccgtccctttttgtgttcttattgtctgtggctttgaatataattttcctagggaattttgtatacgggggtgcggatatgaaaaacaacagactttttgggggcagaaagctttctgtgctgtcatctacggcaatttctgcctgcgtggggtgcggtgcgatatttgttgctgtgcttgcttttgcgtatgttattactaagatagatgccaccgatcttatgctgtcggtgatgtcaacagcggcacttggtatcggagcgtatgcagggggatatgtctgcggaaaaaggcaacgtagaaacggtctgctgtcaggtgtgctgtgcggagtgttcatttttcttatcattgtcattctcagtgcactgttttctaaggcagccgaaagcttttccgtgcctgcaaagcttgtgcttacccttgtgtgtgcaggcgtaggcggagttgtaggtgtaaattctaaaagcagccgtttttgataaggataaatatttatactgcattaaccattcgttcataaaacatagtgggatatgtggtataattaatgtaaatcaattattggaggtaaaatcctatgaaacatatcaagacgatcaataaggctaatctcaagaagactgctgctaagggtggctgcggcaagtgtcaggcatcatgtcagtcagcttgcaagacctcctgcacagttgctaaccagaagtgcgagagagaagcttaatattccgatctttctgaggcgtgcgagcgtacacacgccttgctaaagggacatttttatgtccctttatttttgtataaatttgtatatgaatataaatgcgaaaggtgatttttaaatgatacacaagtttaagcttggcggctttaatgcactgcttgacgtgaacagtggcggagtacatattatagacgatctgacatatgatttgttagacaatgttgagccgccttttgaggagaaatgtcctgaggacgttgtaagaaagctgtcaaagatgtatgacagcaaggatatcgaggattgctatgaggagatagtttctctttataatgacaagatattgttcagcgaggacgattacgagaagtatgccctgtctgctgtggcttcacctatcaaggcaatgtgtctgcatatcgctcacgactgtaacctgagatgtaaatattgctttgcttcaacaggcgatttcggtcagggcagaatgctcatggactatgaaacaggcaagcgtgctatagattttcttatagagcgttcaggagacagaaaatttcttgaggtggactttttcggtggcgagccttcactgaattttggcgtggtggagcagcttgttgagtatgcacgttcacaggaggagcctcacaataaaaagttcagatttactgttacaacaaatggtgtacacctcactgacgagatgatagacttcatcaacaaggaaatgtacaacgttgttctgtctatcgacggaagaaaagaagtcaacgacagaatgagagtgcgtgttgacggttcgggaagctatgacaggattatccctaactttaagaagcttgtggacaagcgtcctaagaacaaggattggtatgtaagaggcacttacacaaagtataatcttgacttctcaaatgatgtaatgcacctttatgaccttggattcgaccagatatccgttgagcctgttatggctgaccctagcgagccttatgctatcactgaggctgacctgccgaggatcttcaaggagtatgagatactttctgagaagatacagaagataagggacgagggcaagttcataaacttcttccattttatgatagacctcgatcagggtccttgtgcgataaagagacttaggggctgtggaagcggaaacgagtatgtttctgtcactcctgacggcgatatttacccatgtcatcagttcgttggtatcaccgagttcaaaatgggcaatctctatgacggcacatttaacgaggaaatgaaagatatgtttgctcacgcacacgtttacaacaagcctgagtgcaaaaagtgctgggcaaagttctattgcagtggcggttgcaatgcaaacaactacatttacgcaggtgatatccacaatgcgcataagctgtcatgtcagatacagaagaagcgtcttgaatgtgctatcatgatgaaggctgttaaaatgctcgacagcgcagaatgaatataaatattttgtaaatttcacgcatggtagcttttatgtacatttataaacttaatatgtacaaaaacgtttgaagtttaacaaaaaaattattgaataatcggtttaaaaagcacggaataacaaatgacgttattccgtgctttctgctgttattacatagtatgataatgtcgaaaaatagcaaaatgcgtctgatatgttaataagtattaagataaatataatgtatactaagctggtagcttattgacaaagtgggtcgaatttagtataagattgacataaacaaaaggtgcttggcggtcatgttaccgcaaatcggctataacgagcgccctctgtatcggacaggataaaccgacaaattattatgaaaaggacgaagagatatgaaaactaatgaaaagaagaatacttctgctaagaagaaacttatacctgcagttgcaatgctcacaacttccgctgtaatgctttctactgctacttacgcttggtttactatgagcagagaagttgaagtaacaggcattaagcttactgctacaactccacagacaatagaagtttcacttggtaaggctacggcaggtgctacaattacgagcaaaactgaggcaactgaacctggcgatgatgaaaaattgtggtcaaacaaggcagctacaagctctgtatatgcaagctttggtaagcttatccctgcttcatcaacggacggaacaaatctctattatacaacaaaagctaaggagaatggtaagtctgttgatataacaggtgcgaatgcttttacacaagctactgaaaataacaatgctggttggacattccaaactgctggagcttcttctgaaacagaaagcaatcttactgcagatacaaaaggtgagggttactatctagatatccctgtttggtttagaactacaaatgttgaagatgtaaagcttggtgttgatgtaactgttactgatccaaatgctgatgatgataacacaaagggtgacttgtataaagcaactcgtgtggctatattgaatgaggatagaagtgctgctaatggtggagttttccttggcgcagaaactgatgtagacacaggatattataagaaaaaagcagttagggctaatacaggaacaagcgaaaatgattattatggcactgtaacagttgcaaaggaagtaactgcaaatacagcaggacaggttacaaatagtgattcaactgaggttgcaaatgtaactggagttggcactggaaagacaggttacagcactcctgctaagtattatatccgtgtatggcttgagggtgaagatgtaaactgctggaatgtaaatgctggacagagctttaacgtagatttgaaattctatgacctttcaaacacaggcacaggtgtttaatccataacaataaaacaaaaaagacgccgaagaaattcggcgttttttggtaaatgggcataaaagataatttaccatatttggggaaacctcccgatttttctttgttttttgtcgaaaatatgctataataatacattggagcagaaaggaagtggctttgctttgggcgaaaattctacagttgacggcgttcgtgccgtggagcttttctatagacctataaaaaataccgacagcggcagggtcacttttttgcagtcgcaaacaaggctcaattctcctgctatgggtacgctaatgcctgcggattatctccctgtggctcagctttccgaccgatgtgttagcattttcaagcttgccttcgttcagcttttgcaggctttgggcaagtttcacgaaagggaagtggacgttgattgggcaagcgtgttcatgcctgcaagatttttaaggcagacggaagctccgagagttgtggcagattattgcgataagtttggcgtgaagtttgagcgtgtctgctttgagttgtcgcctgatgtgcttgatgaagctgacagcacagcggcagataacgtggctcttatgagaagacagggctttcattttctgcttacaggcttcggcactgagggctttaaaatgcttaagaccgctgagttcaaggtagataatatcatgcttgacggctcagtggctcaggttcttggtaagagcgacaggtatgatacctgcgtgaactctctgctgaatttcgtttttgaccttaatgctgaggtcatagctgacggcattactgatgataagcaggtgaaacagctcagcggtatgcagtgcctttactattcgggagaaaatgcaggaaaatatattgcggaaagatacgttcgcaatagaaatgagtaataaacgggtgatacggttttggacggtaaaaatatagataaaaatacaagagtagtcgatacccttgcacttcgcaggaccgccaaggaagctaaacgctatgtggtattgatgagattgcttaaaattcttgccattatacttatcgctatcgtggcggcggcttatgcggtgtcttatttttacgacaagtatggtagctttacagttaagataagtaagtatgatatgataaatcaggggcttactctttcggaaactcctgactataccacgagcaattcaaggctcaatgcggatatcctctatgatatgacaaatatcagtggcgaagatctccctgataatattgataagataaacggcagccataatggcgaggggtatatagcttatactttctatctcataaattccggtaaagatacacttagctatgacagcgaaatgactatcgagaacgtcacgaacggtgttgatgaagctatcagagtggagcttttcgtgaatggcgagaaaaccgtttatggtaaaacaaagtctgacggcagcggtaaggaaagcgattgcgacaaggagttcgcctcctctactgaggtcatgaaggatcgacgtgaaaagcttggtcctggtgagaaagacaagtatacagtggtcatatggcttgagggaaatgaccctgattgtgttgacaaaataatcggtggcacaatgaagcttggtatgaatttcaagatcgttgaaacaacttaaaaaattagaagggaggaagcctcgggtttccgaggttttgaattatgaaaaaagctttgaagatcgtttttaatgttatcgcatgggtggtgcttatctttgcactgcttataacaattctcgtgttctcgtctgataagaataatggtacggcaagtctgctgggatatgtcccgctcacagttgaatctgactcaatgaagccaactttcaaaaaaggcgaccttattatctcaaaggaaatagacgatatcaattctctgaaaaagggcgacgttatcactttctggactcttatagagggcaaaaaagagaagaatacccaccgtatcgcagaggtactcaatgataacggctctgtaggctttatcacacgaggcgatgctaataacgtagatgatacatacactgtttatgcaggtgatataatcggtcagtggaaaggtgcaaaaataggcggtttcggcaaggtaatggattttctcagaacaaaaacgggatttttcatttgcatacttttgccgatagcactgtttttcctctttgagctttataagcttatcgcaaccataatcgagataaagcgtcctgctatcacagagagcgatgaggaagaaataaaaagacgtgcagttgaggaataccttgcacagcagaagaaaaaggaagaggaaaatgcacagcaggagaaaaatgacaaataactgctgcttgggtgatacattatgaatggatttctgaaatggttttttgttttcatgtcgtcaatgcttgcaggctttgggcagatcttcaagggtctgtggaacggcataaaacagatcttcaatataaaaaactacataaggatattcaagacctactcggcagactttggtgcgctgggctggatactttctgtgcttgcaattatcgttgttgtggctatctttgtgcttattatttttatgatagtgcttgctgtgagaaagtacataagattcagacactctattgtcagcaacgaggatcttatcgaagaaatatctgacctgcagcgtcaggtggtcaaaatgaccaaggaaaaagatgagatcatggcaatgaaggtggctcagcttggcgtatatgataacaccgctcttgcagagggtgaaacaaagcttgcagagggcgagcagatgcctgcacagggcgaagttcaaaccattgtggacggcgttgttcagacagcagattgccgtttttcaaagcttatcgaggtggacaatttctacaagacatacgagccgcctgcttacaataatgacatcacccttagtggtatctgcgaagcatacagaaactttgcctgctcaagaatgcacctttattatgacataaaaactatccgacttttcattgcaggcatggcttcaacaaagctcattatcctgcaaggtatctctggtacaggtaaaacatcattgccatattcattcggtaagttcttgcagaaagataccactattgcttctgttcagccgtcatggcgtgacagaactgagcttttctgctacttcaacgagttcacgaagaactttaatgaaacagaagtcctaaaaagaatttattcttctgaatacaatgacgatgtaaacttcatacttctcgacgagatgaacattgcgagagtagaatattactttgcagaaatgctctcgattcttgaaatgcctgatcctgccgagtgggagcttgatcttgttcctaacgtgtggagtaccgaccctgttcgcctggataagggcaaactgcgtattccgcagaacatttggtatatcggtactgcaaataacgacgattccacgttcactatctcagataaggtatacgatcgtgcacagcctatcaatcttgacgcaaagggagttgcctttgacgcacctgacacgccgcctatgaatttaagctttgaacatcttgatacactcttcaaggaagcttttcaaatgtatcctgtttcacaggacagtctgaaaaagatccagcagcttgacctgtgggtaattgaaaagctgagagtggctttcggtaaccgtatacttaaacagatgaacttgtttgttcctgtatatgttgcctgcggcggcgaggagcttgacggcattgactatgtgcttgccacaaagatattcagaaaatttgagtcgcttaacttggcaatgctaagagaagagctgaaagagctttgcacctatatgcagaagctttttggcagaaacactatgaaagaatctatagcatatcttgaaagattgcaaaagctgtactaaaatttgtactcataagctttgagaggagggacgggcatgagcgaatacaacgaacagcgtgcagcttttgacaaagctgtaaagacgtttgacggcaataacagctttgcggcagcccgtgccttgcttctttcgggcgaaaaaactgtatcttttaatcgtaagataatcgagaagaatatagattcgtcctggctcacagagatagaaaaagctttgccacatattgatacggtaataagaaatccaagaaacaccattaaagaagtggaagagatcgtgcctatcgctatgtcaaggaagataacggtagagtccataaaacatctgggacagcacaccgatcttattcaggatatcgacaaaaagactggaaagataactccgtcaaagatactcaacattcataaagaggaaactctcgatacatatgaaaatagatttgtaaatacccttatcgacaggctatacatttttataaatataagatacaataagcttgtccagaccgcagaggcgcaggaggcttattcttttaattacgataccgtggctgacagcggcgacggcagaaaggtcaacattagttttaagatagaaactgttgacagtcttgtcagcggcagcaaggatactgacgtttgggcaaggcttgaaagggtcaaaaaggctatcgagggctataaaggctcagttctttgtaccactcttggcaacgcttttatcagaccgcctgttatgagaacaaacgctatcactaaaaatgtggaccttatggcgtgtcttaccctttggcagtttatcgaaagctacgataaggcaggctacgaggtcaacgtttctgatactgcacaaagacctgatgattcttatatcgaggatatatatggtctgaccgcaatgaactatatgcttttccgctcctatacccatggggcagacaagtcggaggagcttaaaaccataaagagcaagaccctcgcaccaaaggttgtcaggcgttttgataagcagacgtctgataaatatgatgtcatagttggcgagggtgaacaaagtagtgcaagtaagacagatatgggtatgactgccgaagaggcaggaaaccttacggcagagcttgaccgtatagttgagatagaaaagcagtttctcaaagacgaggaagaccgtaagagggctgaggagcttgcggctgcagaagctgaaagaaagcgtgccgagcaggaggaactggagcgtcagcggcgtgaggaagaagagcgcataaggctggagcatgaggaagctgaacgcaggcgattggagcttatccaaaaacagcaggcggagcaggctgcaagagaaaaggcggagcgtgaggaacgtgaacgccgtgaaaaagaggaagagatcaagcatatcgcaagacgcaaaaggcaaatggaagagcgccaacgccgtgaagaggagcagcgtgtccgtgaggaaagagctaggatccgagaggagaaaaagctcgtccgcagcagccttggatctgctatggatcagcagatcagcacgaatgaagaagccgtgtcttcaagctttgtgtcagagtatgagtcctctgagatcgctgcaaaaaaggcgaaagaagcacaacagcagcgtgagcaggaacgtcgtgagcgtgaacgtgctgagcgtcttaaagctgaacgtgaaagctttgaaaataaaaatatcaatgagatatttaaagaatattccaaaaatccatattacatggcaaaacgtggcataacatatgttttggctcacgcatttgggatcatacctgttgtgacggataatccagactatatcaggatgttcaaagtcaagaaggaaaaagaactggctgaggcagagagaaaacgtgcagagcgtgaaatcgagattatctatgaaaaatatgctccgtatcttaaatatgatgtaaagaggcgtatcaaaaacaggcagtttaaaaagagaaaacgtcttgagcgaaagaacagaccgccaagaccatatattccgccacagcgcaccgctgaggagcagaaagctatcgacgctgaaatgaaacgactctataaggagtatcatgtttcagcagttggcagaatggcaaggcatttgaaagagaaatatagcaaacaataacacggagggagcgtcggtatcatcggcaaggcgttgaggatagtaaaaatagctttgacaatacttggctctgctgtgtttgcggcactgctgagtgtgacggtgtacataatggtctgcggctgtatcggcaaaacagcaagcatttttggttacagcgtactgaaagtcgtgagcggaagtatggagccgtctatacatgagggtgactatatttacatcaaaaggacggatactgacagcttaaaggcaggggatatcatttcgttctactctcaagatgatagcattaaaggcgagataaatactcacaggatatctgaggttttgagcgatggcacttttgttactaaaggcgatgctaacaaaatagaggacagcgtgacggtgcaaaaagtcagcattattggaaaatactatgggaaactcagatttttcaagtggcttggttcatttgcatcaacaaagaagctcctcatactgtttgtgataatcccaacagtttgcatggcggtgtatgaggtaaaaactatcgctgagataaaaatatattcaaaccgtgaggaagccttgaaagcggctgaggaagaaaaagaaaagcttatgcgtgaggctgttgaaaaggaagttcagcggctgaaaatgcaggaaaacgagaaaaaggaggcgaacagctttgaatcaggaaaagataatgaaggctaaaatgataacggctatcgttatttgtattgcggcacttgcagggctgttcgtttttatcggcctttatatggacaagtccgaggaagtcagaaagacttacattgctaagtatatggaaaatctgtctgccgcctctgaggagatagacacttatcttgaaagcggcaaggatcttccaacgagatataacatgatactttcggacatgggtgcggcaaggtcgctggtatttcttatcgacgattatactgatgagcagaaggctataaatgagcttcattactgctttgtgaagtatcccgaacaaatgcagggcaagcttgaggacgtaaaaaaagcacttgaccatatcaccgaaaatcttgacaaaggctatagggaagtcaacgagatagttgattcggttgataaaatgggaaattaatgcaaggaggacaataacgtgagcagtaaagggcagcttaaaagagaaataaagaaatgcagacttactatcgaggaaatagagcgtaagagatcacgttcacaatcagcactggttcaggctattcttttgcaggaagagcctaacgaaatggacgttgagtggttcaacaaatacacaggcgagataaccgcttgcagaaaccacatgatagaattgcagaaagagcttgactcgatgaaataatggaggtcgccaaagtggctgagcataaagtgatagagaaagcagacagcgaggaagaaaagaagaaacgcaaactgcttgttataaaaataataccagttgcagtgctggcatttatacttattgcggtcagcttggcttggtttaccattgataaagcccttgatcttgattcatttggaatgaaaagcgtagattcgccatttgaactgaaaacagtaggaagtgccaatgtgcttaaagctgagatacttgacagcgatgactactctaaggtgtctgatgggagcaacatcacttctgacgagaacgacaagatctactggcttcttgatgaagaaagcggtatgactaatggtattaatcctggtagtcatggaaagcttactttttatgttgtcccgaaccagtcgggggaaatggagatacagttcaagttgagtatcacggggtatgcagagaataaaaatgaagacgctgtttcttatgaaaaggttactgaagaagaagtaactagatttatgaatggacatatcatgttttttgagaaatatgatgagaacaatcacacatattctgattttcttcgtgatgaaacattcacaaggacatttaaagattgtaaagtagacgttccgcaggaagtgaacgtatattgggtatggccgaacacgcttggtcagatactaatgaaaagcacagatgaaaatctgacagagaaaaatgtgctgtttgatgataacagtaaagaacgtttgaattttgcggaatatatgaagggtaatttaagcttgttcttgtcaggtgatgccgataaagaacaaaataaaaaggttattgagaatatacataatggtgataaatacagcacagttatcatcactaagctccatgtataatgacgctgacgaaaagataggtacaaaggtgcaatatatccttgttgaactaaacgtatagataagaatattaactttgcacggaggcagttgaaagtgaaagctaatagaaatcagaaaattaatagaatattccacaagctttacagcaagtatcgcaagaatgttatttctttagttaccgctgccgtattgcttgtcacgagtatgccgcttgcagacatttcaggtgttgtgtctaaaatggtatcaactgtcaccaacgctattacggctatggcggcagatacatatactgacatttctaatgatatcaaaaatggcgtttataccatacagaatgcagacgattttaaaaagcttcttaatgcagacccttctgtttatcagaatatcactgtattgttttcaaacaaccaatctcagtttaaggcttctgattttacaggaatagaaaaaggacttggcaatgaaaagtatcctttcaagggaacagtcaaagcaaatgagggttcagctattaatcttcctattaattttgctctgtttgaatatcttagtgacagtgcaaatttagatactattatttttgctagaccggaagaaaaaaattcagctttgcttgctgagaatgttatacacggcgatgtggcttcagctaataagtggaaaataaaagctgatcctgtagatgattcaggtgctacaatttataaatccttcacgtctgttataggaaatatgaaaaatggagcaaatgtcgatctggatatcactctaagtaatggtgtccaggtggaagtatcaggcggggataatgcaggacttgcttgcggcactatggacgaaaacacaagtcttgatgtaagcttgtcaagtagttcgcttgacgtttccggcaaatcgaacgcaggtgtatttgtcgggaaaatgagtactgatgcgacactgaatattgacaagtgcaacaccttgacaggcgtaaatatatccgcaaacaacgcaggcggacttgtgggcagtgcagagaatgcagaaataaatgtcggtgaaggtgtcacccttaccatgaccggaagcgttacaggctctgtaactgcgggcggtcttttcggctcttatacatacagtaaagccaacgaaaagacatttgacatttcaaaattcagtggcatgaaaatggcacttgcttgttcatcaggagataccgctgacagtgcggctgttggctctgttttcggactgctgacaaacagcgcagatagtgtaaaaattagtatcacgggcaccgctaatgatactattatttcaaacttcgatggcactgtcagggcaggcttttatggtggtattgtcggaagatattctgctaatgctcttagctctgaactagcactaagtgatatcattgtaaatgtgactggctcatgcaatgcccttgattttggcggcattattggtaagataggtgataacagcaaggcttatgtaagcgtcaagaataccactataagtattaataatcccacatcatcacaaaataattatggcggacttgtgggctatgcagatcaggcttttattgatgttggcggcaaagtcacagttacggcaaatgatgtttctgcaaaccagagcgtaggtggcattgttggcaaatttaataaaaatggcgttgtaaggcttggcggtgaaacagacctttcaggcttttatcctaaagaccctaacaaaaacggatgtcagatagtaggaaatagaggcattgctttgatctatagcttaagcggctggtcatttacaaggacatcttcaaaagtcatagacgatatggattggggcggagtgcttcgacttaacaattccgatctgcttgagagtgctgacggtgttctgtcttttgatggatcagggcatactgttacaataaatggatttcctaataataatataaccataagcaatagggcagattttgcccgtgcagctttgataatgcagcacgatagcaatgtttttgttaagtatagcggtgctagtagggcagatatgcttgcggcaaatatcagccttagtgcagatgttgatataagcgacacaggtctaaccggatttatgcgtgataatggtgaggatacattcacaggcacgcttactggcaatagtcataaacttaccatgacagtgggaacagaaaatgataaaatagttttccatactcacaacggactttttgcaaagacaagcggtgcaaaaataagcgatttaacgattgtttcaaactttaatattgtcggtgacaatgtttctggcggtgatgcttgttatattggttctgtatctgcatacaacagcggagctttgactattgacaaagtgaccgctgatgtgaccgcatctccaagtggtgcgtatactaattttgtcggaggtctggttggatatgttgctgacgccacaagtgaagtttcgttcactaattctgctgtaacagcaaatcttacatacaataatagcacaacaaaggtagattgcacttgtcttggcggagttatcggaatggtaggcgctgttacatcaaagcctgcaactggtattaagtttgataaagtcactgttggcggaaatataactgacaaacacacaggtcctaaatcaggcagtgctaatgctagagttggtggacttattgccgagataggttcggatatatcatcatctcctaatattgtgaaaatacaaagtgttagtgtaaatactcttaatgtaaaaacttccactaaaatcagcggaagcacaagcggtgggtttattggtcacaactggtataatgttgaagtaacgctggataaaataattgtatctaattctactataacatctgatagtaatgagataggtggtcttgtactttccacaacaggttattggagcataaaaaaggttagctttgacagtgtgacagtaacagcaaacaactgtaaaaattttggcatgcttgcctcaactctttttggtagagattatgactcttatggctttgattattttaaaggtgaaaatgtcaataattacagaagctcacgagatgcaacttattttgaacttactaaacctgatggatataagatctcacaagatactaagataaatataagcccaagctattcgtattttgatgagatagctcgttgtagtatttattattcttcttcagctagttttatgtctaatcgtcaagccataatttcaattcctgctgttacagcggacggagagcgtttgctgtatatggacggaaagaactgcaatacctatcaaaatcaaacaacaaataatggtgctgtgtggaaaaataattcttgggcaagatattattataaccttgatgtatataaaaacggtaaagccaccacaggcggagctaaggctgttgagtggagtgcaaagctttttgcggcaaataatataaaaaattatattaatagcacaaatatagattttccaacagatgcagaaatagatttgacaggatattcattttatccagttgatacaaatggttgtaatataaaatcaaattcaactattacttttgaaaataatggctttaatcagtctgaaatggtatcaagcaataatagtgacaattatgcccgtacaactgacggcatagatggaacaaatttaactaatgaccataatcaacattacatgatgcaatgcggacttttcagaaatgaaaatggagctgttaccataagcggtaaactgacctttcagggaaatatcggtaaggtgaatggtggttcaggtgcattggtttgcggctcggttgctgacgacaccaatactacaaaaaaatttgtcaaaattaccggcagtatcgttcttgatgatctgtatgtgaatgatacttctttaagtttaaatggtgaaaattcttatgcccctttgcttataaataagataggcaacatgacagagatcactatacagaatgtgtcacagaaaaaacacagtatgactgctgaaaaatataacaaaggcggacagaattatgctgcaacaagccttataggcaatgtaggaagcaaaaagggtcaaaatatatctctgactttctcaaatatcaagcttgacgcaagtaatgaaaattcaattttcaaaaatgctactttgcttgaaagctttcagcattctgacggagcaggctcttctgcaatatacaactataaatgggaagacgattggggtacagaagaaaagcataatgtaacctacggaagagaagtgtctgacaccataaagaatcgtgtagatgatgtgagcaggcagaataagtatcatggcgattggagtaaagatgacaggtatacttcccctgtcaaaaataacgcaacagaggaatatagctttactgaatacaagccatatgttgctaaatcgtatgataccgcccaaaactatgatgagatagacgtaaaccttgagcgaccatatttggacgagggttgcggaacatactctgatccatatatccttgacgcttctacacttgcggaggtcgcaagagttatcagtacagccgcacctacaaatggctgggaagtaaactataatgcaaatgtttctgccgatacatcgactgttaatgctaatagtgctttttgcaaaggcactaatcataaaacttatacttatgatggagcaggcaatttcgtaagcggaaaggaaaaagtttcaaaagataacatgatcaaatatctttgcgaggcttattacaagataaatgatgatatagttctcggcagttcttttgcaggtcttggcggaacatcaaacagttacgttttcaggggcgttattgttggacagaagaaatccgacggaacatatccaactatcaccaataattctgcaagcccgctcatcaggttcagcagcggaagtgttgtaaaagatatcaacatagaatataccaaagaagtaacgctttcaaaaaacaataataataaattaaactatagtaccggaaagacggagtattatggtggtgttatgggcgttgtgttcggtggagataatatcatagataatgtcaaggtaacaaatcctaatataacatttgcaaataacgataacagcaaacaacatctcattactgcaggcggatatgttggtgccatagtttatggcggcgttattttcagaaatatggacatcgttgccaaagatagtgcgcttacaaccaacaatactgaggcagtgggtgaaaacgtatataccaatctttttatcaatccatatataggcagagttgtaaacggctttgctatcgaagagggaacaacgtttggtaagtcaactaaccttaacaatggcaggaaaaattatctcatcacgcagtttaagagtgagctaagtgatgatgagaaattaaatgttattgccggcacgaccaatactattgaagtacctaatgcacaagcgttgtttatgctgtctatcatatcacagtccggtatgggatatacagaccgtaaaaacaatacttgcggctatggtcactatacttttacccgaaatgcagactattcaaaagttggcacagctacattgacttctgatgataaagattacaaaactgcgctctcagattatcaaagacttgaaagggctacggctacaagcaaggaatatgaaaagaaaaattctgtaatgctaaaaaaatatacaaagccaagtgaaaaaggtctttatgaagcaaagtgggcacacgaattaaataagaactttactgttgaactcacaggaactggaacctatgacctcaccggaaccggttttcgtggtataaatcagttgtttgatgcaacaaatagtaacttgggcgacattaaatgtgattatactttgtctttgacagctatccagggaaataatcagactataaagcttgatacagatataaaagcctatgctgtgaaaataacggataacaagagcggtaacactattgaaatccaagatatggataactataaatatcgtaccgcatttgcctccgtaaaaggagttgggttgataaactgttcaacgtatgctttaactgtaaataatcttaagctttccggcaagatcagcgttaagacatataacaacgatggacaatcgtatgttaatgaagacctttctacaggtggtattgttggcggagtacagagttcttgcaagtttatcggaataacattgaccgatcttgaaatatatggcgcatatactgtgggaggacttataggaaagtcaacaaatgatattaatataagtaacgttaagtctgaaaacagtggcgtttatgtgtatggcggatttgaaacaggcggtcttgtgggaaattctcagaaaggcaacgaattctctgttaaggattctaagataaaaattaataaagttgaatttgctaatcttgataaaggcacaaaaacttggtttggcgtaggtggaatcgcaggttctgcaaatatcaaaacgacaataagcaatgttcagcttacagcctataatgaagacagctttatcggttcaaaaaaagacaataaaccccttgcaacccagacaatgaacgagggcggtcttataggactgtctaacggagcctgcacaataacaaacacaagcgtcagcgtcgatgtttatggtagtaatgccggtggattcgttggaataaacaaaaaccagttgtctatcaatgactgttactatggaggaacatctgaaacatcagcttgcggtgtttatggctatacaagttcaggcggaatggtcggcacacagaatgcggctgtgactatatcaaagtctgctgtaaaaaatgcaacgataggtataccggctgctaaaaatggtgatgcaggtatcggaggttatgttggcattaaaacaagcggtgatctgaagataactgattgtgaagtcaacaatgttactctgtcagcagaagataagtccaatggtgcaggtgcaggcggtgtgatcggtcataatgaccgtggaagcacatatgcttatgatattctcataaataaattaggctataaaaaaggcaacgaaaacgtgtctgtttctaacttgataggttggaacaatgataaaaatctatcatctaaatttattggagtatcggtaaataacacggattgtttacctgatatacagtataatgcttcacagatacctgccagcttcaccgcagttcactccgactacaacggtactcaggacaataccaaaaatatcggtgagggaagcggcacgcacgttgataactattcaccttatgtcaatataaacccaagcgttactgtaggcggtaagactttcacaggcgatcttgttggccgaaatatgcagactatcattagtgacgctgcttcttatgcgaatggcacaaagacaaaatcctatggcataaacagtaccataaagacatatgcagaggatctggctaattcaaagcttacaacatttcgtcaggcctctgagcttgatgttcaggagctgaacgatcttccagttttgcttattgatgataactcatcgttgaatatcacacaaatgctcgcaaagtatatctcagttgtgacaaattgtgatgtttgcgacagcagttcaaataagctgaaaacaacagatcttatgaatgtaagcacagcaacttatgtgtatgataacgacgttttgaaaaaatcagacaaaagcactcttacgtttaacagcaagacaggatatttcaaggtcacagacggtcagtatgacaatgacggcacaaacagatttactgtcattactcttgattatatcgacccaacgggaagtggcaaaactgctcttagacttcatattcctgtttttgtaagaaaggtgcttgatttcagcttccaatcttacgttatctcaggcacagactataaccattctcactatacggataaaacaaagcttgcttttgagagctttgatgcacctgttactacttattttaagtattcctattacaaatccgctaacgaatgggaaaaaatgcttaataatggtgacagtctgctttggagctttgataaaaagctttatcttattggtgatagtgccactgacagtggtgtgcttaccgatgatacaaagctaactcttgttgatgcaaataacaatgacaagacttatcattctaccgcaagtgatgctaagtttaataaaacaactggtgagcttgacttgacaaatataagtggctttaaaccggttacaatgaatgatgtactgttaagatatgcgtcggtaacagctaaagaatcatctgacggaacacttgttgaggctgatgatgaagctacagctactgtaaaaacaagcgacggcaagtattatagacctgctggtgagaatgaaacaggcacttataagataactgtttcagcgaatagtgatacacctaaaaatgataatgacgaaatgataataagcgagaactattatctcactatcagtattccggaaacgggaagctcaaaaaaagtcatcaagaactttgtgaattattatagtggtaataagccaagaaagctcaatggcaatattcctacaaaccttgtccaagtgacaaataatgacactggcgcatatgttattgcaaacttttttacacagctagtaagtgtgacggctcatgctcctgaggagataacagcgtcaaataactttatccatgccacaatgacttcaaagataagcattgatccgagccttagagatacatttaatggctataagagtgacgatttcaatatgtatcaggcgtttaaattctctatgaagaactttgatgaaaacgatgcgggagctaatgcaaagatcattgcaggaacttcggtgaatgttgattacagcattttaaacagttcagacacagagttatcaaacgcaaaaataagcaagactgagacactttcagaagctaaagacagctatatgctgatgtatcccgattcggtctacgattatatcaatagtgacacaaatggttctataactgtcaaggctgatatcagcttaacttatggtactgcagggatcatagatcagtttcctgagcgtaaggacggggatgcaaaaaccggtattggtgtaaatgcggcgtcttatgttgcatatagccagaacaatattgagaacagctctatctctgcaagtggagttatgcctgccatacgctactatagaaaggcaatgacggtggcacagctaaactataacgttgcagagtcaacggttcttgagtcgaaagattcaccattttcacagcttggtatcaatgccaaagatatgaatacagaagaaatggcaataacagcaaatgctatctatgatctgtctgctttgagccgatcaacaaaggatagtggcaaaaaaatacagtatacaatgaggttgtatgttaaggacaatagtggcgattataagcagactaacgatattagcaaatacctcagtagctttattttggaaaacgccacatcaagcagcggtctgaatgacaaggagtgcgtttttaccactgactataatggcgaagaacaaaacacagccgttacgaaatttacagtaaaaacaggcaaggcttttgaggagcagggacttacctatgcgaactatagagttgagcttaccgcagtattgcttaatgacaacaactcagttgttaatggaactacctcaagcgactatgttgtttacacaaacgcaaaaatagaaacaggctttataaattcataataagcaggcattttcaggagaaaattatgacaaaaagcattttgggaaaattcagaaaattagaaaaaaagaagaagctccagctagtcatagcagtatccatctcggtggtactgcttgtggcactgcctgtttatgcgtggtttactcacaaacgttctattgctcttacaacaaaaataaatgcccctactcagctttatatcaccgcaggaaacaaagaatctgtggcaaatcttgaaatggcagatatagacgttgagaacggcagttataaagactttgttttcggcataggcggggcagacgtgcaacaatatcaaatacagcttgcacatacaacgaatatcccttttgagtatgagatataccgtgcgaaaagcgtcagtgaaactgaaaaatcagaagctgtcgtttatgtttctgatgaagagaataaaacgttttattacaaaatagacggcaataagatctcgggacattatctcaatcagcaaggctcggagatacttgctaacagcacacttcacgaaaagtcctatgacacttatagcaatgttcagaaaaatgccgaagcactttattggcaatcggatacactgacggtaattgacaataaagatccgttttgcgattattttataataagagtaaaatggaatgataaagtccaaaacaataaagaaactgatatggtctacctgacagttcagagaaagtaataattcacaaaatagagaggagggtggctgttatgaaagaccaatttataaaaaagcttaaaagatcgtggcttgcaatatggatagcttttgcggcagccgcactcagtactattggcgtcctggcggcttataccagcgtttcaagtgtaaagcgagttgtgtccacacaaaagggagccggcatgctgttttcatctaattatcttacaacagatgaaaatgatcttccaaggacgataacttttagcagtatggaaaactcgccttgtgtgacagtcaatgtgtgcaactatccgcaaacattgataaagcataatgacaaggatatcacatacactttgacagtcgagcttgtggacagcaacggaaatgccgttaccggagaagaaactgcaaaatactcagttgaatataacggcgaaaaaaagacttttggaagcaattcaaaaatagagttttcacttctgaaacttatggctgacgatttcaacaagcatgaatttgtgctgacttttgataagtcacagctcacaaagtctgacatatacatgagagtgacagccactcctacaaatcaggcagagttgaaaccgctctccgcaaagcttggcgttatctatataaataataacacatcagcaacatggacaggcacattcatcgacaatgctacctcgcctaaagatcttgacggcttcaactaccgactgtcaggcagtggcgagggtactgtcaccctgacttggaatacgaactatgttgatatcagcccatggtttaagaatacttatgatctgactatttcaaaggacagttctggcatggccactgcaactttgaaagtgaattctgctgaaaaaaatcaatatgatattcagttctatcgaacgaacggaattaacagtgcagagcagtggtctgacggtaatcataccgatattacggtgactggtacgggatttgtttcaatgagtttcactcaaagcacagcgaaagaaaattagaatatgtacaaaaaaacggactgcacacaaaatgcagtccgtgtattttttctgtaggggcgaacagtgttcgcccgttattatatccgtgttatgttcagtacgaaagcttagagtgcagacttcaaagcctcagcaagctgagcaggacatgatgtgccacgtccgttgcagtcgataccctcaagtctgtcaataacgtcttgaaccttcatgccctcaacaagctttgatacaccctgtgtgttgccgttacagccacctgtgaaatgcactttctttacgataccgtcctctacttcgatatctatttttcttgaacatactccctttggagtgtagcttatcgttgccatttgaaaaacctcctaaattcttgctacgcctgtttctcttgcagcctttgccacagcctcagccacagcgaccggtacagatctgtcaaaagagttaggcagaataaattccgcattgagcttgtcctcaggaacacagcctgcgatagcctttgctgcagccattttcatttcctcgttgatgtcagaagcccttactgcaagtgcacccttgaaaattccagggaaagcgataacgttgtttatctggttagggaagtctgaacgtcctgtgccaacgataaacgcacctgccgcctttgcctcgtcaggcattatctcaggagtcgggttagccattgcgaaaagtataggcttatcgttcatggatttaaccatttcagcggtcacaagctttggcttggaaacacccacgaaagcgtctgcacccttgagtgcgtcggcaagagagccatggagcttgttcttgtttgtgacctttgccatttcagcgtgagcctcgttaagataattgtcgccctcgcagattatgccctcacggtctaccatgataaggttgccgataccaagagaaagcaaaagctttcctatagcacagccggctgcacctgcgccgtttataacgagtgtaatatcctctatcttcttgttagccaccttgcaggcattcataagtgccgcaccaacaacgatagcagttccgtgctgatcgtcatggaaaacagggatatcaactttttctttaagcttagcctctatctcaaagcaccttggagcagcgatatcttcaagatttatgccgccgaagctgtctgatatcatagcgatggtgtttactatttcgtcaacgtcatttgactttatgcaaagtggaaaagcgtcaacgtctgcgaactccttgaaaagtgcgcattttccctccataacaggcatacctgccagaccgccaatattgccaagaccaagcacagcagagccgtctgtgataacagccacaagatttgcacgtcttgtaagctcatatgaaaggtcaggatctttctgtatctcaaggcaaggctgagcaacgcctggtgtataagccagagtcaggtcttttgcattgtttacctttgctcttgagcagacctctatcttgcctttccattctctgtgtttctgtagggattcttccattacgttcattttatacagtcctctctattacagccaaactaggctttgttacgcattaaaggaacattaccgcatgataatgtccctttattataccatattatttctctgttttcacagccgctttgttagctttttgtgaatttatatgaatgagcttgaaaagcttatcaagattttccttgtcagtggtcatgctcccgatatgtgtcatagtctcattatacagaccgtggaagtcagagccaccagtcactatcaggtcatgttcctttgcgatatccacaagcttctgctgttgagttggagtagcagagtaatgataagcttcaattccgtcaagctttcctgcctcgataagctcaagtagcagttcggtgttgttgaacataacagggtgtgccataacagcaatgccctttgcggaatggataagatcaagcacaaagtttacgtcaggatattcacgggtaacaagacattcgccgtttggatatgcaaaaagcttgtcgttcacagagccgtaaagctcagtggcatagccgtaatttactaatgctctcatgatatgctgtttaaaaatgctctttgagctttttgtgtagtgcagtacagcatcggcagggataggatatcttgccattaccttttctatcatttcctttgcacagtcttttcttatctggcatgacttcaggcaaagaccctcgagcctgtcaggtttctgcggtgcatagcaaagaatgtgtacttttgaattgcgcttcttgtcccatgcggaaagctctaccgcaggaatgaccttgaccccataacgttcgccaagtatttgcgctctgtttgatgatgaaagagtgtcatggtctgttatcgcaagaaagtcaagtcccattctcttcgcctgaacaatgacctcttctataccaagcgagccgtcagacagcgttgtgtgacaatgcagatctcctgtcatacctttgttcctccaaatctataaaatatatctgtcattttctgtatatatagtacagccgttaaatttgactaaataattataacatattttatatacatttgcaagcacttttgaacaatttacacaaaatttgcatgaaaattatattattttgtcgtatatgacaaatcaacagtgtcgaaatagtgcgatttaacgaaatatcagagcttatatccgaagaatttttcgcaaaaccatacgtcttttacctgaaagctcttgccgtttagatattcaagtatgcctgcttcagtggtgaatttaaaggtgagcttgtacgaataaagtgcctgcgttttcacattgtatgcacggttgactttatttattccgtatttgccgtcaccgagaagtggatagccaatgtgagcaaggtgcgcccttatctgatgcgttctgcctgtgacaaggtcaacttcaagaagagcaagatcatcagccttgttttccgcaagcacacgataagatgttatcatggtgcgactgccctcaaatttcttgtcagataccctgacggtctttgtcgcctcgtccttttgatgataagccgtgagccgtgcagacttttcctttggtatgcccactgtcacacaaagataaatcttttcaagttctctgtctttaactttctgattaagcacacgcaaactttcagcatttttcgcacatattacaatgccgcctgtgttgcggtcgatcctgttgcaaagggcaggagcaaaagacagctcctcctcaggacggtattcacccttttcataaagatagtgctgtatcctgtttataagtgtgtctgtcgagccactttcgtcctcatgtaccacaagtccgcactttttgtcgcagaggataatattctcgtcctcgtaaataatattcaaagatgttggcgcactgagaaaagcaggtctgtcagcaacttcgccctcgaaaaattcgtcattgatgtaaagctgcataacgtcaccgcaagcaagccttgtggatatctcacagcgtttgccgttgaccttgatacgctttaggcgtagatatttgtacagcagatttttaggcagcttcggcacagcctttgtgagaaacttgtcaacacgctgacctgcgtcattctgatttattataaattctctcatgtcatacctcagagcttcacacgagctgagaatcctccgtcaataagctcgtcaagaccagtgctgtcagcaccgctttcacggagaagcagaagaatttctgacatatcgcaggctttgcctttacggcgagatatttcctcttcacatttgatagcatattgtaaaggctttttgtcagcagggaagttcacatctgagccttgagcgatgagccatttgatgaaatcaacacttcgcttgtcaggcttgagaacaccatcctgctccacgaggtctgcactttcgattgcagtgagcaggaaagtaagcccgttgctgtcagtgtcgttgtagtccacatcatcagagatgaataagaatttaagctcttccagttcacgctttgagagggtgtagttgtattcgtcatatgatctattcatgttacgtcctcctgaaattattactatagtgatattataacctaaagtgtgggagaatgcaagaggggagcggtattaagtgaggaatgaggagtgagaaatgaggaatgagcaaagctgaccaaagttgtgccccctgcaccgagcgtagcgattttgcggcagaagaacctctccagaacaatctgtaggggcgaacagcgttcgcccgtgctcaggatttgctgtaaattcagaattgtaggggtgcggtgggataattttgtttctatatcaaaatgttgttaccgtgggtttgtttcttcgacgggcgaacagcgttcgcccgtgttcaggatttgctgtaaattcagaattgtcggggagaattttttgctgccgaaccttgttgttaccgtgggtttgtttcttcgacgggcgaacggtgttcgcccctacacatacatcgagctgataccgcaggttgagtaacaataccagtccgaaaaatcgtacatatacgcaaattcaaaaaatattgataaaaaagcctttacaattaaaaataaatgtaatataataagtaaaacaactgttcgattgaggaggcatttatggataagtttcagcttgtttcagattataagctttcgggcgaccagcctgaggcggtggacgctctggtaaagggtatcgaaagcggtatgagagagcagacgcttatgggcgttacaggttccggcaagacctttactatggcaaacgttattgctcggataaaccgtccaacgctcgtgcttgcccataataaaatacttgccgctcagctttgctctgagttcaaggagttttttccgaacaatgccgtggaatatttcgtgtcctactatgactattatcagcctgaagcctatgtgcctagcaaggacgtttatatcgaaaaggacagctccgttaatgacgagatagataagctccgccattccgctacctccgctatcgctgaacgccgcgacgttattatcgttgccagcgtttcttgtatctactccctcggcgaccctgaagagtataagtccatggtggtgtctatacgtcgtggtatggagaaatcccgtgacaggcttatcgctgaccttgtgggtatccagtatgagcgaaacgatataaattttgtgagaaacaagtttcgtgtcaggggagatgtggtggagatattccctgcaaattctactgatacagctatcagagtggagttcttcggagatgagatagaccgtatcacagaaataaacgtagtgactggcgaggtgctttgctcacttgctcacgctgcaattttccctgcttcccattatattgtcagccgtgataaaatgcacgacgctatcgaagagataaagcaggagcttgacgagaggataaagtattttaaggacaacgatatgcttatcgaagctcagcgtatcgcacagcgcaccaactatgatattgagatgttggaggagataggcttttgcagcggtatcgagaactattcccgtgtgcttgcaagacgtcccgcaggctctacgccattcactttgcttgactttctgcctgaggattttgtgcttttcgtggacgagtcacacgtttctctgccgcaggtaagaggtatgtatgcaggcgacagggcaagaaaacagacccttgttgactatggtttcagactgccgtcagcaatggataacagaccgctgacctttgatgagttctattctcatatcaatcaggcggtgttcgtgtcagctaccccaggacctatcgagcaggaaaggtcacagcagatagtggagcaggtaataagaccgacaggtctgcttgaccctgagataatcgtaaagccgactgagggtcagatagaggacttgcttagcgagataaatatgcgcacagctaaaaatcagcgtgtgcttgttactactcttacaaagaaaatggctgaggatctcacaaattatctcaagagctttgacgtaaaggtgagatatatgcaccacgatatcgacactatcgagcgtatggagataatccgtgacctgcgtctgggcgagttcgatgtgcttgttggtatcaaccttttgcgtgagggtcttgatctgcctgaggtaactcttgtggctatacttgatgctgataaagagggtttcctgcgttctgaaagcgcacttatacagaccataggcagagccgctcgaaatgccgagggcaaggtaataatgtatgccgacaccgtgacacgttcaatggaaaaggctatcaccgaaacggagcgccgacgtgcaatacagatgaagttcaacaaagaacacggcatagttccgaaaactatcgtcaaggatataagagatgtaatagagatatccaccaaggaagaggtggaatacgaagcaaggcagaaaacaaagctttcaaagcaggaaactgcaaagctcatagaaaagctcacaaaggaaatgaaagaggcggcaaagctgcttgaatttgagcacgccgcattcttgcgtgataaaattgcggagttaaagggtgagaagaaataaaaagccttgcgaaacataaaacggatatatatccacaaaacgtgtgtaggggcgaacaccgttcgcccacctgcatatcaatatgtgatttttcaataccaaaaggagagtaaagaataccaatgccaattaacgagatagttataaaaggtgcaagagagcataatctcaaaaatgttgatgttaccataccgagagataagcttgttgttatgacaggtctttcgggttctggtaaatcttctcttgcattcgataccatatatgccgacggacaaagacgttatgttgagtcgctgtcatcttatgcgagaatgtttttgggtcaaatggacaagcctgatgttgacagcatagaggggctttcccctgctatatccatagaccagaaaactacttccaaaaacccacgttcaactgttggaacagtcaccgagatatacgactatctcagacttctgtacgcccgtataggcgtgccgcactgtcctgtctgcggaagagagatacgtcagcagactgttgaccagatagtggataagataatggagcttgaagagggtacaaagattcagcttttagctcctatcatcagaggacgcaagggcgagcatacaaaagagcttgaccgtgcaagaaagtcgggctatgtgagagtgcgtatcgacggcataacctatgacctttcagaagagataaaaatagagaaaaataaaaagcacactatcgagatagtcgttgaccgacttgttatcaaagagggcataaagtcccgtcttaccgacagtatcgaaactgtttcatcgcttacagggggacttgtaggagttgacgttatcggcggagaggaaatgcttttttcacagaattatgcctgccctgagcatggtgtttctatcgacgagctgacaccgagaatgttctcattcaacaatcctttcggtgcttgcgaaaagtgtacaggtcttggcgtgttcaagaagatagaccctgagcttattatccctaacaaggacctttccataaggcagggtgcgataaaggcaagcggctggaacagccttgaagaaggctctatcgccatgatgtatttcaacgccatttccgagacctacggcatatcccttgacgagcctgtgaaaaacctcgacaaggacgctatagacattttcctttacggcacgcagggtcagaagcttcacctaaagcgtggcaataagttctataaggctgactatcaggctgaatttgagggcgttataccaaaccttgaaaggcgttacaaggaatccaacagcgattgggcaaaggctgatatagaagcttatatgagcgatgaaaagtgtcctgcctgccatggtgaaaggcttaaaaaagaaagcctgagcgttacagttggcggaataaatatcgcagagctttgtcacaagtcggtggcaaaggcactggagttttttgaaaaccttgagataagcgaccgtgacaagcttatcggtgagcagataataaaagagataaagtcacgtcttggctttctcaaaagcgttggacttgaatatctcaccctgtcacgttctgcaggtactctctcaggcggtgagagccagcgtataaggcttgcaacgcagataggctcatcacttgtgggcgtgctgtatatccttgacgagccgtctatcggtctgcaccagcgtgacaatgataagcttatcgcaacgctgaaaagacttcgtgaccttggcaatacccttatagtggtagagcatgacgaggacaccatgcgtgcggcagatttcgtggttgacgttggaccgggagcaggtattcacggcggcgagatagtctgcgcaggaactgttgatgatataatgaagtgcaagcgttctattacaggacagtatctcagcggtgcaaagaaaatacctgtccctgaaacacgcagacagggcaacggcaagtatctgaaagtcatcggtgcaacacagaacaatctgaaaaacatagatgttgagatacctctcggcactttcacctgcgtaacaggtgtgtcaggctcaggcaaatcatcacttgtgaacgagataatctataaggaacttgcaggcaggctcaaccgtgcgaagatacgctctggagcattcaaggaaatgcaggggatagagcatcttgataaggtcattgatatcgaccagtcgccaataggcagaacgccaaggtctaaccctgccacctatacaggcgttttcactgatatcagagaacttttcgctcagaccgctgatgcaaagatgaaaggctacggtgcaggacgtttttcattcaacgtcaaaggcggaagatgtgaagcttgcgagggtgacggtataatcaaaatagaaatgcactttttgcctgacgtgtatgtgccatgcgaagtctgcggtggtatgagatacaaccgtgaaacgctggaagttagatataagggcaagaacatctatgacgtgcttgaaatgacagtggaagagggcgttgagtttttcagtgctatccctaaaataagccgtaagcttgaaacactgtatgaagttggtcttggctatgtgaagatagggcaggcggctacaacgctttcaggcggtgaagcgcagagagtcaagcttgcaacagagctttcaaaaagagccacaggcagaactatatatatcctagacgagccgactacaggacttcacactgcggacgtgcataagcttatagaggtattgcagaagcttgcagacggaggaaacacggtgcttgttatcgagcacaatcttgacgtcataaagaccgcagaccacattatagacttaggacctgagggtggcgatggcggcggaactatcgtctgcacaggaacgcctgaggaaattgcggcttgcgacaggtcttatacgggacagtatttgagaaagatgctgtagctgtaacaaatgaggaatgaggagagagaatgaggaatgaggagtgaggaatgaggaattggcatagctgaccaaagttgtgcacaagcaccgagcgtagcgattttgcggcagtagaacctcttccgaataaaatgtaggggacgacgccctcggcgtcccgctatccctcgcctgcggaattattggcaaacgtcacaataatgtatcccgaataattcggcatcaggggtgtgataatcacagcgttgcccctccatttagcaaccaaaaaatcccaatatcgaagatataacagttatggtgttatctctccgagcgggacgtcgagggcgccgtcccctacacattatttgtccgaaaaccgaatatacatatttcggtgatgaacttgtttaagctaaaaatcaaaaatacgacttatggaatttcattcagctttttctttgttatagccctcgtgacgatatgctctgcgacccaaacggaaaaattgctcatgacccttgttagctgcgcactccacgaactgggtcacctcgtactcatgaccgctttcggaagctcaccgcaagaaattgttgtctatggaggcggtatccgcatttcccctgataataaacagctgtctaaataccacgagcttgctgtgcttttcggtggtgcagcagtaaattttgccctctgcctgctaacatatctaacaaatggtggtggctttttctgccaggtgaattttctgcttggtgcgctaaacctactgccatttcgctattttgatggtggcaggatactcgccttgcttgccaatggcaaggtctgcgagtttttcagagcggtgtttatactactctcagcggtggctatgatacatatgatactccacggcactgtgagcgtttcttttgccgcaactttctgctttatcgtcctctcggaagtcatatattaacactttgcttattgcttttgtaataaatttttggtataataatacgaaatgcttatgtatctgtaggggcgaacagtgttcgcccgtttcacctcactttgtgtattgctctcgctttactgggtgcggtgagatagtacagacattcaatatcggaggataaaacgttggaagaactgaaaaagaaaatagaaaagctgctgcttaaagtgcagcgtccgtcaaggtatatcggcggcgaggtgggcagcgtggtgaaggataaggataatgtggacgtgcgctttgccttctgttttcctgatacttatgaggtgggtatgtcacaccttggcatgaagatactttatggtctgaaaaatgcccgtgaaaattggtggtgcgagcgtgttttcatgcctgaggaggactacaacaagcttatgcgtgagaacgatatccctctttacgcactggagagccttgaccctataaaggattttgatttcatcggctttacgctcatgtatgagctttcttataataatgtattggaaatgctcgaccttgcaggcgtgccggtgcttgcaaaggacagaactgagcttacaccacttgttatcgcaggcggtccgtgtgcctgcaaccctgagcctatggctgactttttcgacctgttcattcttggcgagggtgaggaagtcaacgtggagcttcttgaactttacgagagaatgaagcctttgaagcctactaagcaggagtttctaagagaagccgcaaagctggagggtgtttatgttccgtctttctatgacgtggattacaatgaggacggcacagtgaagtctatcacgccaaacgtccctgaggcacctgctagggtcaaaaagcgtgttataaaggactttgacaaggtatattacccagagggatttgttgtgccgttcactcagatagtccatgacagagcggtggttgaggtactgagagggtgcataagaggctgtcgattctgtcaggcaggctttatctaccgcccgttcagagagaaaagtatcgacaccataaagaacgaaacaaagtccctttgcgagcagacaggctatgaggaagtttctctttcgtcactgtcaacaagcgattacacagagataaacaagcttttggaaaatcttgtggaatacactgacggcgagcagataaacctttcactgccttcgctgcgaatagacaatttcagcgaagagcttttggaaaaaataaagtccgtaagaaaaagcggtctgacctttgctcctgaggcaggcacacaacgacttcgtgacgtcataaacaaaaacataaccgaagaggagataatgcgtacctgtcgcactgcctttgagggcggttacagcactgtaaagctttatttcatgcttggtctgccagaggaaacgctggaggacgttgagggtatcgcaaagcttgcgcagaaagttcttgacctttattacgaaacaccaaaagaaaagcgtggcaagagtgtgcagatatcagtttctactgcaacattcgtaccaaagccttttactccgttcgagttcgagccacaggcaactcccgaggagataaaagagaaacaggaacaccttttcaaaagtcttacaagccgtaagatacgccttagcactcaccaatcctatacatctatattggaagcagttcttgcaaggggtgacagacgtcttggtaaggcgatatacaccgcatggaaaaagggttgctatcttgacggctgggacgagcatttcaaggctgacaagtggcaggaagcatttgaggagtgcgggcttgatacaagcttctatgctcaccgcagacgttcttatgacgagatagcgccgtggtcgcaccttgattatcttgtgagccacgagttttttgttcgtgagaacaagaaagcacatcaggcagtgactacacgaaactgcaaagagggctgttcaggctgtggcataaaatgcgaatacggaggtgtttactgtggcaaacgctgagccgaagaatgtaaatctccgtttggagagatttgaatacagagccgtattttcaaaaacaggcagggcgaaatacatttctcatcttgatcttatgagagcctttcagcgagtgttcaaaagggcgcacctgccaatatggcacactcagggtttcaatccccatgtgtatataatgttcccacttgcattgccccttggcactgacagcagggtagagataatggactttgctctcactgaagatatcccatacaacgaggttttggagcgaatgaatgcacaaacgcctgttggtctggagatagtgagcgtttcaaagcctgagcataagcataccgacattacagcggcggagtatgtggcaaggctgaaaacagataagagcgtacatgaagtggcggagcttttcggcaagttcatggcacttgacaagatagagatagaaaagcgaaccaagaaaaagactatcaatcttgtggatataaagccacatatcacagtgcttgacagcaaagagctagaggacagctttgaggtgacattaaagctgccctgcggaagctccttcaatcttaatgtgaacgtagtcatagacacgttctgtgagcgttatggtatagaaatatcggaaatttatacagaacgtacaaaaatactcatggcaaatggcgaaaattttatataaatatccttgcaaaaggttttgagatgtggtataatattaaagcatttgaattaccgtcggttcttccgacgagagttaatgccacgcctttgaacgaaaggcacgacattaaagcgggcagtcctctggctttgcagcgatagctgccataaagcgaatgaatgtctgaaaatattaaggaggaatttaaagtggacgctttaaagcagatttctaattcaagccttaaatccgaggcacctgttatcaatgttggtgatacagtaaaggtacacgtaagaattacagagggtgacaagtccagaatccaggtattcgagggcacagttatcgctaagaagcacggtggaatccacgagacattcacagttcgtagagtagctcacggctgtggaatcgagagagttttccctgttcattcacctgtagttgaaaaggtagaggttgtacgcagcggtaaggttcgccgtgctaagctctattatctccgtgacagagttggtaaggcagctaaggtcaaggaagctatcagataattctttctataaaaatgagtcggctttggtcggctcttttttttatatccacgactgagttgttcgcacgatatacggtaggggcgaacagcgttcgcctgcatatatcgcccgacaattttatgatattcgtacattcgttatattttcacaaaccatgtagggcgtcgtcccctacagttctgaatttgtacaagttctgagcatgggcgaacactgttcgcccctacagattatttgggatagtttgtcttgccgcaaaatcacatgacatttcaccgtcacattgcacaaaatgtcagcacttgatttgtgcaaacaaatgatttatattttaatttggcaacatttctgcaattgttgcatttttttatgcaacaaaacgcccttttttctggataagtagagggggataattacctctgcttcacagagaaaggacgataaaaatggcaaagaattttcacacagacaacaaagctttcatgctttacaaagactgggaggacatttttcaggcgcttgacagcagcgaagagataggcgagcttgtcatggcgctgtttgcttatgcaaagaggggagaaacaccaaagctgtcaggcggagcaaagatagcgtttcttatgatgagggctgctatcgagcgtgacggcattgcatgggaagaggtgtgtgctcaaaggagcgagtgcggtaaaaagggcggcagacctaaaaagtatgatgagtcagggaatactgatgaaaaagctgagcagacagctgcatcagcagataatgcagaagaaaaacctcagggtataaatgataccgcagaaaaaccaaaagctttttcacaaaccaaaaggttttcagaaaaagcaaaaaaagctgataaagatatagataaagacaaagatacagatatagatatagacaaagatacagataaagatatagacaaagataaagataaagctatagataaagagaaaaagaaagacgcagggacagcgaagtctgtcgtcaggtctttcggcacacacaaaaatataatgctcacatcagagcagtataacgagcttgaaagcaggtgtcggtctgtcggtctgtctttagagagctatatatctaaattatctcaatggctgtttaccaagggcaggcactgcacagacccataccgcataatctcaggctggcttgacaatgattcaaagagaaagactgcggcaaagcccaaagaaagacaaggctgcgatctgtcgtggtatgatgactttgccatgaattttgatctgtcaaagttcctgtagggggtgttttgctgtacttgccatatctgcacgatgtatgtgtaggggcgaacgctgttcgcctgtcgaagtaataagcccacggcaacaacaaggttcggcagcaaaaaattctccccctacaattctgaatttacagcaaatcctaagcacgggcgaacactgttcgcccctacagattattcgggagagtttgtcatgccgcaaaatcgctacgctcggtgcttgtgcacaactctgttcagctatgctcattcctcattcctcatttctcattcctcacttaaaccctccgctccccctatctcaaagaaattttccttacccccttgtaatttgttttgaaatttgatataataaatctatatgagtatttgacggcttttgccgcctttggataaaggatcgaggcttttatggacgataataaaaaattcggcgacgtttctcaggaggatattgacaaggctaaaaaagccgcccctgacgacctaaaggaaaaacagcccgtgaatgttatggacgaggtctttgaatgggctgaatctttcgtgttcgctatgtttatggtgatcctgatatttacttttttcttcaggatagttcttgttcagggtccttctatgcgtgagaccttgcaggatcaggatagacttataatcactcacataaattatacaccccaaaagggcgatatcgttgttatcaacagcgaaaagcttggcaaaactatcatcaagcgtgttatcggcaccggtggggataaggttgtcgttgattataataacaacaccgttacagtaaacggtaaggtcatttcaaatgacaatatcagggaagctatgtataacactaatctctttgatgagaaatatgaagtggaagaaaatgtttttgagtatgacgtgcctgagggcaagctgttcgtcatgggtgataacagaaataattccacagacagcagaaggataggctttatcgacccgtctgacgtgcttggcaaggcagttttaaggctttatccatttgacagctttggtaaggtaagttgaaaaagcagggcaaaagagctgttgataatctgttcgactttcttgagatcatagtcatggcaatgttcgtggtcgtgcttgtttttacttttgtgtttagaacagtgaatgtacaaggacagtcaatgcaggacactctttttgaaaatgattctcttgttatatcaaaactgctttatacgccaaagcagggggatatagttgttgtcaactcgtctgttcttgacaataggataatcaaacgtatcattgctgtagaagggcaaaaggtcgagatagacaacaagtcggctatagtcaaggtcaacggagcagtgcttgatgagagctatattaagtgcgacggcagctttgatgacgagtattttgatgaaagatactataataaagaaagtgaagtttatgaatatgaagtgcctgcgggatgttgctttgtaatgggcgacaaccgaaatcattccacagacagccgtgtaataggatatgtgccttatgacgagatagttggcagagttctgtttcgatttgcggcaggcaatgatgagggcgttggtaaggtagattgagttagagtaaggaggaagatatgagcgaagtatctcacgttcagtggtttcctggacatatggcaaaaacgcgccgcataatggcgtcaaatctaaagcttgtggacgcagtggtggaaataactgacgctcgtatcccgttttcaagcagaaaccctgaaatgaagcgtatcgtaggctcaaagccaaggcttgtgcttctcaacaaggctgattcagccgatccggaagtaacggcaatgtggctcgactattatgcaaaacagggaatcacagcacttgctacagattgtaggagtggcaaaaacgtaagtaagttttatggaaagctcaaagagcttttaaaggacgatattgagaaatggaatgccaagggtatgtctggcagacctataagaataatgatagtcggtataccaaacgttggcaagtcgtcatttataaacagacttgcagggtcaaggcttgcaaaagtcgaggacagacccggtgttacaagaggtaaacagtgggtgaagcttgacgagggctttgaacttttggatatgccgggtgtgctgtggcctaagtttgaggataagcttgttggcgaaaggctcgcatttacaggtgcagtcaaggacgatataatggacatggaatatcttgcctgccgtctgcttgagtttttgaaagagaactatcctgagcttatcgagaaacgttatggcatcagaacagatgatatagagcctgctgacgaggaaactatcggctgtgtggtaggctttgagcttcttgaaagaataggcagaaagcgtggctttttagtttctggcggagagataaataccgaaagggcagccattacagttatggacgagttcagaaacggtactctcggcagacttactcttgaaaagccaaaggggtattgatatgacgctcagcgagtttgacaacgagataagaaaagattataacgtggtgtgcggctgcgatgaagctggcagaggtcctcttgcaggagatgtgtttgcagcggctgtgatatttgataaggacacagttatagaggggataaatgacagcaaaaagcttacagcgaaaaagcgtgaggagctttttgatgagataatggaaaaagcagttgacttttctatacagaccgcaacagtggaagagatagaggatataaatatacttaatgccgcaatgcttgcaatgaaaagagcggtggaggatatggatacaaagcctgacgtctgccttatagacgggaacaagacccctgaggggcttgagtgtccagccatagcggtggtaaagggagatgccaaaagtcaggcagtggcggcggcttcaattcttgcaaaggtcgcaagggacaggtatatggagcaaatggctgaacaatatcctgagtatcggtttgagaagcataagggctatggcacaaagctccactatcagatgatagaccagtatggaccatgcgggatacatagaatgagttttctcaaaaagtattatgcaaagaaaaatgggcattgaccatacccagcgccgaaagacgggcaatatcggggaggacgcagtttgcggctttcttgtaagacacgggtatgagataataaagaggaattttaccgtcagaggcggtgaaatagatataatcgcagagaaagcggatatcatagccttcgtggaggtcaaaactagggagcatggctctcttacctccgctgaagaggctgtcgatccggtcaagcagcggcatatcgttcagacagcacaggctttttgtaaggggattttagagcctgtgtgctgtcggttcgatgttgcggcggtggagctggagaacggcagagtcaaaaagctaagatattatgtgaacgcttttgatgcaagtatgaaataaagaccatgggtcggatatgccgaacgaactgtgtctgtaggggcgaacactgttcgcccgtgacgtggaatgttagacgttatctgaacaaatggtctgtaaatagccgacacctgtcggacatctaaaacaagaagggttgttgtttatgttttacaaaagtacaagaaacagcgaagtaaaggtttcgtctgcacaggcgatagcacagggcatttctgaggacggcggtcttttcgttccgtctgagatacctgccataacacttgatgatatcaaggctcttggcgaaaaaagctacgctgagagagcatttttcgttttctcaaagtacctcacagacttcacagaggctgagatacgctactgtgtagagggtgcttacaacacaaagaatttcgacacagacaatattgcagagcttgctcacctttttgacggcacttatatgcttgaactgtggcatggtccaacttgtgcatttaaggatatggctctccagatacttccatatctgcttacaacttctatcaagaagcttggcgttgacaagaaggtagttatcctcgttgctacatcaggcgacactggcaaggctgctctcgagggcttcaaggacgttgagggtacagagatactcgtgttctatccagaggacggcgtttcagctatgcagaaaaagcagatgacaactcaggagggcggcaacgttggcgtttgcgctatcaagggcaactttgacgacgctcagacaggtgttaagactatcttcacaagcaaggaaactgccgacaaacttgctgagaacggcatgatgttctcctctgcaaactctatcaactggggcagacttgcaccacagataatctactatgtatctacatacgctcagcttgttgctgacggcgagatcgagcttggcgacaagataaatatagttgttccaacaggcaacttcggtaatatccttgcaggctactatgcaaagcatatgggtgttcctgttaataagcttatctgcgcttcaaacgcaaataacgtcctcacagactttataaagacaggtatttatgacagaaatcgtccgttccatacaactatctcaccttctatggatatccttatctcttcaaaccttgaaagacttctctatcaccttagtggctctgacgacgctcagataagagagtggttcggcagcctttccaagactggcagatatgaggtaacagacgaagtgaagaaggctatcgctgacgagttctatgcaggctgctgcgacgatgagcagacaaaggcttgcatcaaggagatctatgacgagtattcctacacttgcgacactcacacagccgttgcagtgaaggtatacaaggattatgcggctgctactggcgacaagacaaagactgttatcgcttcaacagcaagcccgtataagttctcaggctcagttcttgcagctatcggtaaggatacaaacgctgacgagttcggccttgttgacgagcttgccgaggtttcaaagatacctgttcctgcttcacttgctgcacttaaggataaggaagtaagattcacaaaggtaatcgacaaggctgatatgaaggactacatctactcagctctgggtatttgatatgtacccgtccgactattgtcgggcggaggtcagcgcacagcgtatgtccactgaccatggcgaggggaattagcctcttgccttgaatgtcttgcactctgtttcgtcacagcagttaggatcggtgcaggtacagcctacattgatcttgcctgcggtacattcgcagttgttgctgttgtaaacgcagttgtctacgttgcagtggataccgtaaattctatccttctccatttgtacatcgctccttccgcagctttttgctgcaaaagtagtatgtgcatgagtggtcgggataatacatgaagtttctggaatggaggaaaaaccgtgagcctatttgccattgccgacttgcatttgtcgctgggtacagataaaccaatggatatattcggtggctggtctgactatgtgacaaagcttgaaacaaactggcagaacaaagttcgtcctgaggacactgtggtgatacccggtgatatctcgtggggaatgaattttgagcagtcgaaaaaagacttcgagttcataaataagctcaacggcagaaaaataatatccaagggcaatcacgattattggtggaacaccaagaacaaaatggataaatttttcgcagaaaacggttttgataccataaatattctgcataataatcattacagctatgagggctacggcatatgcggaacgagaggctggataagcgataatggtgagcctgcagatcagaaggttctggcaagggaagcaggcagacttgcgctctctatcgagtctgcacaaaaggcaggcttagagcctgtggtgtttttgcattatccgccgcttttcggcaatagctgcaattatgatatgcttgaagtgcttcataaatacggcataaaaaagtgtttttacggacaccttcacggaagagcccacgcttatgcaataaacggcactcgtgacggagtggaatatcggcttatagctagtgatttcttgcattttgacccattggacataacgaaaattgtgcaaagtgacaatttataaaaaaatgctggaaatgacaatatatttgtgctataatgtataagatacatttatataatggaggaataataaatgagtttaaaagctacaaacaatgttgaaaccaataagtacgagcttgagatcgagatctctgctgaggattttgaggctgcaatagagaaagcttatcttaaagcaagaaagaatatcgctatgcctggcttccgtaagggtaaggctcctagaaagcttatcgaaaaggaatacggcgagcaggtgttttttgaggacgctgtaaatcttctgtacgctcctgttgtaaacggcgcagttgaagagtccggtctggaacttgttactcgcccagaggtagaggtaactgagatcagcaaggaaaacggcgtaaagctcaaggcaacttgcatcacaaagcctgaggttgaagttaaggactataagggtatagaagttgaaaaagttgtcaatcctgtaactgatgaggatatcaacaagcagcttgacgctctcagagagaagaatgtaactgttgagacagttgacgacagagcagctgagaacggtgacgacgttgttatcgacttcgagggcttcaaggacgatgttgctttcgagggtggtaaggcagaagatttcacactgtcacttggaagcggtcagttcattcctggctttgaggatcagatcgttggtcacaacgccggtgaggatttcgacatcaacgtaacattccctgaggagtatcaggtaaaggaacttgcaggcgcacctgctgtattcaagatcaagctcaagagcatatcaaagaaggttatgcctgagctggacgatgatatggtaaaggattcaacagagttcgatacagttgacgaatacaaggctgacgttaagaagaagcttgaggaagctaacgagaagcacgctgattctgaggtagaggctaagatattcgataaggtcatcgagaacatgacagctgagatcccacaggtcatgtttgacaacagagtaaacgagatgatcagcgagctggagcagagacttgcaccacagggcatctcacttgatctctatatgcagtatacaggtcagactatcgacactgtaaagaaggcatatgctgagcaggctgagaagcaggtcaagctcagacttgcacttgagaagatcgcaaagcttgagaatatcgaggtaactgaggacgagcttaaggctgagttcgataagcttgctgaggcttacaagcttgacgttgaccagatcaagcagtttatccatgatgacgaccttaagaaggatattgcagttggcaaggctgttgaccttatcaaggacgcagcagttataaagtaagataatttatgctttcgcccgcatgaccttatgcgggcgaaaatagattaaggaggcaattttatggcattggtaccttatgtagtggaacagacaagcagaggcgagagaagctatgacatttattcccgcctgctcaatgacagaataatcatgctctgcgaccagatagacgacgcagtggcaagcgtagtagtggcacagctgctttatcttgagggacaggatcctgaaaaggatatcgacctttatataaacagccctggaggagtaatcactgccggcatggctatctatgatactatccagtatatcaagtgtgacgtgtcaactatatgcatgggtatggctgcttcaatgggttcattcctgctttcaagcggcacaaagggtaagagatttgctctgccaaacagtgagatactcattcatcagcctcttattgcaggcggcggaatttctggtcagtgtacagatatcaagatacattctgaccacatggtaaagaccagagagaagctcaacaggatacttgcccagaacacaggcaagcctatcgagcagatcaacatcgacactgagcgtgacaattatatgacagctcaggaggctcttgaatacggtcttatcgacaaggtaataactaacagataggttcggtgaaataaatggctaatgatacaataagaaaatgctcgttctgcggcaagcctgaggacaaggtaagaacacttttttcagcaggcacgagccacatttgtgacgagtgtgtactttattgctataatgttctggctgagcaggagggacttcctacaacgaagcagcgtggcaagggtaaaaattcagctgacagcggcataacccttaagaagcctgcggagataaaggcggttcttgatgagtatgttatcgggcaggaggaagcaaagatagcgctttctgttgcggtatacaatcattacaagagaattttgtcacttaatgacgatgatgacgtagagatacagaaaagtaacgttttgcttcttggaccaacaggaacaggaaagactttgcttgcacagactttggcaaggcttctgaacgtgccttttgctattgctgacgctactacgctcacagaggcaggctatgtaggtgatgatgttgaaaacgtgcttacaaggcttattcaggcggcagattataatgttgaagcggctcagaacggtattatttatatcgacgagatagataagatatcaagaaaatcggagaacgtttctatcacaagagatgtaagcggtgagggcgtacagcaggcacttcttaagatagtagagggctgtgtgtctaatgtgcctccacagggtggcagaaagcacccacatcaggagttcatacagatagatacgaagaatattttgtttatctgtggcggagcttttgagggacttgacagtgttatcaagaagcgtacagagtcatcatcacttggttttggcggaaaggtcaagagcaaggaggatgataacaatgtgatgaagagggtagtaccacacgatcttgttaagttcggtatcgtaccggagcttgtgggcagacttcctgttatcacggttcttgatgagcttgacgaggacgcactttgcaggatcttgactgagccaaagaactcacttatcaagcaatacacgaagcttttcaagcttgacaacatcgattttgagatcacagaggacgcaaagcgagagatagccaagaggactattgaagaaaagacaggagcaagaggacttagagcgatagttgagaagatactcacaaagctcatgtttgaagcgccatctgatgatgagatagttggcataaagataacggctgaatgtgttcgtggcgaagcagagcctgagatcactcgtgcggtaagctcggccagaaaaaaataatagtacaaatctttgtacagataaatgagaggcggagtattctgcctctttttttgttgcatatctgcattatccgcacattatttgtttaacaaaccatgtaggggctggcgccctcgacagtccgctttttggacgttacatcttgtaatttattgcacaaactttgagaaaacgcacaatttgtggtagggacgagcattgttcgttcgtttcggtcgcttgcataaatttgtcacaatcaaaaaaattcgacgcttcgatatcgggacgtcgggggcgccgtcccctacattttgttgtttacgatacgagttcatgaagctaacgggcgacactccccactttgaccgcattttcccttgaattatgcggaaatatgtgctatactaaagaaaatacactatagggggtatccatatgaatgaacttatccaacagtttattactgatgaagtcactgctctcacttactccgacctttggaacttcgtcaactccaactccatttgccgtggtactttcgagggcaataatcacattatcatgaaaatctcctctaatcaattcattatttatcgcatttgccttggtatggaaaacaccaaatatcaggaagctgttcttgttgcaaaaacctacctgcttaaaaagataaatagcatggcttatcagcttcatttagaggatattcagaacattttagactaattgctttttaaggagatcataaaatgagtgtgcctttggctgaacgaattagacccaaaacccttgatgatattgtgggacagacccacctgttaggcgaaaataaacctctcaggcgtattatcgaaagcggtaaaataccgaatatgattttttatggtccgtcaggtgttggcaaaaccacggtcgcaagaatgatagcaaataatgctaatatgactatgcataagcttaacggcacaagtgcttctattgctgatatcaagcagatagttgctgaaactgagacgctcagcggcattaatggtatcttgctttatcttgacgagatacagtatcttaacaaaaaacaacagcaatcgcttcttgaatacattgaaaacggcaagataactcttatcgcttctaccactgaaaatccgtatttttatgtgtacaatgctataattagccgttcaactgtgtttgagttcaagccgctgacttcggaggagatcttgcctgcaataaagcgtgcttttcagcttatggctgatgagttggggctgaaactgcgtcttgaaaatggtgtgttggagcatattgcaaggggctgtggcggtgatgtgagaaagtcaataaatacagtggagctttgcatactttcggcagataatgacggtgaaaagttcactgtgaaccttgataatgtgaagcttcttactcagcgcagcaatatgcgctatgaccgtgcaggcgatgagcattatgatattctgtcggctttgcagaagtccataagaggttctgacgagaacgccgcacttcattatgccgcacggcttattgaagcaggggatatcatttctctgtgcagacggctgcttgttatcgcaagtgaggatataggacttgcgtatcctatggcggcggtagtgacgaaatcctgcgttgattcggcattgcagttgggactgcctgaagcaaggataccattggcggaagctgtggttcttcttgccactgctccaaaatcaaattctgctgaatcagcaatagacgcagctttagcagatgttagaaatggtgattttggagattatccacggcatttgcagaataagcattttgacggcgagggcgcaaaagtgaaaggacagcactatctttatcctcatgactatccaaaccattgggtaaaacagcagtatctgcctgataagcttgtggggaggacttattatcagtatggtgagaataagacggagcaaatggcgaaagcgtattgggagaagataaagaagtgagaaatggaaaaaacgaaaagagtgcagtggctttgcggcagtaaaacctattctccacaaaaaaattaatcgccgcaggcgataccttaattcctcactcctcattcctcattcctcaatcaaaaaaattttcgttgacatcaaaagaaaaatacgctataataaaagagaacggaatgtccgtaaaattttatgatgggagtaatttcgatgaaaataatggatactatcggctttgttgaaaatgtcgataaagaagtcggcgaagcaatggaagccgagctggcaagacagagaagaaatcttgagcttatcgcaagcgaaaatatcgtttcacctgccgttatggctgcaatgggttctgtgcttactaataagtatgctgagggatattctggcaagagatattatggcggctgtcagtgcgttgacgttgtcgaggatatagctgttgaaagagcctgcaagcttttcggtgctaagtatgctaacgttcagccacattccggcgctcaggctaacactgctgtttattttgctcttcttaagccaggcgacactgttatgggtatgagccttgacgctggcggacaccttacacacggctcacctgtaaacctttcaggtaagtattttaattttgttccttacggcgtaaatgacgagggttatatcgactatgaggctctttacaagcaggctaacaagtgcagacctagacttatcgttgcaggtgcaagtgcttatccaagagctatcaattttgagaagctttctgagatagcaaaggctgttggtgcataccttatggtagatatggctcatatcgcaggacttgttgcagcaggctgccatcagtcacctgtaccatatgctgacattgttacaacaacaacacataaaactctgagaggtccaagaggcggtcttatcctcacaaataacgagtatatagctaagaagataaattctgctattttcccaggcacacagggcggtcctcttatgcacgttatcgctgcaaaggcagtttgctttggcgaggctctcaagccagagttcaaggcatacggtgagcagatcgtaaagaatgcacaggctcttgcaaagggacttcttgacagaggattcaatcttgtatcaggtggcacagacaatcatcttatgcttgttgacctcagaccattccacatcacaggcaaagagtttgagaagaaacttgatgagatttacatcacagtaaacaagaacgctatccctaacgaccctgagaagccatttgtaaccagcggtgtaagagttggtacagcggcagttaccacaaggggacttgttgaggaggacatggacgttattgcagagtgtatgtatctcacagcaacagactttgacaataaggctgatgagatcagagaaaaggtaaacgctatctgcaagaaatatccactttacgaataattgtacggatttatatactgttgatacacaaagggagcggcttaggtcgctccctttttctcaataatatatgaataaatctctcttttggttgatttttaacagagatcgtgttataataatcttttagagtataattaaaaggtgggatatactttgccaattaaaataccaaatgaccttcctgcgttccaaacgttggaaaatgagaatatattcgttattcccgatgacagagccgctcatcaggacattcgtgccttgaagatcgctattgtcaatctcatgcctgacaaaattgcgacagaaacgcagcttttgcgtcttttgagcaacacacctcttcatgttgacatcgaccttattcagatgagcagtcatatgtcaaaaaacacctctttggagcatatgcttgctttctacaagaactttgacgaggtgtgtgataatcgttatgatggtcttataatcaccggtgcgcctgttgagcaaatggagtatgaagacgttgattactgggacgagctttgcagagtttttgaatggtcaaagaccaatgttttctcaactatccacatatgctggggcgctcaggctgggctttattaccattatggtgttcccaaatatcctttgaaagagaagatgtttggcaatttcaagcaccatatcgactatcccgaaagcattattcttaaaggctttggagatgttttccattgtccgcactcacgccatactgaggtgcgtcgtgaagatattgaaaaggtggacgaccttatagtggtggcagtgtcaaacgaggcgggtgtgcatcttgtttcagataggacacaaagacagttttttctgttcggtcactgggaatatgatcgtgagaccattgcaaaagagtatttcagagataaggaaaaggggttgcctatacagataccatatagctatttccctgacgatgatccagaaaataagcctattttcaattggagctgttcggctaatctgctttattcaaactggctcaactactgcatttatcagaaaacgccatatgatcttaacgaacttgagccactggggactgcacaatgaagaacggaagacatatagctgagttttacggtgttggagtaatgctcgcaatagtgggtggctatcttgatgcttatacctacatcagtcgtgaccacgtttttgcaaatgcacagacaggtaacatggtgttgttggctatcaatatcaaagagggaagctggctgaaggtctttctttatctcatgcctatactgtcctttatgcttggcgtgctgatagtggaaactgtgaagctgaaattcaatgaacacccgaggatacattggcataggatcataatcggtgtggagcttgtggtgctgactattgtgggatttatccctgctggtacgcttaacacattggcgaatatcctagtttcttttacctgtgcaatgcaggtggagggttttaggaaaatggacggaaagcctttcgctaccacgatgtgtactggcaatcttagaagcggtacggataacctgtttcagtatttgaaaactaaggataagctaaagcttagtaatgcaatgcagtattatggcataatcctttgctttataagtggagcggcagtgggtgcatttgtcacagaattgcttgaaactaaagcggtttttgttgctttgacaggtcttgttatcgcactctgcattttaagaagcgacgacgataaattagcagaaggtaagtgacaatcaccgagcaaagccttgtcatggcttgaggcatagacttaatatgcgtaagccagacagtaaaataagaaaatcaaaaaaacaaagcaaagcagtgcttgagaaaaatctcagcactgctttttctatttcattttgcaaaaccacctttcaaagcacaaagtgaattggtggcaaaacaaagtaatatggatatccaaataataattgcaaaaaatataacgtcacaaaagcgaaaatgatgttatctgactgtttttgattgaatgttgttaaaatgcacaaatatcttattcataatttataaaaacggccaaaaataatgctgtgtgaatgaatttgaacggaattgcttgacttttgctgtacaatatgttactttaatatcagaaacaatcaatatcgttcaattgacgtcaaaaaacattattgaaatttgaaaaggtgataaaatgcttacagaggaaaggtactctattatattagagagagtcaagcagaataaaagtgtgaagcttcttgagttgtgcgagcttttaaaagcttctgaatcaacgatacgccgtgacttgacggtgcttgatgaaaggggtcttttgaaaaaagttcatggtggtgctatatctgtcgaggaacattctttcaatccagaggaacaggacgttgagtcaaagtcaaagctttttaccgatgaaaagcttgcaattgcgaggttttcagcatctcttgtggacgacggcgatttcatttttatcgacgccggaacgactacaggctatatgatagactttctgccagataagaaaattacctttgtgactaacgctttcgttcatgccaaaaagcttgctcagcgtggctttaaggtctatatgccggcaggggagataaagctcacaacggaggctatcgttggtgctgaatgtgtcagcagtctgcaaagctataatttcaccaaaagctttcttggagcaaacggaatttcgttgtcaggtggtataacaacaccggacagaaacgaggcaagagtgaagtctaccgtggtgttaaacagtcagactgtttatattcttgcagatcactctaaattcgatcagatatctgcggtcactttcgctcagcttggacgtgtgaagataatcaccgacaagcttcaagacaaaaaatatcttacaaaagcaaatatcaaggaggttatgtaaaatggtatatactgtaacattcaatcctgctatcgactatgttgttcatacaggggaaatgaagcttgggtctactaaccgctcagatagggaagagatgtatttcggtggcaagggtataaatgtgtctatagttcttagagagctggacattcagtcaaaggcacttggcttcactgcaggcttcacaggtgaagctatcgagaacggactagcggaaatgggaattgatacagattttgttcatctcaaaaaaggtaattcccgtataaatgtgaaaataaaatctgctgaggaaacagaactgaatggtcagggtcctgatatagatgatgaggctgtgaataagctttttgcaaagcttgataagcttcaggacggagatacgcttatactcgcaggaagcatacctgcctcgcttccttcagatatctatgagaagatactcgaaaggctcgcgcacaagaatatcagaacagtagtggacgcaacaaaagacctgcttcttaatgtgcttaaatataaacctttccttatcaaacctaacaaccacgagcttggcgagatgttcggagtgacactcactaatgatgaggagatagaaaaatacgcacgtaagcttaaagaaatgggtgctgtgaacgtacttatctcaatggcaggggacggcgcaatgcttattgacgaaaacggtgaaatacatcgctgtggagtatgtaatggtaaggtgaaaaattccgttggtgcaggcgattcaatggtggcaggctttaccgctggtatattgcagggcgattatgaatatgctcttaaacttggcacagccgctggcggtgcgaccgctttttctgacgggcttgctcaaaaagaaaagatcgcagagcttcttgaaacgctctgaaaaaatatagggacgcggagcaatggcagtttcaggtgcaacttttgctgctgctgtcggaaatgttccatcaggctttcttggcgcatttcttgcaggtttccttaggaaagttacagaatagtctttacaaatataagagaatataatataataatgttaacaatcataaataaattaagtttcagaaaaggagagatctattatggtatcaaaggtcgtaaaagtagtaaatgcggagggacttcatatgcgtccggcaggtatcgttgcaaaggctgctaaggagcatcctgagtgcgagatcatgatgaaagcaaacggcaaggacatcaaggctaaggctgttatgcagataatggctgcaggtatcaagaaggacactgaggtagagataatcgtaacaggcgaaaacgagcaggctgttcttgacgagttcgttaaaatgtttgaggacggtttcggcgaataattccttatatcttccaaaaaaattcagacaagaccgtagcgtaaactgcggtctttctgagtaatatgacgttgtaaaaaatccaaaagagagaaatacatatggacaaaaaatatcttttacttcttgcacaaaaatttcctactatagacagtgccgccagcgagatagtaaatctatctgcaatacgcagtatgccaaagggtacagaatactttttcagcgatatccacggggagtatgaagcctttttacatatgctaaaaagcgcatcgggcatgataaaaaacaagatagacctgaccttaggaaaaacagtttcctcggcagagcgtgaagcccttgcctatcttatttattatcccgacaagcagctaaagcgtttgcgtgataaaaacgggctttcagacgagtggcgcagacttactatctatcgtctgatacttgtttgcgaggcggtgtcagcaaagtatacacgttcgagagtgcgaaagagcataccaaaggatatggtctatatacttgacgagctgcttaatgtcactgatgatgtggtaaaggaatattactatgacgagataatcaccacaattcttgacactggaatcgcagaccgctttataaagtccctttgtgagcttatacaatctcttgctatcgacaagctgcatattatcggagatatatatgaccgtggtccaagagcagatattattatggacgagcttatgaaaatgcacgatgtcgatatacagtggggcaaccatgacatttcgtggatgggtgcggcttcaggtaatcttgctcttattgcaaatgttatccgtatctccatgcgatacaataactttgatgttctcgaggacggctatggattaaatcttcgtgcgctggcggtctttgcaggagaaacatataaaaacgatgagtgcgcaattttcatgccacagacacttgatgataatatctatgacccagttgatgcaaagcttgtggcaaaaatgcacaaggctatcacagttatacagctaaagctagaggggcagcttatcagacggcaccctgaatggaaactgtctcaccgtgaccttttcagcatggtggacttcgcaaatggcactataacaatagacgggcaaattcataagcttcttgacggcaattttcctacagttgatcctgctgatcctcttgcgctcaccgaaggcgaaaatgagcttatgacgattcttgcaaactcgtttatgcacagcgacaggctcaacacacatatgcgttttttatattcaaaaggctcaatgtataagaccataaacggaaatttgcttttccacggctgtatccctcttgatgaaaatggaaagcttctgagcttaagtatagcaggagagcagtattcgggtaaggcaatgctagataagcttgacgaaatagccaacaaggcgtatttcttacagccttgtgaggagaaaagcaactgcgcagaccatttgtggtatctgtggagcggcgcacgttcgcctctttatggcaaggacaaaatggcgttttttgagcgatatttccttgaagataaaaagcttcataaggaaaattataatgcctattatcacttctcagagaagcctgagatatgcggaaagatacttgaaatgtttgggcttgacccacagcatggtcatatcataaacggtcatgtgcctgtgaagataaaaaatggtgaaagccctgtcaaggcagacggcaggctgttcgttattgacggtggtatctcaaaggcttatcaaaaagccaccggtatcgcaggctacactcttatttatgattcccacagccttaatcttgcggagcataagccgtttattgcaggagagagtgagcatactcctgagatacatatggtggaaagacttgaccgccgggcaaacatttcagataccgacaagggaagggaactgcttttgcagataaacgatctccgtgacctgttggacgcttatcgctctggagatatcaaagaaggttataaggtattttagatgttctgaaaggagcttaacacatggaaaagggagaactgaactgggctgttatcggctgtggcgttatcgcaaacgaaatggcaaagcttagaaaagaatggggactaaaatacccaaatgagctatggtgatatccacataatgatataacaaaccaaaaggcattgacttcaattggaagccgatgccttttttatctctcgttttgctgtgaaaacaagtacaaattatagtacaaataaattacaagtacaaaaatatgtacgtttatcacacgaattcagagcatatatttttgtaacattcattggtggaatagacccattttgtgagcctgccgctggtgatgaaatagtttatctttgagggaaaaacgctgttttcaaatacgtctacgataatgagcttgactttcattttttcggggataagagcctttatgtaaacacttgctgcctgccccacacgcacattttctcttggttctgcaagccctgcaaggttcggagcaagctctataaaaataccgtatggttcaatggagcgtactatcccgcctacggtttctcctgtggagaacaatgctgcattttcttcccatgtgcctaaaagttccttgtgagaaaggcatatcctgtcatcgtcacagctttttaccacagcatatatgtcctgaccgttgaaaaatctgtcgttggggtgggtgatgcgtgagacggatatggcgtctattggtataagtgaaggaagaccacagcctatgtcaacaaagcacccgaaaggctcaaggtgtgttacctttgccggtataacgtcccctgatgtgagggtacttatatatcgttcaatgcactcttcttgtgcaagacgccttgacaacctgcatatgacctcgcccttttcgtgaacaatatctgtcaccttgaagcataccgttttgtttaccctagaaagtaatgctatgtcttttgttttgccttcttgtattccgatcgctccctctgatcttgggattattcctttgccaaagggaagctctactattatgttgtgttcgctgtcacaaagcacagcatgaccctccagtatcaatccctgagccattgcctcagccattgttcgttcgctttgaagataatatcggttttcagggctattgaagatcttgccctcaggtaaatattttttcattattttgcctctttccccacagattttttaaaaacagcaggatctctgtggttgatccattgattttgttcatattctgcacatattttctttgtgataattgtgcgtgaactcttgctgatacagtaaattaatattcaatgtgctgaaatattagtacaatttttatattctttgcttcaaattataaacaaaaatcaaaaaaactataaaaaagcttgacaaatgcaattgtgcgtgttacaatagtgtagtaatttgtaatcagtttgtaactttcttaaccgttatcgttacagattgatacataattttaatcgaccgtaataaaattaaatagcggcacagacatgaccgccgctaattaaaagaaagggtgtgaattggcaatgcagcgtgtatgcgttgtaaagccgtattattaatggatcattcagcaaattttatttcagcaaagaataagtcactgaaagttatagtgatgtttattgcagcacttatgacatttttggtaatgacagagggatttagtgccgatgccgctgcggcaaagctttcgactcctaagatgaccgctcagatcaactatggaagtgagttcactcatccgtataacaagcagacaaacactatcaaggtgcattggagcaaggtaaaaggtgcttcaaaatatgagctgtacatcaagggtggcaaatataagagttggaagaaatacaagacagtcaagaacacgaactgcactgttacaggtcttcagagaacaacttcatatcagttcagagttaaggctgtaaatggctctgccgcttctgcttactcaaagacacagacaataaagacagcaagaatggacttcaataaggcaggctgggaagcaatgtgccgtatagtttatcatgaggttggtaagatgtcaggttcggagtgggataagcctatcgtttatgttgcagattgtgttgcaaaccagtatgttgccgcaaagtacacaaagaatgcaatgtggagatcctactatgcaagatataacaatgttcaggatatcatttataggagcggcggatttatgtcatctgcacagctttcaagggacggagcaaattattcaaacgtttccagaagagtaaagcaggctgtttttggtgcagtgtatggcaaaactcaccttaacggtattgctaatgactataatgtttacttctggtgcaacagaagctacaagacaaacagcagcaagatagcttactcatttaaaattccttggggttatttcaatgtttggagaacctattggggataattgtaatactattatagaattatgtgaaagaagagcagaacaaagcgtctgctcttttttcgttgacaagaatgtagcggtgtggtaaaataaagttgataaaagcagggaggaatcagaatgcttgtgggtgcggtcggctataattatcgccatagaaaagattttattatggattgccctcacggggtgggctgtcctcttatattgctcataaaagaaccatcggtgttcgttataaatggtatcgagcatagggcagagaaaaattcttttatcctgctttcaccagatacccctgtgaaataccatgccgcagaagagttttataccgatgattggctgtatttcaattatgagcagggcgataatgaaaaatttgaaaggcttgatgttcccaaagatacactggtataccttggaaatattgatgagcttagtcagataatgcgttcggtggcatatgagtatcagctcatgaaagaggggcatgaggaagtaacacggtgctatatggagatctttttgttaaagcttgcaagacagctaaagtgtacagacaagaagtcctgtattattactgacaggaacagccgctttatgcagctcagagcatacatatacgcaatgcctgaggacatcgcagacgtaggcagcatggcatgggatatgggtataagcaggtcaagttttcagcatatgtataagaaaatgtttggagtgagcgtcatgacagacgttataagcgcacgaatggaaagagccagtcagcttctggcaacgacaaatctcagcgtaagggaagtggctgagaggtgcggttatactaatgaatatggttttatgaagcggtttaaaatgcactttggaaaaactccaacggagtttcggagtatgctctgacaacggcggataaactttagacggcataacaaaagaggtcaaggaatgtgtccctgacctcttttatgttattttattcttcaacaaatacagcggccgagcctttaataacatcattagtgccataacgtggagcgactgtgtaatagtcctcaacgtcatagcctgcatcgccaaaaggtgatttgaagcatgggtttatccaaatagcgttacaccccagctcgcagatatagtcaagcttttctgtaatacccttgatatcaccgatgccgtctgagtttgtgtcattgaacgattgtgggtagatctcgtagaaaactgcattgtcaagccactgtggctgctttgtcatgataattcctcctgaatatcgtcagaatatatttattagtcttccatgcccttcatgtattccacgaactgctttgcaactctcggtgaacgtcctgctcttgaaagcgcataagcctcagccttttgaagcacctcatcaataggagttttaagctcgtattgctttgcaagtttctcaactacatcaaggtaaatcttcttgtcaggcttctgatatgtgacagtaagtccaaaacggtctgacagtgaaagaagctcctgcatagtgtctttgaagtgtatctcgtcaccctctcgtgaggagaacgtctcgtgtacaagatgtcttctgtttgaggtagcataaatgcagagattgtccgcagttgatgaaacgcttccctcgaggatagctttcagtgccgcaaaatcatcatcgtcctctgtgaatgaaaggtcgtctatgaagataatgaacttcaatggatttttgcttaccgtttctacaatggctggtatctcatggagctgcttctttttaagctcgataagtctgagacccttgcaggcatattcgtttgctatggccttgacagttgaggacttgcctgtaccgcagtcaccataaagcagaacgttgttggcaggcttgcctttcaaaagcgcaagagtgttgttgatgacctcctgacgctcacgttcataattgtgcaggtcggaaagctttatgtcatcaggatattctaccggaactatcttgccgtcttttatgacaaatacatgatactgtgagtaaatgccatatccgtactgaccgatagcgtgtatacggtcggcatatatctgcgagaagtcaagcttttgtgtagcatatctcggcagaaagccgtcatagtctatctttgagattatctcgtcacttggtatctgtgaaagctcctcgataacggcaagctcgtttgcaagacattcctccaaaagcgcacctgtctccttgccttctccctttttaagcataaaaaggttttcattttcaagaaccagcttgagcatatattctgtaagattatccgaatatgcaaaaagttcagccacaaaatctgagtatttttctatagccatgtcgctgtcagattcgcatacagcaagtgtttcaagtagcttttcaaagacaggaacttcatgtaagctcttgaatattactaatgtgtgtgcctgacggcagagtgccttaaaatcgtgcattatgaacacttctttcttcatattttatatttattctttattatacaacatatcgttacttttcgtcaacatctacattgcacgattttaacaaaaaacattaccgctttttgtagcttaaagcaaaatatttttgcccgttatgatttacttttgttttgaaaaatgctataatactataatagaccattatagaaataaaaggagaaatggatatgacggacaaaaacgtatctatcatgaatatcggcagtatgggttatcttccacaagtattcaaaaagatagagaatgaaaaaaagcttagcattgtttatttgggtggctcgataacaatgggctgtaatgctacaaaaactgagttaagatatgttgaccgcagtgcaaaatggtggcagacgaattttcctgacgctgagataagctacttcaatgctggtattggtgcaactacctcgcagtttggggtggcaagagtgcaggaacacgtccttgacaaacagccagaccttgttttcgttgagttttcggtaaacgacagcagttcgcccctatttatggaaacatacgagagccttgtaagacgtctgctgaaagctgagagcgtcaaggcggttgtgcttataaacaatcttttttacgatacaggcacaaatgcacagggtatacataacgctatcggtctgcactatgacctgcctatcgtcagtgtaagaaactacattttccctgagatacagcttggaaacgtttgtcttgcagactacacagcggatatgctccaccctacagacctaggtcacaagatgatagctgatcttatctgcaatctgcttgatacagaatattcatactataagaagctcggcgcagagaagaagccttcacttcctgagccatttacagcaagcagatatgaggacgcacagcgttttcagaactatagctgttcgcccgttatggagggctttgagcctgatactcatgcggcagagcagtggagcgatccattcaagggcggttggatagctcacaagcagggaagttgtattaaattcaacgtgagtggaagtattataatgctgcaatacagaaagtctatcaacaagcctgcacctgttgcatatgctgtcatagacggtgacaggcagaacaaggttcttcttgacgcaaactttgacgaggattggggagatctttgctgtcttgaggagatatacagcggagcaaagggagaacacactgttgagatagttattgacacagagggtaaagaaaataacgattttatgcttatttctgtcattacagcaaacaaatagaaacgtaaataagtgaaaaattttactcgaatctattgactttatgacataacgattgtataataaatatatattattaaattaggaggcattctctaatgaacgattttttcaaaattgctgacaagtacctcaagccggtaactactggtgcaggtgttgttctgggtcttgcagttacatatgcagcaggaagctatctttcaggtatgagcaagctgtatggcggtttctacacattcatgtatgtactgttctggatagcatttgttcttcttgttatctgcggcatctatgcacttttcaagaagtatgcaggttctgttccacagcagaacgctccacagcagacatatgcacagccacaggctcaggccgcaccacagggtgaaaagttctgccctacttgcggaggtaaagttccggctggaaatcagttctgccctaactgcggcaacaagataaactaatcttaaagttttgcagataaaacgcccttgattttcaggggcgtttttttgttagaaaacgcataaaagtatgccaaatggggaataaatatgtgcagtttggaaaaagtgaaaaaattctcgaaaaccccttgacaaatgggtggaaaattggtataataattaagtcgttgcaggacgatatgagttattagctcagttggcagagcatttgacttttaatcaaagggtccggggttcgaatccccgatagctcaccactagggaaatatccttagtcaagatcacgccttactttgttagggcgtgatttttttatgtctgttatatgtgatgataaatggacaagcaagtggtgatgagcgagcgacatcaggacgccactacaacgcatttatccaacaaaaaaaagcagcccctgtggactgctttttttcaagcttgtagcttgatccttatatgacaaaaaactatctgattacgttaaatgcacccatttgtggataaacagcgctttcgccaagttcttcctcaattctgagaagctgattgtactttgcgacacgctcacttctgcttggtgcgcctgtctttatctggcaagtgttgagagcaactgcaaggtcagcgatagttgtgtctgctgtttcacctgaacggtgtgaagaaatcgcagtgtagcctgccttatgagccattttgatagcctcgagagtttcggaaactgagcctatctgattgagcttgataaggatagagttgccgcagccaaggctgatgccctttgcaagtctttctgtatttgttacgaacagatcgtcgccaacgagctgcaccttgccgccaagctccttagtgagaagctgccagccctcccagtcctcttcgtcgagagcgtcctcgatagagatgatagggtacttttcaacgagtttcttccagtgttcgataagctcagcagaagtgaactttgtaccagcctttggaagaacgtactcgcccttctttgagcctttccactcgcttgaagcagcgtccattgctatcatgaaatccttacccggctcataacctgcattcttaacggcttctagtatatactggatagcttcctcgtcgcttgcaaggtcaggagcgaagccaccctcgtcgcctacagaagtagcaagtccctttgatttaagcagggcagccagagcgtggaaaacctcagcgcaccagcggagagcttccttaaagcttggagcaccaacgggcattatcataaattcctgaacgtcaacagtgtttgcagcatgagcgccaccgttaagaatgttcatcataggaacaggaagtctgtttcctgaaatgccaccgagaaatctgtagagagggatatcaagagagatagaagccgctcttgcagcagcgatagaaacagcgaggatagcgttagcaccaagctttgacttatccttagtgccgtcagcctttatcatagccctgtcaacggcatagatgtcagaagcgtcaagaccgcagactgcgtcattgatagcagtgttgatgttctcaactgcctttgttacgccctttccgccatatctgcccttatcgccgtcacgaagctcaagtgcctcaaactcgcctgttgacgcaccgcttggtgcagtgcctctgcctactgttccgtctgcaagatatacctcagcttcaacagttgggtttcctctggaatccagaatttcacgtccgattacttttacgatctcaagatagttcataatataagctcctttttaatattatgcagactacccgaacgcaccaccattcgggctgatgacatttcgctcttgtcatcatagagaagtctgcatgatttattctcacgaggttagtaattactaaccacatttattttaccatgcgtgaagccgtatgtcaatcttagttaggcatacctaacatattttatagatatgcacaaaaggtgtactgtctgcaggcatggctattgactttttgaacaacagataagctttgcgaaacttttcgtttgttattattgacaagctttgtgagaatattcgttttggacgtgatcttatttatgctcaaaaccgcacaaagcatggtagggtatagaaaaaagcggtgcagagatcgttctccgacaccgccttgatttatttctcatttctcatttaactctgcaagtgcattcgccattcttagatcactatctgtggttatcttgaaattcattgcgtccccgacaacaaggtatatatcctcattacaagctgtaaacacagaacaagtatccgtcagctttttattttgctccttgctaagcgaataataattcctcctcagatccccaagtctgaaagtttgcggagtttgcgcctgataaagctcgcttctgttaagcgtttcactgaccttttcgccgtcagatcttattatggtatcagccgcaggcatataagttccgcaggcggaatgttccttcatcgcctcgatattgtcttttattatcttctccgtcacaaatggtcttacagcgtcatgggtgagtattatgtccccctcattctcaccatgttcagcgactattgcctcagctatgttcattacagtgccgtttctgtcagctccgccgtctataactttcacacgcctgctgtctatcccgaagcgttcaaaaagctcgttagtgtattcgtgccagtcaggttttatgcccacataaaccatatctatctcttccactgtaagaaaagccctcacagttctgactataacaggcactccgcctatctctataaactgctttggtataaccgcactttttactcttgaaccgcagccccctgcaactatccctgcaaatatcattttatcttctcctcatataaaaaaagttcgggacagccgtccgccccgaactttatcgttgtgtattgaatttactttatgccgtattttttcagcagagcttcgatctttgtgtgtgggtcgatgacctgtgaaattgacttgtcatgattgagtgacgcaatgaagtaagcaatgtacttagagcagtctacctcatagaaccatgggcttgaaagcagctcaggagttctgtatgtgaggtttgtgccgaatacaccgtcgatgatgccgtcagcataagccttgttgaatgcttcaagaccatttgtgaaaattggataagtagcatagcagtagatcttgttagctttacgctttttaagctctacagcgatatccagcatcgactcgcctgatgagatgatgtcgtcagcgatgaaaacgtccttgccggcaacgtcattacccatatactcgtgagcaacgatagggtttcttccgtcgatgatagttgagtaatctcttctcttatagaacataccaaggtttacgcccagaacagaagcgtagtacatatttctgttgatagcgccctcgtcaggggagattatcatgaagtgatccttgtcaggtctgaaatctgaaaggtttttaaacattgccttgagaacctgataggaagggattatgttgtcaagacccatgagtggaacagcattctgtactcttggatcgtgagcgtcaaaagtaaggatatttgacacgcccatagactgaagctcctgaagagcaactgcacagtcaagagattctctgtagtttcttctgtgctgtctgccgccgtaaagggaaggcatgatgatgtttattctgtgagccttaccgcctgcagcctggattattcttttaagatcctgataatgatcgtcaggtgacatactgttttccctgccgaaatagttgtatgtgcagctatagtttcctacgtcgcagagaatgaaaagatcgtcgcctctgatagatgacttgataaggcccttgccgtcgccggaagaaaatctaggacaaacagcctcaacaaggaaagtatccttaacaaattcgttttcattagcccattttgtaagataaccgtctaccttcttgccaagctcggaagcgcctgccatagcaataagaccaagcggtgcaactcttgagtcattgtcgaacaatacattgtcagcattacccattattatcatatcctccaatactaattgttgcctgacctcaggtcagtacgaaacataccaatatacatatattatactttataaatcccgattttacaatagttttttcgcaaataataaatttttctcacttttcacaaaaaacacactgttactgcggcacatttagacacaaaaatcaagtaaacgtttgctgaccgcacgacaggtaaactttttttgcatatataaaaaagtccttgcgtttttggataaaatgatatataataaaatagaataggtatgtgtgcaatatattgcacacaactgacagaattattaaaggagttaatgacatgacaaaagcacaaagatatttcatggaaataaaagataagagagtagcgttcataggcacgggcgtaagtcaccttgagcttattaagctttttctctcgaagggcataagatgcgttgtctgcgacaaaaagacagaggacgaatttgatgagcttatctatgaggagctttccgcaaagggctgtgagttctcattgggcgagcattatcttgatatcatctttaattgcgatatagttttcagaacacctggtatgtactataatgatgaaactatcacaaaggcaagaaaagcaggcgttgccattacatcagaaatggaaactttctttgacctctgcccatgcaagatatacggcgtaacaggttcagacggaaagactactactactacccttatcagcgaaatgctcaaagccgagggtaagcgtgtccatatcggtggaaatattggtaaagcacttctgcctatcgtagaaacaatgtcagacagcgatgttgcagtagttgagctttcaagcttccagcttatctcaatgagacagtcaccaaacgttgccgcaatcacaaacatcactccaaaccaccttaacgttcacggaacaatggaggagtatatcagtgcaaaggcaaaccttatcgctcatcagaacggctattcaagaactgtactcaacgaagataacgaggaaacaataaagcttgcagacctcgtaagaggaaaacttgttactttctcccttaagcaccctgttcagacaggcgcatatcttaatgacgacggtatgctttgctacacagaaaagggcagaactacagagatagtacacaaggacgatataaggatacctggtatccacaacgttgcgaactatctcacagctatcgccgcagtatggggcgaggtatctatccagagcatagttcaggtagcaaagaacttcggtggcgttgagcatcgaattgaatttgtaagagagatagacggtgttaagtggtataacgattctatcgcaacaagccctacaagagttatcgcaggacttaattcatttaatcagaagcttatcgttatcgcaggtggctatgacaagaagataccttttgagcctcttgcagaacctgtgaacaagaacgtgaagatactcattcttcttggtgcgacagcagacaagatagaaaaggctgttacagaaagcccgctgtatcctgaaagcggtctgaaaatagtgagagtaaagacccttgaagaggcagtccttacagcacagaaaatggctgaaaagggcgatgttgtcacactttcacctgcctgcgcaagttttgacctctatcctaactttgaggcaagaggcagacatttcaagcgacttgtgaacgaactctaattttataaaaagcagggatatgtattatggatacatttgagatactgtcacagctttgctctgcggcaggtgtatcgggagcggaaggctcagcggctgaggctgcggcaaagctccttgaaaagtatggcgaagtcaccttggataacgctcttggcagtgttatctgcaaggttggaagctgggaggacggcaagcctgttatgcttcttgacgcccatatagacgagataggcatgatagtaacatacatcacagaggacggctttttgaaaatatcaggctgcggtggccttgatacaaggcttcttttggctcagcaggtgactgtctatggcagagaaaaactcacgggcatcgtgacttcaactccgcctcaccttgaaaaagacagctccgatgcacctgaacttgacagcgttttcatagatataggtttcacgagccgtgaaaatgcagcaaagtatgtttcccttggggacagagtgcttatagaaaacaaagccgaaaggctcgcaggaagccgtgtgacatctaaagcaatagacgataggtcaggctgtacggctatcctaaagactttggagcttctcaattgtcagcagacagcttataatatcgcagtgtgcttttcaactcaggaagaagttggcgagcgtggtgcaaaaacagccgcctttgatatcagtgcagactatgcgatagtggttgacgtttcctttgcaaagacccactatgagagcgaggaagagtgcggcataatgggcaagggagcgatgataggcattgctccgtccctttcacgagagatgtcagatggctttattagccttgcagaagaaaagggcataccatatcagcttgaagtcatgagcggaaaaacaggtacgaacgctgacgctatcggtgtgagcggaagcggaacaaaagccgttaccatatccattccagaaaagcatatgcacacgcctgttgagatagtggatataaatgatattgataatacggctctgcttattgcagaatatctgaaaagagtgtagatatttatgttggataaactgaaagacctctgcctccttgacggcatttcaggcgacgagggagcggtaagagaatatataatagataaaataggcgataaagctgaaataagggtggataaccttggcaatgtcatagctttctgtaagggcaaaaagacgcctaaaaacaagataatggtgtctgctcatatggacgaggttggcatgatagtcacctatgtgaattctgacggcacgctgaaagtgtcatcagtcggcggtgttgacccaagagttgttttcggcagacgtgtcaaaatcggcaggaataacgtccttggcgttgtggggggaaaggctatccataatctcacagccgaggagagaaaaaagtctgtgccttttgataagcttaccatagatataggtgttgacagccgtgaggaagccttaaagcttgtgcgccttggggacagtgtgagatttgtttctgactttgtggagttcggcgagggctttgtgaagtgcaaggctatagacgacagagcaggctgtgcaataatgctcagaatgatagaagagggcatggagtatgacacatattttaccttcgtggtgcaggaagagataggtctgcgtggctcgacctgtgcggcgttcactgttgcgcctgattatgcagttgtgcttgaatccacaactgcggcggatattccatcggcttctggagagaaaagggtatgtgagcttggaaaaggtcctgttgtttcatatatggacagacacacaatgtatgaccgtgagctttttgagcttgcattttctgcggcagaagagaacggcataccatgccagaccaaaacaatggtggcaggaggaaatgatgcaggtgcgatacacgtttcccgtggtggcgtaaagacagccgcagtgtcgctcccttgcagatatcttcattcgcctagctgcgtgataaataaggcggactttgagaacgcttatgttcttacaaaattgatcttggataggacttataacaaatgatctatgaaaccaaagagatcagctcagaactgctgagcggtcttaaacctaacaattatacaaggcgtataaagtcgcactttgcggcatacggcacagggtatgattttctgcatttctatgccgttgaggaaagcggagaaaagcttggtatcatatcagtattcaacgcctctatgatgatatcgactttcaaggataagagatttgacgataaggtattgggcgagcttgcggggtttatccttatgaataagcctgccgcagtggagttcgaggcggagtattcagataagcttgcagaactcactaaggcagagtataagggcgacaagcggacggagttcagctttgttgcgaaaaacgatatcccgccccttgacgtgaacgagcttccaaaactcgatgatgttttcaggatacttgcaccgtgtttccctgccataaaaaattcctatgagctgtggcttacggatacttcccacagagtaaggagaggactttcacagtcattcctgctgggtgattacaccactgccactatacagtatatcatagatggagtggcgcttgtgggacacgttggaacaatacctgaggagcgtggaaaattccatgcaagacagcttttgtattggataggtgaaaagctcacgcaggacggttttcaggttagattgtttgcaagaccccatagagtgagctattatgaggagataggctttaaagcctgcggaatagatcttgtattggagagaattgaaaatgaatgaatgtatatttgatatagacccaaagcttttatctcttgcctccgaagcagagaatgagtgcagggagatgtttgaaaaaatagacagcaatgccgagtataacggacagaaagtgctgaaagcttttattgacaatcgtgtgagcgagggctgtcttaaaggcacgacaggttacggatacggcgacatgggcagagatactatagacaaggtgttcgctcaggcactgggcggtgaggatgctttggtaagacacacttttgtgaacggtactcatgcactatctaccgcgcttttcggagtgcttagaagcggagacacaatgcttgcctgcactggaaagccatatgatactcttgaggagataatcggtatcagaggcgaaaagggcaacggctcacttattgatttcggtgtaaagtatgagcaggtagaccttgtgaacgaaatgtatcctgattatgacgagatagcaaagaaagccgttggcgcaaagatagcctatatccagcgttcaagaggctattctctcagaccgtcactgacagtggagataatcggaaagatagcagaaacagcaaagaaagctaatcctgatataatcgtcatggtggataactgctacggtgagttcgttgaaagaaaagagccactgagcgttggtgcagatatcataataggctcgcttatcaaaaatccaggcggtggaattgcttctacaggcggatatatctgcggcagagcagaccttgtggaaaagtgtgccgacaggctcacctgcgttggcatgggcaaggaggtcggctgttcacttaatcagaacagagaaatgctccttggctttttcttagcaccgcaggtggttgcatcagcactgaaaacttccgttttcgcctgccgtttctttgaaaaacttggctacaagacccttcctgagagcggagaaacaagaacggatataatcgcatctattcttcttgaaaacgaggaaaacctcgtggctttctgtcagggaatacagaaaggctcgcctgttgacagctatgttactccagaggcatgggatatgccgggttatgacagcaaggttataatggcggcaggagcattcacaatgggtgcgtccatagagctttcagcagacgctcctataagaccgccgtttgccgcatggctgcaaggcggaatcacatacccaacaggcaaagcaggcgttatgcttgccgcacaggagatgtataacaaaggtttacttagaatataaaatttgactggaaaggaatgatattcaatggcagagatattcagcgttactgtcgaggagataatcaaacagcttaatatggagataatctatgctcctgagaacatcagcagccttgttgttactgagaatgattgtaacagacctggacttcagcttatgggattttatgagtatttcaacgcagagcgtgttcagatatgcggaaatatggagtttgcttatcttgcttcacttgacgagaaaacaagatatgagaggatagacgctctttttgctacaaagataccgctttttatcgtggcaagaggtcatgaactttatcctgaaatggttgagatagctaagaaatacggcgtacctatcgcaagaactcaggacagcacaacagcttttatcgccgcacttatcggctacctgaacgttgagcttgctccgagaataacacgccacggcgttcttatcgaagtatacggcgagggtatccttatcgtgggcgagagcggcgttggtaagagcgagaccgctatcgagcttgtaaagagaggtcacagacttgtggctgacgatgccgttgagataagaaagacatcaaacagaacgcttgtcggctcatcacctgataatatccgtcacttcctcgaactgagaggtatcggtatcatcaacacaagacgtctgttcggtatgggtgctgtaaaggtaagcgagaagatagaccttatcgtagagcttgagccttgggacagcacaaagatatacgacagaatgggcgtagacaatgagtataccactatcctcggtataaaaataccaagccttaccattcctataaagccgggcagaaacctagctgttatccttgaagttgcggctatgaacaaccgtcagaagaaaatgggttataacgctgctgctgaacttttgcagaatcttggtctgcaaatggacaagaaagacaaggtcaagaactgggataatttctaaaaacacgcatatacttttttaaataggagatagatcataatgcacttacagggagatatgcacacgcacactatagcttcaactcatgcttactccaccataacagagaactgccagtgggctgaaaaatacggaatgaaaggcatagcaatgacagaccatgccatgaaaatgcctgattcgccacatatctggcattttgtgaaccttggcatactgccgagaaagataaacgggataaccgttctcaaaggcatagaggctaacgttgtgagcgatgacggagagcttgatactgacgaaaagttgctttcaggacttgaatgggtggtggcgtctatgcacagtgcctgctatactccctcgacacctgagaaccacactaaaagctggctgaaagtcgcacagaaccctcaggtggatgttataggtcactgcaccactgcaccttttatgttcgattatgaaaagggcgtaaaggcgttcaaggagtacggcaagcttgtggagataaacgaaagctcatttgcgtgcaaaaggtcgcccagaagaaacgtagtggagcttttgaagctttgcaaaaagtatgaagtgcctgtggtctttgactctgattgtcatttctgtcagcttatcggtcaaacaccgaaagtggcaaagatagcggaggaacttgattttcctgagaagcttatcatgaacagtgattgggaaaagataagggaatatgttcttgcgaaaagaccaaacctcgatatttaaaacgatgaaaggagaagccctcacaagggcgttttacagatatatatgaatacacaaaagctgcttgaccttgcctcagagcttgaatgtaatgttgtctacaacgagccgctttcaaagcataccacattccgcacaggcggaacgtgtactgcaatggtggatataagctcagaggaaagccttgcaaaacttgttagagccgcacacgaatggaacgtaagatatattgttgttggaaatggctcaaatcttttatttgacgataagggctatgagggagtggtgttcctcatgggtcagtcagtggacgagataaaaatgatgaacgaaaacaccatatacgccgaggctgggtgcagccttataaagctgtgcagatttgctcttgagcataacctcacaggacttgagtttgcctatggcataccgggaactgtgggcggtgctatatatatgaacgcaggtgcttatgacggtgagattaaaaacgttataacctctgcgaactccgtgagggcagacggtactgtacatactacagaggcaaataaaatggctcttgcttatcgcagcagctgttatcagaaaaacggcgaagtcataacctcaggagtgttcagacttgaggcgggagcgtatgacgatattcaggacaaaatggtggagcttatgggcagacgccgttcaaaacagccacttgaatatccaagtgcaggctcgacctttaaaagacctgagggacagtttgcaggaaagctcattgaggattgtggtctgaggggatacacagtgggaggagcacaggtgtctgaaaagcactgcggttttgtggtgaacaagggtggtgcaacaactgaggatattatgtcggtgataagacacgttcagcacattgtcaaagagcagacaggctatcttcttgaatgtgaggtaaagataataccttacaaggaataatttaaatagggatcaataagtgatgatttttttcagctttgtaagaaaggaatgaacgttatgcagtttgtgataattactggtatgtcaggatcgggaaaatcaagtgccgtgaatgtgcttgaagatataggatattactgcgttgataatatgccgcctgagcttatcccaaagtttgcaaacatatgcagtcagtctgacggaaaaatagacaaggtagcgtttgttgttgatataagaggcggcgacctttttctgaagcttcaagacacagtaaagcagcttcagggcgagggcgtgagtcttaaaatacttttccttgacagctcagatgacgttatcgtgagaagatacaaggaaacaagaagaaagcaccctcttgacgaggtgtcatatggaaacataagaaaagctattgaaactgagcgtgagatattaagacctataaaagcacaggctgatttttatatagacacgtccagaagctcaacagctcaatttaaggaaaggctttattccatatttcttggaaacaacgagtttatgcatattgatgttcagtcgttcgggttcaagttcggtgcaatgagcgagggcgatcttgtatttgacgtaaggtgtctgccgaatccgttttatgtacctgagcttaagaacaaaacaggtcttgacaaggacgtttatgattatgttttgagctttgacgaagccaaagtgcttctaggcaagctaacagatcttatcgactatctcatacctctttacgaaaaagagggcaagtcacagcttgttatagcgttcggctgtacgggtggaaagcataggagcgttacctttgcagaagcagttgcggagcatctgagaaagcaaggtcacaggataagaataacacacagagatataaataatcagtaaggcggtttgaaagttggaggacgtatccttttcatacagagcaaaagaagaaataatcagcaagataaattcaaagccaaaggctgacgtgtgcatgatgggtatgctcacgtactgtaactgcctgtcagatgatgagatatcttttctcactgaaaacaaagcggtagcggactttttcgtgttgaacaccggcaggataactggtaatgaaaacgcagtgttagtcacagagcagaaaaagcgaaacggcgttgtgctttatgctttggatattcctgagcgtgaggacaggctcacacttcttgactatttcagaatggataagagcaggcgtttggaagaagctgacctgcctaaagagaagttttatccacagcttgtggctggtatatttcttgcctgcggttcggtgaacaatcctgagaaaaaatatcatatggagttcgttatgccaacgatagagctttgcaatgattttggtatgctgcttatagataattacgatatcactccaaagcacgttgaacgtaagaacgcacagatagtttacataaaagagtctgagaatatcatagatatgcttactcttatgggtgcgcctatgtgttcgcttgaacttatgaacgtaaaaatgatgaaagatatgcgcaacaagataaaccgagcggtgaactgcgataacgccaatatagagaagtcgctgaaagcagcggaaaagcagataagcgatatcgaacttatagacgagacagtggggctttattctcttcctgataatttgcaggagatagctgagcttagatataataaccctgacttcaatcttaaagatcttggtgcagccatagatcctcctatctcacgttcgggggcaaaccacagattgcagaagatagcagagatagctgacaggataagagttgaaaaaggtcttgcactgaaagaggaataaaaatgcctgagtttgtacatctacatcttcatagtgaatattcgctccttgacggcgcctgccgtatcaaggagcttgttttgcgtgtaaagaagcttggacagaaagcagttgcggtcacagaccatggaaatatgtttgcggcagtggagttttacaacgaatgtcttgctcagggcataaagcctataataggctgtgaggtgtatgttgcaccaagaacacgatttgacaagctagcgaagatagacagttcgccttaccaccttgtgcttctgtgtgaaaacaacgagggttatcaaaatcttataaagcttgtgtcggcggcatatacagagggcttttacagcaagccgagagtagatgttgaattgcttgaaaaatatcacaatgggcttatctgtctgtcggcttgtcttgcgggtgagatacccagaaagcttaccaatggcgattatgaggctgcaaagcagactgctcttaaatatcgtgatatatttggcagggataattactttatagagcttcaaaatcataagtttgcagaccagcagagaatattgcctatgcttataaagctttcacgagaaacaggaataccgatggtctgcactaatgacgcacactatctcagacgttcagacgctaatgcgcaacgtgttctaatgtgtatctcaacaggcacgacactagacgacccaagcaggcttgaatttccgacaaacgagttttatgtaaagtcagcagaagaaatggcagcactttttccctctcagcctgagtcgttggagaatacagtaaagatagctgacagatgtaatgtaagctttgagtttggcaaaacaaagcttccgtatttccatatagacggtgtttcagataacgaaaagtttcttcgtgatatgtgcatgaaagggctttataaacgttatgaaaatcctacaaaagaggctttgaaacgtgttgactatgagcttgacgttataacgagaatgggatatactgactattatctcatcgtgtgggattttgttcactatgcaaagacccacggtatacctgttggctgcggacgtggttcaggtgcaggaagtctgtgtgcttattgcataggcataacgggtatagacccgctgaaatatgatctgctttttgaacgttttctcaatcccgaaagagtttccatgcctgactttgatatagatttttgcatggaaggcagacagcgtgttattgattacgttgtggagaaatacggctctgaccatgtggcgcagattgcgacctttggcacgcttgcggcaaagcaggcagtgagagatgtggcaagagcaatgggtctgccttatcagaccggagatatgcttgcaaagaaaatacctagaggtcagccactgaaatattccatagagaatatacctgagcttagttccctttataagactgatatgaagatacgacaacttcttgatattgccatgagcgtcgagggtatgccacgaaacgtgtccacccacgcagcaggcgttgttatcacaaaagagccggttgacttttacgttcctctctattctcgtgacggacaagtttccacacagtatacaatgacagtgcttgaacgattgggactccttaaaattgattttctcggactccgcaaccttaccattatagaccactgccgaaagcaggtgatagaaactcaccctgattttgacttggagaagatacctcttgatgacaaaaaggtatatgaaatgctgtcacagggcaaaacggagggcgttttccagtttgaaagtgcaggaatgactgcaactgtcatgaagcttcgccctgaaagattagaggaccttatcgctgttatctctctttaccgcccgggacctatggactcgatcccaacatacatccgaaaccgccatgaacctgacaggatagtgtataagcacccattgctcaaaggcatacttgaagtgacatacggctgtatagtttatcaggagcaggtaatgcagatattccgcacgctcgcaggatattcatacggcagagcggatatcgtaaggcgagcaatggctaaaaagaaagcggctgttttggaaaacgagcgaaaagcgtttatctacggtgagaaagggcagtgctgtggtgcagtggcaaacggtgtgcccgctaatgttgccaatgagatatttgacgaaatgacctcttttgcaagctatgcctttaacaaatcccatgcggcggcttatgcaactatcgcatatcagacagcgtatttaaaatgtcatttctataaagaatacatggcggcacttatgactatcacgcttcttgacagtaccgataagctttacggttatattgcagacgtgagcaaaaacggtgtgaagatattgccgctggatataaataagagcgaaagcggttttgtggcagagcctgagggaatacgctttgcacttcttgcggttaagtcacttggtgagggggctatcgacaggatagtttctgagcgtaaatcaggtggagcgtttcgttcgcttcaagatttttgtacacgagtttcgggcagagatatccacctgagaacagtggaagcacttataaagagtggagcttttgacggttttggatacaccagacgtgaacatctcaatgcttgcgaggacataatgaaaagcgtaactcggtcagacggaagtgtgattgagggtcaacttgacttgtttggcatgggtgctgctttgccaatggaaaagaagatagaacgctgcggtgagtttgacgaacagcagcttcttgaatttgagcatgaagctcttggtatgtatatatccgcccaccctatagaccgctttgagtgtgtgatttcagccgcaaggtgcgtcacctctgcacagctcaaaaaagcctgtacagacgagggcggaatggcagataaacgtttcgctgatggggcggaagtagactatgcaggaatggtcaggggcagaaaaatgctaaagaccaaaaaaggcgatatgatgtgttttgtggagcttgaagacaagttcggaacattagagatagtggttttcccgtcagtttttcaaactatgggaggcttcataaaagacagagcgcttctacacgtcaaaggcaagatatcatgcaaagaggaagaagaacctaagatacttgcggatatgctcgagcctgtcgatagattttgctcattacagcttcaaagggatatttgcgtaaggcttgtttcaagagatgcagagggcataaaggctgttagaactatagccgagaaatacaaagcacagactggttcaaagtttgcggtatttttcagcgatatacgcaaaatgacaggcataaagtctgttcatgctgtgaaaatgtgtcctgaactgcttgtcgaacttgaaaacagactgggtgctgaaaacgtggtatttatggacagaaaaggagaataaaaatggagccaagaacatataaggtaacaaaaattgacggcgattatgcacatcttcttaatgtggacacaggcgaagatcttcttatggcaagagcgcttttgcctgacgaaacagacgagggaacaatgcttcactgggaaaatttcatttatacggtaatagaataagtgcatttatgaaattcttgtgaaaagtatggaaatctgcacaggaatgtgatatactatattattatcgtgttatcacgaaaaattttagcgtgaaaacgcttgaaggagtaatcaaatggctgtatcttatagtagggaagaactcggcagagggatatctcttacaagaatatatgacaagaaattcaagtcaaactgcgtgaagatagcatttatatcaccgctggacgaaaaaacagcctgcgtaaatgcaatgctgcaaacagtgcttgtgacatcgaatgcagagataccttcacgaacaaagcttacatctacactcacagggctttacggctcaagtatcggcaccaactgtggtaccataggcgattatcagtctgtcggtctgtctgcgagctttatcggcgacgattatactatagatggcgaagtaatatccgttcaggtggtaagacagcttctcaattgtctgataagaccgcaccttgttgagggaaagttctgtgagaagtattttactttgagaaagcaggagcttatcgacgctattgttgccactgtcaatgataagcgtggctatgcacttttgcaggcgaaaaaggtcatatttgagggcgagcctgcggctgtgtctgcaatcggaacggtggagcttgcggagaacataactcaggaggatttgttaagacaacacaaaaagcttcttgaaagtgcaaagatagagataaccatatcaggcggcggaaacacggctgctgcggaaaagcttataagagatgaaatggctgctcttataagagtttcacctgtggagaagatagactacagacacaattcacctgcaaaggcggagcctgtttatagagagcttaaaatgcaggtaagccaaagcaaaatggtcatggcattcaagtctgattatgaggatatctacaccgcaaagcttttctgtatgcttctcggagcaacgcctttttcaaagctttttgcaaacgtaagagaaaagatgagcctttgctattattgttcttccgcatatgccgacagaaagggcactctttttattgatagtggcgttgaaagctgtaacatagaaaaggcaaaaaaagctatcgaagaacagctcgaagccatatgtaatggcgacttcacagatgaggagcttgaaaacacaaagaaatctctttgcggcggcttcaagtcgaactatgacagtatatatgatatcatgggctggtatgcggcacagaatacacgaaacacggctttcacccctgaggagataaacgagcggatagcaaagcttacccgtgaggacataataagctgtgcaaagacttttaatcttgatactgttttcgtaatcaggggcgaggaagaggaggactgtgatgaataaggagatcgtaaagagcgagcgactgggcgagagctacagcgtttttcatcacccgtcaggacttgacgtgcttgtgtggaaaatggagggcttcacaactacagaagccatatttgccacaaagtacggctcaatttacaactgtttcaagaccaaggacagcaaagatttcatcactgtgcctgagggcatagctcactttttggagcataagctttttgaaaacgaggacacagatgtttttgacttatatgcaaaaacaggtgcaaatgcaaacgctttcacgtcttttgatgaaacggcatatacgttcagttgctcggaaaactgggaggattctcttgaaatacttcttgactttgttcagaagccatattttacagagcaatctgtggctaaagagcagggcataatcggtcaggaaataaaaatgtgtgcagattctcctgaaagacagtgcttttataatctgctgaaagctctgtatgtaaaccaccctataaagatagatattgcaggaactgttgatactattgctgagataacccctgatcttctttataagtgttactacactttctataatcttcacaacatggtccttgccattgcaggaaatgttgacgaggataaggtcatggaaatatgcgataaaatgttgaaaccatgcgagaatatggagcttgaaacaaagcttcctgatgagcctgagaatgtagcgcagaaaaagatatttcagagcttccctgtgggtcttccacttttcaatatcggcttcaagtgcaagccttatgagggcagagaacttttcaaaaaggctggaacagcgtcagttgcgcttcatctgcttataggctcgtcttcgccactttataagcagctttttgacgacggactgataaattcgcagtttggtgtcgaagtgttcacaagcggcggagtattctctccaataatatcaggtgaatcccatgaccccgaagagctttatcgccgctatctagcggagatagaacgtgtaaagacagagggctttgacaagtcgcagtttgatatgataaagcgttctatgtacggcgaaatagtaagaggaatgaataatcctgaaagagcagcagattatcttgcagaaagctattttgaaaactctgacgctttctatgaagcacaggttcttgcagaaatgactgtggaggattgcgaaaacgccgtaagagaaatgttcgaccctgaaaagtcgtctatctccgtggtagataataagtaggtattttgagccacagactcagtgaaaggaatgataaatttatgacagcattgcagtttcttgccgactcttcggcaaatgacgcaataagggaaaaactcagagagtttccgaacagagtttatttccccaatttcggaaagggtgacaatatcttcaaagagggtattgatatcgacagagtgctttttacagtgccaggcacgaatttcaagatatattggtatggttttttaataaccatcggtattcttcttgcgatgatatacggcttcagaagaatgaagaccgtaggcatcgaccctgacagagcgacagattccgttatcggcggacttattggagctatctttggcgcaagattttattatatcatctttaatacagagggcatgaaattctcagagtttttcgatattcgtgacggaggtcttgctatctacggcggacttatcggtgcgataatcgtgggcggaattatagcaaaagtaagaaagctgaagcttactgcgcttcttgacgtggtcgcaccatgttttcttatcggtcagtgtatcggacgttggggcaacttcttcaatcaggaggccttcggtgcaaacacaaagctcccttggggcatgataagcaacaccacaatggaatatatctcaaaccattatgacgagcttggcggcaaagtgtcggctcttgaccctatccacccatgcttcctttatgaatctatttggtgtcttattggatttataatcctgcatttctatcttaaacaccgcaagtttgacggcgaagtattccttatgtacacatgctggtacggtctgggaagatttttcatcgagggtctgagaacagattcgctctatcttggaaacataagagtatcacagcttgttgcaggcacttgtgttcttgcttcacttgtacttataatcgtgttcagaggtatcacaaagagaaacagcgattacaagctgttcgttgatacagagctttcaaaggctcagcttgaacagtataacagctacaatgatattcagaaagagaagaaagaacttaagcacaagataaaggaagccaaggataagggtgagagctttattgagcttcaaaaagaatatgacgaaaaattcggcaagcaggctcaaaaagacaagcttaaagaagccgaggaaaaggacaaggagtcacacaccaaagccgagacagagtataagtctatccttggtgacgataacgacgaggacagcgaagtaaaagatacagatgaaaaggatacggaggaagaataaatgggacagataattgacggcaaggcagtatcagccaaggtcaaggaagaaataagacttgaaacagagaagcttaaagagcagggcatagagataggtcttgcagtggtcatcgtcggtgatgaccctgcttcacaggtctatgtaagaaacaaggaaaaggcttgcgaaactgtgggctttaattcattcaagtatgctctccctgcggaaacaacggaagaagagcttctcgaccttgtcaaaaagctcaatgacgacgacagagtggacggaatactcgttcagctcccactgccaaagcaccttgacgataaagtgataataaataacatcagacctgacaaggacgttgacgctttccaccctgtaaatgtgggcaaaataatgataggcgattacagttttctgccatgcacacctgctggcgttatggagcttatcaagtcaacaggcactgacattgcaggcaaagagtgtgtagtggttggcagaagcaatatcgtaggcaagcctcaggctatgttgcttttgcataataacggcactgttactatatgccactcaaagacaaaagatcttaaagaagtttgccagagagcagatatactggttgcggctgttggcagaccaaagatgataaccgctgattatatcaaggagggcgcagtagttatcgacgttggtatggatcgtgatgaaaacggcaagctttgcggtgacgttgattttgaggactgcaaggataaggcttcatttatcacacctgttccaggcggagttggccctatgaccattgcaatgcttatgagaaacacactcacagcaggcaaggctcatcacggcatagaatagttgtaaaatttctgttaagtctatttacaatttgtctgaaataatgtataatatatgagttgcttactgcaacatatccatgcaacagaatatgggtcacgcccgcaagtgggaaagttacctgccatattcttttacatcggaaatattttaacgaaagaggtacaaaaaaatgcttagaaaagacgaaaagacagctgttatcgaagctaacagaactcacgaaacagacacaggttcacctgaggtacagatcgctatccttacaaagagaatcagcgaccttacagaacatcttaagacacacaagaaggacaaccactcaagaagtggtctgtttaagatgatcggtaagagaagaaatcttctcaactacctcaagaagaaggatatcgaaagatatagagctactatcgaaaagctgggtatccgtaagtaatcatgtaactgacatcaaggcagaggcatttattgccactgccttttggtgtttatttgaactgttggtgaaaggtaacttagcattaaacagaatgtatgaagctcgtatgtcctgtttattgctaatgctttcaccatacagagaattctaaatttctaaaatggaggaaagacaatgtttgagaatttcagaacttttgaaacgacatatgcaggcagacctgtagtagttgaaacaggtaagacctgcggacttgctaacggctcttgctgggtaagatacggtgaaacggttgtaatggctaacgttacagcttccgcaaagccaagagagggtgttgactttttcccactttcagttgactttgaggagaaaatgtatgcagtaggcagaataccaggttctttcacaaagagagaaggcaaggcttctgacaaggctatccttgcttcaagatgtgtagacagacctatcagacctcttttcccaaaggatatgagaaatgacgtttcagttgttatgacagttctttctgttgaccctgacaactcacctgagatcacaggtatgatagctacatctattgcactttctatctctgatatcccttggaacggacctgttgcatctatcaacgtaggttacgttgacggcgagctggtgcttaacccaactcttgagcagagagcaaagaacagacttaaccttacagttgcaggctctgctgaaaagatcgttatgatcgaagcaggtgcagaccagatacctgacgatcttatgctcaaggctatcatgacaggtcatgaagagataaagaaaatggtagctttcatcaacgatatcaaggctcagatcggtaagcctaagtttgagtttgagtcaatggaagttgaccacgatctgtttgacgctgttgaagcaatggtaggcgagcaggtaaaggtcgctcttgatacagatgataagaatgtaagagacgcaagacttcagccaataatcgacgctgttcatgagaagttcgacgagcagtgcgaggataacacagctgttcttgacgaagttatgtataagctccagaagaagatagtaagaaactggctctatgagggcaagcgtgttgacggcagaggtatcgacgagataagaccacttgccgcagaagttggtgttctcccaagagtacatggttcaggtatcttcacaagaggtcagacacaggtaatgactatcgcaacacttggtcctgtttcagacgctcagaaacttgacggtatcgacgaggaaacttccaagagatatatgcaccagtacaatttcccttcatattctgttggtgaaacaagaccttcaagaggtccgggaagaagagagataggtcacggcgcacttgctgagagagcactcgttccggttattccttctgttgaagagtttccatatgctatcagatgcgtatctgaggtgctttcttcaaacggttctacatcacagggttctatctgtggttctacacttgcacttatggacgcaggcgttcctatcaaagagcctgttgcaggtatttcatgcggtcttatcactaaggaggacggcagctggatgactatggtagacattcagggccttgaggacttctacggcgatatggactttaaggtaggtggtacaaagaacggtatcacagctattcaggtggatatcaaggttgacggtctgacacctgagataatcgcaagtgcttttgaaaagacaagaaaagcaagaatgtatattcttgatgagataatgctcaaggctatccctgctcctcgtgctgaggtaagcaagtgggcacctaagatgctggcaacaaaggtaccggttgacaagatcagagaagttatcggttcaggcggaaaggtaattcagaagatctctgctgagtgtgacgttaagatagacatatctgaggacggtagcgtattcgtttcaggtatcgacaaggaaaaggctgaacaggcaatcaatatcatcaatactatcgctaatgaccctgagataggtgctatctacagaggtaaggtagtaaagatcatgaactttggtgctttcgttgagatagctcctggtaaggacggtttggtacacatttctaagcttgacaaatcaagagtagaaaaggtcgaggacgttgtttctgttggcgacgagatcgttgttaaggtaatggaaatcgacgatcagggcaggatcaatctttcaagaaaagacgctcttgctgatatcgaagctaagaagaacgctaagtaataagtttttaagagcgggcggctatgtgctgtccgctttttttgttgacaaatttgttgacaaaaaagaagaagtatgttaatataaaagtaataaatttttatagggggtatctttatgagatgtacagtatgcgggtgcgatattctgcctaacagcatttgctgtcagaattgtggcacaagagttattgaaatgacaggggtaaattcggcacagccgaggtatggcaatagtttcaataatagctttaataatggctttgacaatggtcttaacagcaatgtgagggcagtgggaaagaatatgtctataggcaaaaaggtgcttatccttttgttggcattgtttgtgggtgcagctatcggttttggatattggtactatcacaatgtttcaacccataccattagagaggagaactttagcgttgaactgccaaggtcacttgaaaaggcaaccacaatagattatgcggcacagagcagtgatggaactgtaaaagccaacggaaagtacgccgatgttaatagcgattttcagtatatgatccttgattactcttcacttgctggcgaaacaacggatattcttactgagaaactgtttgttacctacatgaagggcaatttgaaaagtcagtttggaagcagctataaagaagtgtatgctgatggtaacaagcttaaaatgacctatcgtgcaaaaacgggcgacgaagtttataactatgctatatgcaaaaagtcaggttataaatattattggtttgtttttggctgtaaggctgatgaaaaggatttctatgacccgaaatttgaaaagtgggcaagcactatccatatcaattaatacaaaatttataaaatcgatttgttaaattattgacataataaacagtatatgttagaataaaagcataaattatatgagggagaaaagaatatgaaatgtcctatttgttcggcaaagatcagtgatactgacgctttttgtcctaattgtgggtcggctgtgaagtctgaaacaagcggttatatggattctatcgacacatcaaaccttggtgagaatgttggctttggcaagcgcaacacaacaggtgcacagcctgtgaatgcagtacctcagcagagttatgctcaggggcagcagtcttatggtcagccacagaacggctacgctcagcagagttatccgcctccgcagaatggcaatgctcaaactccatacggcagtgcatatgagccttataagatagcgcctgttacatctgctaaaaagggtataccaaagcccttgatgtcagttcttgtgtttatccttgcgttcttggttgcttttggtgtgagatatttttacaaaaacacagctacgaaaacattgcagggtacaggatatacaatgacagcacctgcggatattgagaaatctagcagtacaaatctgtatgcccttgataacttctccaacaacgaggtgggcataaacgctgttaagctttcatattctgatattgcactttacggctatggcaagggcgagtctgcatcggatatctttgattttatccttgaaaacggctcaacaaccttgaaaataacaggcaaggattcaaaatatatttattatacccagagcataggagataaacattattacggcatgagttctataacagagggcaacggtggctactacatttttgattttctctgcgagcagaaaaataagtcaaagtatgaagataagttcaaagattgggctgcttcagttgagataaagtaaataattcaagctgtccttcggggcagcttttttgttttgcataaaaatcttgcttttttcgtcaaaaaggtgtaaaatgaatcatatgacacaaaatctgctttccgcataaaatgtactaataatatgtggaggtgatcttgtgttgaatcttatacttcttctggctcttgtgctggcggtcgttatttggttttgggtgaaatggtataaggtgcgaaatgttggcaagcgtggaggatatttgcttatcccatgtaaaaagaatacacgtgagcttgaacatatggtaaaaagctgttattgggaggagttttttcagcctgaatattatgggagagaaataatcctcgttcagcttgacaaaagcgagataaattatgtttcaaagcgtttggaacaggattatagcatcgttcactgtgttgatataactgaacttgcagattttatcaagcgcagagagctgaaatgccatgaaaaatagatcattcggagaataatatggaagatttaaagaccctcaagggtgaggttgacagcataatatttaaaagtgaggacacaggcttctgtgtgcttatgcttaactgtgacaatgaccttatcacagttgttggcgaaatgggtgacgttgaggagggcgaagatctcgttgtaacaggggagttcacttcacatcagaagttcggcgagcagttcaaggtgcatatctttgagcgttctttgcctactacctctgcagcgattcagcgttatcttgcaagcggtgctatatcaggcatagggcctgtacttgcaaaaaagcttgtgaacaagttcggggacgatacccttgacataatagaaaatactcccgacaggctcacggagatagacgggataacagtgaaaaaagcggaaaaaatatctcaggagttcaaaaccacttttgccgcaaggtctcttatgtcatatcttaacaaattcgagatagaaacttcttatggcataaaggcgtggaagcgttggggcaacactgccgagcagattataaaatccaacccttatgtgctttgtattcagggcgtcgatctgtcattttcccgtgcggacgcagttgcggcaaagtctgatattcctgctgacagcgagtgcaggataaaggcaggcattacatatattctaagacaaaacgctgaccaaggtcatacctgcctgcctttagacagccttgtgaaaacagcggtgagttatcttgatgttgatgaaaagcttataaaaaaagtaattgaggatgaaactgaggaggaaaacctctactattacgataagcatggcagacgttttgttatgcttgcagatttttacaaagctgaggactacatagcaaggagacttgccataatgaggcagatctcttatgacaataagatagacttttccgaagtgatcgatcttgaagaggaaaataatggcatacaatatgaaaaaatacagcgtgaagccataaatcttgcactgtcaaagggttttcttgtgctgacgggaggaccaggtacaggaaagaccacaacgctcaacgctataatttctctttatcagcagcaagggcttaacgttatgatatgtgcgccaacaggcagagccgccaaaaggctttctgaccttacgggatttgacgcaaaaactatccacaggcttcttgaagtgaagcatacaagcggtgacacacttgcgtttatacatgatgaaaacaatcttctcgattgtgacgctttgataatcgacgagatgtccatggtggattcctgcctttttgaagccgttttgagagccataagcgttacctgcaagctcgttctggtgggggacagcgatcagcttccgtcagtaggtgcaggaaatgtgttaaaggatattattgacagcggagtaatgtctgttgtaacactaaaagagatcttcagacaggcacaggagtctgagattgttatgaacgcccataagatagtaaacggcgagcatatcgacctggccagcaaggacaaggatttcttttttatgcaacggctagaatatggagaacttcaggatcttgtggtggagctttgcaaaacaaggctgccaaaagcctacgattactcgcccatagacgacattcaggtgctttcgcctacacgaaaaggtcctgcgggtactgtggagctaaacaagcgtctacagcaggagcttaatcctcctgccgcaggaaaatcagaggtcaagacccctgtttatactttcagaaaaggtgacaaggtcatgcagaccaagaatgattatgaaattctttggaaaaagtatataaccgaggacaagaccgaaagtggcgcaggcatttttaacggcgatataggcataataatcgcagtgaacaagatacttaaaactgtgactatagattttgaaggcagaatagctgtctatgacaagcaaatgctggataatctggagcttgcctatgccataacagtgcataaaagccaaggttctgagtttgatgttgtcattctcactgtattcggtggatttgacaagctttattacagaaatcttctttatacggctgtgacaagagccaaaagaatgcttataatagttggctcgaaaaagcgtgttgattttatgatagataataataaacgcactttgaggtatactgcgcttaaaaatatgctaatggagcttgtagagggtgatgacagtggtcagcagacgcttgatatataaatttctgcttgattttgtttatcctaatcgttgtcctatatgtggaagttttataaaatgggacgagcttttgtgcaaaaattgtgaatgtaagctgccttttcataaaaaaatattgtgcgaaaagtgcggcaaggataagtgcctaaatcatgattcactacattttgataggatttatactcttatgagatatgaggatatctgcgtgaaagcaatatatcagcttaaaaacgacagacagcttaattttgcggaatattctgcgaagcttctgggtaatgtgctaagagaaaatggtatcgcacagcaggcggatatcatcacatcagtgccaatgcacagatcaaaacgccgtaaaaggggatatgatcaggcacaaaagcttgcacactttacggctatggagcttgggataagagaagatcatcgcctgcttggacggacaagggataccgcagaacagcatactttgactgccgctcaacgaaaaactcatgcggaggatatttattattctcttgcaaaacacgttgacataaaaggtaaaaatgtcctgctatttgatgatgtttacacaacaggttcaacgcttaacgtgtgcagcggactgctaaagaatatgggtgcaaaaaacgtcttttgtgcagctatcgccaccaccttgctcgatgaaaaacacaaagaataaaacagaccgccttcggtataataatatcgggaggcggtctttatgataactgaggaacagtttgcggcgataaaaagacttatcgtgtctgaaaactgcatgatagacaggtttgagcattatgtgagtgagataaaagagccgcagctaaaggaagatatgcaaaagcttacagcggctttgaaaaatcagcgttcagggttgctcacaagtctggaggataacaatggtaactgacggaaatataataaaagaagcaagattttttgtcaaggcgtattcaaaggagttttgtcagacctacagtgatctatgcggaagtccttttgcagagtgtataaaaagtgcgcttgatggtcagcttagaatagcagagaagcttgaaagtcttgaaaaaacatactgtgacaaaaccaagctgccaattgcagacagtattgatgtgaacagatttttatataagaacagggaagatatgaggtaaaaagtccgcagatgctcgtctgcggacttttgttattttgatatatgtacgtcaagttggtcgaatggtatggaaatgccgtttgcgtcaaagcgttcctttgcctctttgagaaatttgtatcgtatctcccagtaagcatcggtcggtatccatacacgcatgataaggattatagcgcttgcgccatgctcgcagatagccacaagcggcttgtcaggctcgtttattacccttggctcatcattgagcatttctctaagaatagccattgccttgttgtggtcgtcattgtagctgatagagaatttcagttcaaggcgacgtttgtcgtcagcagttatattcgtaatagtcgattgtgaaacaacaccgtttggtataaatatcatcttattctcaagggtctttagggtggtgtaaagtatagagatagcgtcaacagttccctctgagtcgcctatttttacataatcaccgcatttaaaaggctttgaaaaaagtatgataaagccgcctgcgacgtttgaaagactgttttgaagagcaagaccgatagcaagacctgctgcaccaatagttgcgactattgaggacataggtacttgaagtgctgaaagtgccattactattattataataagcaatacagtgtgtaccacagatgtgagaaatttatgtatagtcacatctgttcgacgcatgctcaaacctttgtgcatgaccttcaaaacaagcttgtcaagaagtattcctaaaagaaaaataacagccgccgcaataagatgtggtgtaaattcctcaagccaatttaaaaatttgtcagacaaaaaatcatctccgtaacattattatgtaaagatattataacatcttaacatgatatttgcaagtgtgcccaatatataagtttttttgcgtatttatgcacttttatcagaaatcataacaaaaataggtgttgacttggagataattttgtgaaaaaaatgtgggaaaaagtcttgctatttgtgtggctttggtgtataataatattaagttttattatacttacagtaaggagaatttttatgatcaattttcttaacactgcagctcagatggttgcggcaaagagtacgatcagtcctgatcaaaaagatctgggtgctggaactgttgcctctgtcgttatcacgggtatagttgtggtatttatcggacttgttctgcttattctgcttgtgtcgatatacggcaagatatttgacgttatcaacggcagagctgcaagaaaggctgaagaggcaaaaaaagctgctgaagctgcaaaggctgttgctaagccagagccaataaaggctgctgcccctgttgtagaagacggcattgaagaagaaacagttgctgttatcatggctgcaatttcggctatgagtagtgcagagggcaagaagctcgttcttaagagcgttaaaactgccaagcctcaaagaccagcatggtctaccgcaggcataatagacaatacaagaccattttagtgcagttgacgtgaaaggaacgtgataatagatgtcaataattaattcatttcttgataccatggcgtctttggcgtcacagtcgggctttgcgggtttcctcgtagacggcggctggaaaaatatcgtaatgatacttatttcattcgtatttatgtatctggctattgcaaagggctttgagccgcttctgcttttgcctatctcatttggtatgcttcttacaaacctgccatacgctgagatgtatcatccggacttctggaactataaaacggttgcaggcaatgaccactatatagattacggtcagatacttcaaaagggtggcctgctggatattctttacatgggcgttaagcttcagatctatccaccactcatattccttggaatcggtgctatgacagactttggtccgctgatcgcaagccctaagagctttcttatgggtgctgctgcacagggcggtatcttctttacattcatcggtgcggctctcttcggcatgagtgctgctgagtgtggttctatcgctatcatcggcggtgcagatggtcctacatctatctatgtatcttcaagacttctaacctcaaacagtaatatcggcgttggtactattgcacttgcagcctatacatatatggctcttgttcctattatccagccgcctatcatgaaggctcttacgacaaagaaagagcgttcagtagtaatgggtcagctaagacctgtttctaaggtagaaaagcttattttccctatcctcgtaactatcgttatctcactcatggttccttcagcagctccactggttggtatgctcatgtttggtaaccttcttaaagagagtggcgtctgcgacagacttgttaagactgctcagaacgaacttatgaacatcatcactatcttccttggcgtaacagttggtgcaacaacacaggcagataagatcatgaacattcagtttgcagaagttatggcacttggcgttgtagcgttctcaattggtacagcctgcggcgtacttcttggtaagcttatgtatgttctctcaggtcacaagatcaatcctcttatcggttcagcaggtgtatctgccgttccaatggcagctcgtatctctcagaaggtcggtcagcaggaagttcctacaaactatctgttgatgcacgctatgggtcctaatgttgccggcgttatcggttcagccgttgctgctggtgttcttcttacaattgtaagataagatcagaaatttttcgggacgatgaaaagcatcgtcccgatttttgtgtatagtttaggagtgttgatatgtcagaaagtaaattttttgcagtgatatcccgtatgaaatatataaatcgttgggcacttatgagaaacacgatcaatgagaatattagcgagcattcccttgaagttgcttttatcgcacatgtgcttgcacttatcagaaataagcgatttggcggtaatgtttctcctgagagatgtgcgctacttgctatgtatcatgatgtcaccgagataatcacaggtgacttgcctacgcctataaaatattacagccatgagataaagggcgcatatgatgagatcgagcagaaagccaaaaatactctggtgtcttatcttcctgatgatctgaaagaggactttgagccgcttttctgtaaaactccacaggaagaagaagcatggactcttgttaaagcggctgataagctttctgcacttataaagtgccttgaagaaagacaaatgggaaatactgattttgcatcagctgaaaaatctacacttgaatctattgtcgcaatgaatattccagaagcaaatgtttttcttgatgaatttattccagcttatacattaactcttgacgaacaagcttgacaatgacgcagtggtgttgtataatagaaattgaaattataggacaatattaagtgggaagatattgaattaacggaggctttcaattggatattatcgtttctgcgtcgctgcttgcctgcgacttttcaaaccttgcgttcgagataaagcgtgctgaggacgctggtgttgactggattcattatgatgtcatggacggaatgtttgtgagaaatataagttttggcgaaccgcttttgaaaagtgttggtaaaagcataacagttccagtagacgttcatctcatgatttgcgatcctatcagatatattgataactacgcagatcttggagctgaccttataacttttcattatgaggcggctgatgatccgcaagctgttattgacaaaatacattcgagggggatcaaggccggaatctccattaagcctgcaacacctgtaagtgctatccagccatttcttaaatctgttgatatggtactcgttatgacagtaaacccaggttttggcggtcaaaagtttattcctgacactcttgaaaaagtaagcgaagtgagatatctgattgaccagacggaaagggatatcagacttcaggttgacggtggcgtaaatctcgaaactgctggtttgcttaaagaatcgggtgcagacactttagtaacgggaacatatgcttttaaggcaaacgatatgccagaggctgttaagcttctaagagaaatagtttagtttttcaaaaggagtactgctcaataatgggctgtactcctttattttgtttataatcacgttgtcagtagcacaggttttcagtaaatcttttttcgcaactgttgagcgtgcgtatcctatggtgaagattagagcatgaccactaggaagctgatacagactgctttttataatcttttcggagtattttttgtgtatttcagtagcttttgatattagctcgtttggatcgtagctgattatggcaagttcagtggtgtgatgattgtcgtttttaggtagtataaaatatatgtttattgtttcttcacttgtcaaagcaacattaacttcaatatttccttcggatatttttataagtcctgtctccttgagtataaacatgagttcagataaaaaatctttgcttcttttgttgtttttctcaaaatcttcaaaggatatattcattatccgcatatccttttcgttgagaataacttttatttcatactctgacagcctttttatctccaaaacaaacaccccttatgtataatgtcagcctgcgctgtatcattatactcataaggggtgatttctgtgaaaaattttcttatgaaagctgatctgaaagttctgcccactcgtccattttctggtcaagggcggttttggcttcttcaagctctttgcatttctcgctcattttgctgtagtcagaagctatctcagggtcagatatggcattttcaagttcaaatatcagaacttctgtatcttcgatctccttttcaagttctcttatgcggttgcgtttttgagcgtcagcagcacgctgttccttactgcgatattgttttgctttgttttctttgtacgctttttcctcttcagctcgctttatctctgcttcgctctgcatcttgagctgacgggcagcgttcaccgcttcgctgtatgcgtcaaagttgccatcgtatgagttcacctcgtcatgctttatctctattatcctgcttgctaccttgttgagtagatatctgtcatgagatacaaggattatcgttccaccaaactctgccaaagcgtcctccagcacttcttttgtgcttaggtcaaggtggtttgtaggttcgtcaagcacaagtacatttccacgattgagagccattatggcaaagcaaagctttgccctttcgccaccgctgagaacagaaataggcttgaacacattctcgcctgtaagcagaactgcacctagtacgcttcttgcctgttgttctgataatcttggatagcgatccattatttcttcaagcactgtcttatggggatcaagtatagcgtgttcctgttcaaaataggatatcttcacgtttccgccccagcttatattcccaccctcgtgtgggataatgccttggataagtttcagtatggaagtttttccgataccgttcgcaccgattatagcaacgtgctctccacggcgaacgttcatggtaagtgactttataagctcctttttgtcagcaccctcgccaacgatcagcggacagtcaacaactcgcacgatatcctttgttggctcaatatcatattcaagctttatcttcggcggctttgagtacataagcggtttgtcgattcgctcgatacggtcaagcatatgctgtcttgacttcgccatttttgaggttgaagccctgacgagatttttcgccacatagtcctcaagctttgctatctctttttgctgtgcttcatattctttgagctgacgctctgagttcattttcttttgcacaagataggaggaatagtcccctcgatatgatgtgagcctgccttgttctatctcacatattctcgtacagaccttgtttagaaaatatctgtcgtgggaaactatgattattgcacccttgtagcctttgagatagtcctctaaccacatgagcgtttcaaaatcaaggtggttggtaggctcgtcaagtataagcagattaggctcttcaagaagaagcttagccagtgcaagacgtgttttttcaccgcctgaaagagtagagattactctgtctgtaggtgttgagccaaagcccatgccgttaagcacctgctttatttttacatctatcctatatccgtcccgagcctcaaagtatgaggaaagctcggcatactcatggcttatgtcgtcaatatctccgccatctgccattttcttttcaaggactttcattttatccagtgtttcaaggaggggagcgaaagcgttcttcatttcctcacctatggtaagttcagaattaagtccgctgttctgccttaaaaagccaatggaagccttgcctgcgatattcacagagcctagtccttcgggggtcttgtcataaccctctctgcctgtaatgatattaagcagggtagactttccgcatccgtttatgccgataagtccaacggcttctctgtcttcaacagtgaaatttatatccttgagcagtgcctgcccattgaaatatttgtaaagatgttcaacattcaataacattgtatatttctcctgtaacaattatcagaacttattatacactattttcttcttgatttcaaccttttttattttattgccacacttatgccatgcttaataaaaaaatatgaaaaaagtgcgtaaaactatgtactttttgatcgagatgtggtataatgaaaacaagtctataattttagtcttgataggctgattattttatccgaaaggacgggtgatgttagggttggagcagaagctttctttgtatggttttaataatctaaccaagacccttagctttaacatatatgatgtatgttatgccaaaactgaaagagaacaaaaggaatatattgcttatattgacgagcagtataattcagaaagacttacgaaaattctttgcgacgttactgagatgataggcgcaaggatacttaatatatcaaaacaggattatgagccgcagggtgcgtctgtgaacgtgcttattgctgaaaaagccctcgatgaggacagtatcgacccttcgtgcaatcaaggaaaaataggcggcgatgtgcctgaaatgatacacgctcaccttgacaaaagccatgtaactgttcacacatttcctgaatatcacccagacaactcaatttccacattccgagtggatatagatgtttctacttgcggaactatttctccgctaaacgcactgaattatcttatcagcagctttgactctgatattatcactattgactaccgagtaagaggctttacgcgagatgttctgggaaagaagttttttatcgatcacaagataacttcgattcaggattatatagataaaaatacgctgactaaatatgacgcaatagatgtcaatgtttaccagtcaaacattttccataccaagcttctcattaaggatatcgacttgcagaattatcttttcaagcaggacgtatatgagcttacgccgaagcaaaggcttgacataacagatagtctgcgccgtgagatgatcgagatatacagcggcatgaacatatactgataaggtagtgatagatttgaacttaacacagaataacgcacctgtgtatgaggctttaaaaaaacatatgaggaacagagtggtgcgtcttgacgtacctggtcacaagggcggaagaatgaataaagagcttcgtgactttttgggcgtggattgtctgaagtgcgatgtgaactccatgaagccacttgataacctttgtcaccctgtttctgtgataaaagatgctgaaatgcttgccgctgaggcttttggtgcaaagcacgctttctttatagtaaatggtactactgctgcagtccagacgatgatatttacaagctgtaaggcaggagataagataataatgccgagaaacgttcacagaagtgctatcaatgcacttgttgtgtgcggtgctatacctgtttatgtaaacccaggcacaaacaaacagcttggaatacctcttggaatgtccgttaaggacgttgaaaaagctatcaaggaaaatcctgatgcaaaggctgttttggtgaataacccgacttattacggaatttgctctgatataaaaagcatcgtcaagcttgcccatgagcatggtatgttggtgctcgcggacgaagcacatggcactcacctttattttggtgagggtctgccttgctctgcaatggcggcaggagcagatatggcggcagtatcaatacacaaaacaggaggaagcctaacacagtcatcgctccttctttgtgcagacactgtttcagagggttatgtaagacagataattaacctcactcagaccacaagcggctcttatctgcttatggtatcccttgaccttgcaagaaaaaatcttgcgctcaacggcaaggaactttttaaaaaggcagttgactatgccgattatgcaagggaagagataaataagataggtggctattacgctttcggtcgggagcttgaaaacggtgacgatatcttcgcatttgacagcacaaagctttccgttcacacaagagccatgggattggcaggtgttgaggtctatgacattctccgtgacgattacgacattcagatagagttcggtgatatcggaaatatacttgctatagtttccgcaggagatagagagctcgagatagagcgttttatatccgcactttccgaaattaaaaggctttattcaaaagacccgtcaggaatgtttgaccacgaatatatcaatcctatcgttgagataccgccgcagcaagctttctacagcgagaaaaaatcagtgcctatagaagaaagcaacggtatgatatgcggagagtttgttatgtgctatcctccgggaatacctatccttgcccctggtgagaagataacttccgacatacttaattatatcgcatactgtaaagaaaagggctgttttcttacaggtacggaggatcttgagataaacaacataaacgtagtggtaaattcatagagaggagatacattttatggatctttggtttactgagaaacatacggacgatgttaatttcaccattcgtgtaaaaaaacagctttattctaaaaaaagctattatcaggaaatagacgtttttgacacatatgagttcggcagggtattggtgcttgacggctttataatgcttaccgaaaaggacgagttcatctatcatgaaatggtaactgcagttcctatggcggttaatcctgagataaaaaaggtgcttgttattggtgcgggggacggtggaactatccgtgagctttgcagatataacacaattgaaaagatagatatggtggagatagatgagcaggtagtaaatgtgtgcaaggagtatcttccacagacagcctgtgcatttgacgaccctagacttaccctctatattgaggacggtctgaaattcgttcgccgcaaggaaaatgaatatgaccttattatagttgactccaccgacccgtttggaccgggagagggactttttacaaaagaattttacggcaactgctcaaaggcgctcacagatcagggaatattgataaaccaacatgaaagcacttattatgattcctatgtggatatggtaaagcgcacacacagaagaataggcagtgcgttcccggtttcaatggtctatcagacacatatacctacctatccgtctggtcattggcttttcggctttgcttcgaaaaatcttcaccctatatatgatcttaaggctgatgagtggaaaaaattcggcataaagacaagatattataacacagagcttcacaagggctgtttcgcactgccaaattacgtccttgatgtacttgaggactgtgactaaaggagagaagtatggaaaagaatgttcatacctttataggctgtgattgtgaatatgatgattcaaagatagtccttttcggcgcaccatatgacagcacaacttcgttcaggccgggtacaagatttgcaagctctgcaatgcgcaatgagagcttcggcattgagacttattcaccatatcaggataaggaccttcttgacgtgaatgtgttcgacagcggcgaccttgaactgccatttggcaatcctgagggagcacttagagatatccatgaccgcactgctgaaatacttgacgacggcaaagtgccttgcatgataggcggcgaacaccttgtcactcttggtgcggtcagagctgtggcagagaaatatccagatctgcatatcattcactttgacgctcatgccgatctgagggacgattaccttggagtgaaagagtcacacgcctgtgtgcttcatagatgctgggatattgtgggtgacggaaagatatatcaatttggcatcagaagcggtgacagggacgagttcaagtttgcgaaagagcatactttcatggaaaagttcggcttcttcagacttgacagcatagtaaaaaaacttcatggaaagcctgtttactttacacttgaccttgatgtgcttgacccttcagaatttccgggaacgggtactccagaggcaggcggagttacttttaaggagcttatgtttgcagtggaggaagtcgcaaagcttgatatcgtgggctttgatgtgaatgagctgtcccctgtgtacgatcagacaggacgttcaacggcacttgcctgcaagctgctgagagagatacttttgtatttttataaataaaagggggaaaacatggggttatttgatatttttaagaaaaagaatactgacgccaatgtgcaaaatgaatcagcggagaaaactttaggccacgaaacagaacttaaagttgccgagcaggcacttaaagctgttgagaaaaagacgttaacaccttgcgtgaggctagaacttgcaggtgataagccctctatttttgagagcaaggtcggcggaattggttatgtcccacatgacggcactatcccagaggacaaaaagggcaggcagttaaggctgctggctcagttagattgttcgcaggtggttggtatcgaagattttcctaaaagtggacttttgcagttttggatattaaatgatgatgtttacggaatgtcttttgatgatattacttgtcaagatacgttcagaatagtttatcacaaggatattgacaataccgttactgaggaagaagtcaaagctaagttcaaggaaaacggacttgacggagagtacagtatgcctgtaaatggcgagtttggcttgaaattcacttcaagtactgatgttatgagcgaatctgacgtaaggtttgagaagatgttttgtgagtactataatgctgctcaatcgaaaaagaaaataaattctcttatggacatggatatcgctcctgctgacgagatagaggcttatgagcagaactatcagaacgcttatggtcataagataggcggctatcctgcttttacgcagtgggaccctcgtaaggaagataccaagtatgactttttgcttttgcagcttgacagcgaattcggcaatggcgatgagaagataatgtggggagatgcaggtatctgcggattttttataaacagacaaaagcttaaaaatctcgattttgatgatgttatctataattgggattgctgttgataataaatttagaaaggaatgatctaatatgtcaagagcattgataatcggtgcaggcggagttgcaggtgttgttatacacaagtgttgtcagaacagcgaggtatttactgatatctgtatcgccagcagaacaaagtcaaagtgcgataaattcaaggaggaacttcaggataagacaaagacaaatatcacaactgcacaggtgaacgcagacaacgtgcctgagcttgtggctcttatgaaagaatataagcctgatatttgtatcaacgtggctctgccttatcaggatcttcacatcatggacgcttgccttgagtgtaaagtagattatgttgacacagcaaactatgagcctgaggacactgcaaagtttgaatataagtggcagtgggcttatagagagagatttgaaaaggctggtatcacagcgcttctcggatctggctttgacccaggtgtaacaggtgttttctgtgcatatgctcagaagcattattttgacgaaataaactatatagatatcctcgactgtaacggaggcgatcatggctatccattcgcaacgaacttcaatcctgagataaacataagagaagtttccgcaaagggctcttatattcaggacggcgagtgggtagaaactgagccaatggagataaagagagtttataacttcgatcaggttggtgaaaaggatatgtatcttctccaccacgaagagcttgaatcactggctctcaacatcaagggtatcaagaggattcgtttctttatgacatttggtcaaagctatcttacacatcttaagtgtcttgaggacgtgggcatgacatctatcgagcctattgactttgagggcaagaagatagtaccgctacagttccttaaagcagttcttcctgatccagcttcactcggtccaagaacaaagggtaagacaaatatcggttgtatctttcagggtaaaaaggacggcaaggacaagacatattacgtttacaacgtatgcgatcatcaggagtgctataaggaagtcggttcacaggctatctcctacacaacaggcgtgcctgcaatgataggcgcaatgatgatactcacaggcaaatggaaaaagccgggcgtacacaatatagaggagtttgatccggatccattcatggacgcacttaacaagtggggtctgccttggaaagagaactttgatcctgttcttgttgactaataggagaacaaaaaatgaaaatcgaagaagcttttgcgagatacctcggacaagaggtgcttgtttatacagtttcgcagggaggctcgctttcatcagttatagactgcacacttgaagagataggcgatggctgggtgagagttactcagggtgatgacagaaacgaaagtatcgtgaatacagccaatatcatcaggataagagagtatccacgaaacaaaaacggcaaaaagaaaatggtttttgattaaaggtgacgaaaagtgaaaaccaaaacaaaaaaaatgatagcaccagttgtgatagttgctttgatatctatttattatatagctattggcgttatttttgcatatatgaatggtgttcctatgcttgcaaagataattgctctggtagttcctgccttgctgtcaggcgttgcgataacggtgcttattcagcgtataaaagaaataaagaagggcgaagatgatgatcttagtaaatactgattatatttctggcaaaaagcttgaaatgcttgggcttgtcaaaggctcaactatccagaccaaaaatgtcggaaaggatatcatgcagagctttaaaaatcttgttggcggagaacttactgcctataatgagatgatgaatgatgcaagagctcttgccacgaagagaatggtggttgaagctgaacaaatgggtgctgatgcagtagttaatataagatatgcttcatctgctattgcggcaggcgcggctgaggtcattgcatacggaacagcagtaaaatttatgggggacgagtaaatgatattgatgatagacgatgttaaaatggtaaatgctgatatgttttacccatatgtcagcaaggcacttgctcatgatatggattctatagctaacggcgacaagctttatgagaagctctgtgaagtcgaagaaccgcttgaagtaatgatacatgactttgacgatattcctgaggagagtcttgaatttgccaagggtgttcttagtgtttttatggacgcaagaatgaaaaacaaaaatattacagtaaactttatcaacgatggttcatatagatgagctgtggaggaaaagaatgtttgatatttctaaggtgaaaacaccttgttatgttgttgacgaagcaaagcttctaaaaaatctgactatcttggataatgtcatggagaaaacgggctgtaaaatacttttggcacagaaagctttttccatgtatagcacataccctatgatatcacagcacttgaaaggcactaccgccagcggtctttatgaggcaaagcttggcagggaagagtttgacggagaagttcatgtttattctcctgcatacacagaaaaggacatgaatgagcttgttcagatatgcgatcatatcgtgttcaactcaccaaaacagtggcagaaattcaagggcattgttgaaaaaagcgacaggaagatatcttgtggaataaggtgcaatcctgagtattcggagatcgaaacggatatctacaatccatgctttaaaaattcaaggctcggaacaactttagataattttgatgacagtcttatcgatggcatagatggtctgcattttcatactatgtgtgagcaaggctctgatgtgctaaaaagaacgataccacatattgaggagaagttcggcaagtatctttacaatatgaaatggataaatcttggtggtggacatcacataacccgtgatgactatgacctagatacccttatcgagtgtgtgaattatattcatgacaaatatggtgttcaggtctatctcgaaccgggcgaggctgttgcacttaatgcaggatatcttgtttcagaggttatcgacactgcaaaaaacggcatggatcttgctattcttgacgcatcagcagcctgtcatatgcctgacgttctggaaatgccttaccgaccgaatatcatcggttcagggcaggcagacgaaaaggcttacacatatcgccttggcggtccgacctgtcttgcaggtgatataatcggggattattcctttgataagccgcttaaagagggtgacaggcttgttttttgcgatatggctatatattccatgtgtaaaaacaacactttcaacggaatgcctttgccgtcaatatatcttcaaaagcttgacggcgagttggagcttataaaagagttcggctatgatgattttaaaatgagattataagaaaaagcggtctgatttttggtcagatcgctttgtttatgttttatttatgtaaggcagtgtttttcgatttctttcataacgctgttgtcattgtttgagcctgtcatgaaatttgctacctttttaatagactcatgagcatttgacattgcaaagctgtagtaagaattgttgagcatatcaacatcgttaagataatcgccgaaagccatggtttcttcatatcgtactccaatgcggttttctatggttcgcagtgcagtgccttttgttacgcccttattcattatatccgtccagtatttacctgaaagctgcacgttgaaattttcgccgaagcgttcttcaagcttgcagtagccgtcattttcaatgccgctttcttcaaaaacggctatcttgaaaatatcatcgtcgacaagggtgagatcctccatctttacttgatttacatagtatgaagctatttcttggtgctgactatcatttcttgagttatgccatgtgccattttttccgcaaagaaggactgtaagtcctaatttgtcgcaaaatctaactgcttctttaacggtatcctttggcaacactgaaaccgaaagaagttttcctttatcaacaacatatgcaccattgtcgcaaataaatgtcatgtcgtcaagatattcagaaaactgtttctttagcgtgcagtagcttctgccacttgaaataacaaatctgatatttttattaaaaagccgttttactatgttgtcaaaattttcgggaagctgcttgttatcgtcaagcaaagtgccgtccatgtcagttgcaataagttttatcattgttttcctccgtgatcattgttatgctcagacattcatattataatgtatttccatactattttcaattatttttgatttttgacaaaaaactttgtcaattttaatatatttatttcatataaacaaaagcacattgagattattgtacagttaaattatttgagcatacataaaatgtaaattgttttacgcgattattacaaaagtgaaaaatagctgaaatttcagcttaatttgttgacattaaggttcaatgggagtaaaatatactttgttcaaggaatattgcctttaaattagttggctagtttgaagaaagttttgtgtatttcactgaaaaggttttaatatgcttgacttttatcagaaaaaattatacaatattctttgcgactgaataaagtaaatagaaaaggagatataaatgaataaggtcataacaaagatccgcagcggaataggcggatatctgaaggataacatcttgtttctaacatttgtatttgcatctgttctgaatggatttcttcttagagcatttactgttaagtttaattacagccagataaaaccgctcatggctgatatggcagttatactgttgcttgctctaatttcatatgtgtttaaaaagccaagaaagcaatttgtatatttgcttgtactcaccataattttttctattctttgtacggcaaattctatatactatacaaattataagtcgtttatctcagtgtcgcttatttcaacggcttcacagctcggcggagtaatggacgctgttactgagaacatcatggaaccaaaggatcttattttcctgtgggatatccctgtgatcgtagttgtgtacatacttcttaaaagacgtacaagagattatatcaccgaggtcaaggaaaagagaaagcgccgtggatatgctcttggaacattttgtgtttccataggtcttgcaggaatattttgctcaacacttaccggcactgattattcaagacttgctaagcaatggaacagagaatatgttcttggcacttttggtctttacacatatcagttcagcgatgttatttcctgcactcatgcgaaaataaatatgatgtttggttacgaggagagcgaggaggttttcaataagttctatgacgataagtcaaagactgaagaaacttccgaaaagagtaacaagtacacaaatattttcaagggtaagaacattatagttatccatgctgaaagttttcagcaattctgtatggatacatatataaacggagaagagcttacacctaatatgaacaagcttgcaagagagggtctttatttctcaaatttctacgctcaagagagcgtgggaacaagctcagatagcgagtttacctttgcttcttcacttatgccagcttcaagcggtacagttgctatcaactattgggacagagattacacaactacccagaaaatgcttaagaagaagggctattatactttcagtatgcacggcaacaacggctcttactggaacagacttaatctacatcattcccttggttatgatgatttctttaactataacaaagattttaacattgatgaaactattggtcttggtctgtcagacaaatcgttcttcagacaggcagttccaaagatcgataagataaacaaggagcatgataagtggtatggtgcgttccttatgctcacaaaccatacgccgtttactgacattgagcgtgtgagcgactatgaggtagatttcaagtataagatgtacaacgaagaggacgggatgtatgaggaaaaatctgcaccgttccttgagggcacaaagcttggatcttattttaagtctgttcactatgcagatcaggctatcggtcagttcatgacagaacttgacaatgcaggacttcttgataacactgtagttgttatttatggcgaccatgacgcaaaaataaaggcagaggagtatgaccgatatttcaactataatccatttactgattctgtgcttacagaagatgatgagggttatgttcctgttgacgatttctactacaatcttaacagaaaagtgccgttcataatatggtcgaaagacggcggatataagcctacagaggtcaagcagataatgggtatgtatgacgttcagccaacacttggaaatatgtttggcttctcaaatgtctatgcacttggtcatgatatcttttctgttgctgataacgaggaaaatgttgttatcttcccaaacggcaattttgtaacagatactgtttactatgatagccagaaaaacacatattttgatcttacggattacaaaaatgtggcaacggcagtgtcatgcaatcaagtatataaagatgatcctaacccagtgtatatggacaacgatcagggtctgttcaagaccactgtgaatgaaacgtactgtcaggattcttgtaacgcacgaataaacgatggtgttgtggacgaggattatatcagtaactactcgaattatgccgaggagcgaattaacatctccaatgctataatctactatgatatgatatataagaccgaccacggtttcagcaacaacaatatgaacagtgacaattcatcgtcaggtgctaattctgtttttgcaccgcctgagaataagagaacatttggcagacacgctgcataataaaaatcggagcagagtatgacactcggctccggtttttttgttgtatcttaaaaagcataaaaaaaagactagcgaagctagtcgattttttggaatattcaagcattaagctctttctaccttacctgaacgcaggcatcttgagcaagcgtaaatgtgacaaggagtgccgtttacaacagctttaactctctttacatttggcttccaagttctgtttgttcttctgtgtgagtgtgataccttgataccaaaagtaacgcccttaccgcagatctcgcattttgccattacgctgcacctcctttacccttaaaaatgtaatactattattcacaatattaaatattatagcataactgaaaagaaattgcaagtgctttttgagattttttttgaaatttccgtaaaatcgcatatatttatcgttttcgattaaaaataaagacaaaatgccttgaaatttcattgaaaatagtgtataattacacttgtgatttgtgtaattttgttttgaaatgacaggaggtcatgaaaatatggatccgcagaaaattctagattacggtgcaaagctcatcgtaattttcatgtgtatacctatccatgagtacgctcacgcatgggcagcaacaaaacttggggatgatactccacgctatcagggtagactttcccttaaccctcttgcacatcttgaccctattggtgcattgtgcatattcttcataggttttggttggggtaaacctgttcaggtaaaccctatcaggtttaagaattacaggaagggcatggcactcacggcagccgcaggtcctatctcaaatatcataatgggacttatcggaatagttctttataagcttttctatgtgctttatatagtgcattattctatagctctttactatgtgtcgcttatattatattactttacagctataaacgtgggacttgcagtgttcaaccttatacctatcccgccgcttgacggtcagaagatactttcttactttacaagcagtaaggtagaccgctttatggcgcagtatcagaactatatcgctattgcatttatgatacttgttgtaacaggcgttcttgatacgcctataggttggttgcaaaatggtatgttctggataatggataagattacgttctgggttgaccctatactaaaagcgatatttttgaaataaaactgttcatgaaaggaaaaacgtaaatgagtgctgctcagttcaagctggatatgtttgaaggaccgcttgacttgcttcttcaccttatcagcaagcacaaactgaatatttacgatattgagatatctttgctccttgaacagtatatggactatatcaatgatcttgaccacgaggattatgaggatgccgctgattttcttgaaatggcggcacgccttatatacataaagacctgttcgcttctgcctcatgacgaggagtcaaaagagcttaaaaaagagcttgaaggcaggatcatcgagtattctctgtgcaaacaggcggcacagactctccgtgaagtttacgttggcgaccttgtttttataaggacggcgataaagcttcctgtaaacaagacctatacccgtgagcatgaccctcagtgtctttatgacgcttatatgggcatatcaaagaaagcccgtgagagcgttccgctgaaagcgaagatgttcgagccgatagtttcacataagatagtatcggtcacatcgaagataatccatgtccttaaaagactttataagcatggtgaatgcgatatgggcgacctttatgacggcatgacggagaaaagcgagaaagtcgctacttttcttgctatattggagcttacaaagtctggcaggatatttctcaatgacgataactcaaagatttttttcaacaaggcttcaaataacaaaaaagtcgagtccgacttcgataagcctgttgttatcgaaagcgaaacgacagaagctgtctccgagcctgagcctatagaaaatatacttgacgatgagcctgcagatgagatagaagaagttgctgatgttggcgcagagcgtgaagaagcttctcagtcaaagcggtatatatctgcaaaatccgagcgcatatcaggtgaagtcattgcggcgtatgctcctgtgaagtcagccgaggaggtcatggcagaaatggagcatatatctgaaaagatagacagtgttgatttatataccgagcctgctatggcaaagcctgagcccgaacagcctgatgaagccactatggaggagataaggctgatcgaacagcttgcggatatcacccctgatactgtattcaagccgaactattggacaaaaagaagatattattggggatattcacctgtgggcgatgacggagacaataatttctggtgctacggataaaataagaaaagggataatctatggaacattcaaatatacaggcagccgtcgaggctgtgctttttgcaagcggagagcctgtggagagcgagaagctatgcgaggcagttggtatagtcaaagatcagcttgaggaagctcttggctctttggcggataaatacagcaaggctgaaagcggaattacgcttctgagccttaatgggtcatatcagcttgccacaaaagaagagcttgcgacattcattaaggcggctttggagataaagaaaaactctgttcttagccctgcggcaatggaggcgctgacaatagtagcatataatcagcctgtaacaaagggctttgtggaacacatcaggggagttgactcttcgggagttgtaaattctctcgtggacaagggcttgcttgcagaagcaggcagacttgacctgcctggcaggcctattgcatacaagacgacggacaattttctccgttgtttcaggctgtcaagcctggacgatctgccgcctatccctgataagcaggagcagataaccattgacgagataacaaaagagaatgatacggaagaataaagtatgaccgtgaggggagatgataacgataattgttttatggatactgcttggtattatagcagttattgttatcctgcttcatttttccattacggcacagatagatctgaataaaaaaggctttgatctaaaagtgcggtatatgttttttgacatttatccacgaaagcctaagaagaaaaaacagaaaagatcaaaaaaagctgaactgcctgaggatagttttgaggattttgaggagtttgaggacaatattgaagaaagcttacctatcccacagactgatgatacgcctgataaaacaggagaagtgtccgagcaaattgttgaagctaagcctgaaaaaatagaaaagaatgaagcagatgaaaatgtcagcgtggctgaggtagaggataagcaggaagatatctctgatattgatactgatactaatgttgaagctggtgcagaggacaaaccagagaaaataactgtgaaacaggagaaaaagggctttgtcggaaagctttttcataaaaaggataagggtgaaaagaagccggtttccaaatctaaagaaaagaaaaaaagcaagttctataagctgaaagcacagtataaaaaggtgaagccttatattccgatgggttggaaatattttaaaaagcttttgaaagctatacgctttacagacacaaggatagttcttgacgttggaaaagaggacgcttacgaagcggctatgctatacggcaaggtgcaggcagggcttttcaataccattgcaatacttgcgggtgtttttacagtaaagcttaaaaaagctgatgtgaactgcatttttgatgaaaaaaagttcggatatgacgttcataccttagtcagggtaagaccaagcactttgatagcaatagggttttgcacgggcgttaattttcttaaaatatatctttcaggcagacgtaagaaaaagcgtgctgccaagcgtcgcagtaaagagcttgcggctaagaagaatgaagttaaagcaacaaattgaaatacgaaaggttgagaaaaatgagcgaaagtacaaagatcgagggacttgttaaaactgcaatggacaaggtccgtgaaatggcagactgcgaaactgttgtgggcaagcctatcgttaccgcagatggtactactataatcccagtttcaaagatatcagttggctttgcgtcgggtggctcagacttgccaacaaaaagcacaaaggaaacgttcggcggtggctcaggcggaggagtaactatccagcctatcgcttttatcgctgtttacaagggcgaagcaaagcttttacagctttcaatgaatgcgacaaaggaaaacgctatcataaatatggtacctgaggtaatagataagattacagattttcttggcaaaaagtctgacgacgaggacgaagacgaggaataattttactgaattttaaaagcacaagtgagcaaactaatccttgaaattgattttaagggtgtggtttgtttgaaatgcgtgacggtatttatttgtacggtcatgatgatgtgcttttgctgtatgaatgtcagcgctgacgatctcagtgagatatccgcgaagagtgctatagttatagacggtgaaacaggtgatgtgctgttcgagaaaaacgcctatgaaaggcgtcagatggcaagcactaccaaaataatgtctgtgcttcttgtgcttgaaagtggtgaagatcttgacaagcagttcgtggtagacagcgaagctataaaggtcgaaggctcgtccatgggtcttcaagatggtgacaaagtcactctacgcgatctatgctgtggcatgcttcttccaagcggaaatgacgctgcaaacgctgctgcggtaagagtggcaggaagtatcggcaagttcgttcagcttatgaacaaaaaggctgaacaattggagcttaatgatactcattttgtaacgccgtctgggcttgatgatgatacagatgagcattattccactgcagcggatatggcaaagcttgcagcggaagcaatgaaaaatgaagatttcagggctatatgccaccttgaaaaggttgagttgtgctatggaaacccaccgtatgaccgctggctaattaactcaaacaagcttttaaaaagctgtgagggtattgtgggcgtaaaaacggggtttacggacaaggcgaggagatgtcttgtttcagcctgtgacagaaagaataaagagcttatatgcgttaccttgaatgctcctgatgattggaatgatcactcaaagctatatgattattgctttgattttgtatctaaacagaagcttccactggataaaagtagttttgatgttgcagttgttggcggagtgagcgacagtgtgaaatgtaaggcagggcaggcaagtgctgtgcttctgaacggcagggcttacaaagtcaagacaaagatatatctgccaaggtttgtttatgcgcctgtgaaaagtggagataaaatagggctggcgttgttttactacaatgatgtggaaatagcccgaactgatatcacggcaacggaagatgtggagcttgctgaccctgaaaagcctgacatttttcattattattttaataagctgaaaaaattgtttgcataacggctcaatgtgagccgtacataaataaggagaaaatatggaaaagattcgtatacagaaaataatgtctgacagtggtgtttgttcaagaagaaaggcagaggagtatatctcagagggaagggtaaaggtcaatggcagaccttgcaagcttggcgacaaggctttggcaggcaaggatataatcacccttgacggggaaaaaatatatgttgccaagaaaagacagctttattatatcatgctccacaagccaagaggatatgttaccacaatgagcgatgagcttgatagaaagtgcgtaaccgagcttctaacaaaagtgcctgaaagagtttatcctattggcagacttgacaaaaactcagagggtctgttacttttcacaaacgacggaaactttgccaatgatatcatgcacccttcaaggcatatcgctaagacttatcgtgttacagtaagacctgacataaacgatgagcagctcataaagcttgcttcaggagttgaaatagacggcaaaatgacgcaggagtgttcagttgtcgtgctcgacaaacagcctggcagggttgtgcttcaaatgactatccatgagggcaggaaccgtcagataagaaaaatgtgcgaagctgtgggacttgaagtcgcaagactaaagcgcactgccatcggtccggttaaactgggcatgctaaaaccaggtgagtatagagagcttaaacctgacgagctaagggctttaaggaatgctatcaccaaaaaataacgctcatcgagggtctctttttgtcaggaggccctttgctattgtgcaaaatgcttaataatatgcgtgtatcgatattgattatgctactaaacgtaaaatatgcggaaataggtcaatttactcttgtaaatttggcgaaaaaatagtataatattaagtgtataaatatgataaaatccagtagttttgcgttattttatcacaaaaattatttgaatggaggaaactgtatgtctgattcaatttctactcttgctgagcttaaagctgcgtcgcagactcctactgctgcaagaaacaggctgacatatttgtttgacgaaggaaaatttacagagcttgacgcttatgctgctgcgggtgactcccttgctggagttattactgcttttggctatgttgagggtaatcctgtatatgctttttctcaggacgtgactgttaaggacggtgctttgacagaggcacaggcaaagaagatagcaaaggtttatgaccttgctgctaagacaggagttcctgttgtcggaatattcgattcttatggtgctgacgtaagcgacggttcaaaggctctcaatgcttatggtgaactgcttatgtggacttctaacctttcaggtgttgttcctcagatagctgttgtcgctggcacttgtgcaggctgtgcagcaatgctcgctgagtctgctgacttcactgttatcgcaaaggatgctgagctttatgttgcaccaaacgcaaacataaagaactctgctgaaaatgctgctgaaaacggcactgctgctgttgtttgtgaggacgataaggctgctgttgaggctgcaaagaatatacttacaaaacttccacagaacaacctttcaccagtaccaatgtatgaatttgctgatccaactgaggctgttggtgatgacgctgatggcattgcaaaggctgtttgcgatggcgacagtgtaactgagcttaatgctgagtatggcaaggcttcttatacagcacttgcaacacttggcggtgctacagtcggcgttgttgctactaacaagacaggcgacaagcttacatctgctgattgctcaaagatcgcaagatttgtaagaacttgtgacgcttacgctatccctgttgtaacttttgttgatactgagggcttcaaagctgatgatgaaactgaagcttacggcgctgttaaggatatggcaaagctttgccacgcttacgctgaggctactactattaaacttgctgttgttacaggtaaggcttatggtcctgcatttattgcacttgccggcaagggttcaaatgctgatctgtcatttgctcttgataccgctgttatctctgcacttgctcctgttactgctgttgaattccttcagcatgacgagcttaagggtgctgctgatcttactgctgcaagaaacactcttgctgataagttcgctaaggaaaatgcctctgctgctgttgctgcaaagaatggctgcgttgacggtatcatcgctaagaacgagattagacagacacttatggactctatcgaggtaatggctggaaagagaatttccagactgcctaagaaacacagcaatattcagttgtgataaacatatcaaattaaaaagattggtggttttttaagatgaaaagatataatattacagtaaacggaaaagcttatgacgttgcagttgaagaagtcggcggaagtgccgcagctgctcctgtagccgcagcccctgttgctgccgctcctgctgctccagctccagccgctgcacctgttgcggatggcacaaaggtaacagctccaatgcctggtactatccttgacatcaaggtagctgtgggcgacactgttaagtctggtcaggctatttgcgtacttgaggctatgaaaatggaaaatgacgttaacgctccttgcgacggtaaggtactgagcgttaatacaactaagggctctgctgttgagactggtgcagttcttgctgttatcggctaataacattcctgaaaaataacgaaaggatcgatttaaaatggcaaagcttaaaataactgaaactgtcctccgtgacgctcatcagtcacttcttgctacaagaatgtcaatggacgatatgcgtcctatacttccagagatcgacaagatcggtttttattctgctgagtgttggggcggtgctacatttgactcatgtatcagattcttaaatgaagatccatgggaaagacttcgtatacttagaaaagaaatgcctaacacaaagctccagatgcttttcagaggtcagaatatgcttggctaccgtcactatgctgatgaccttgttgagtattttgtacagaagtctattgcaaatggtattgatatcatcagaatttttgacgcactgaacgatatcagaaaccttgaaacagctatcaaggctgctaagaaggaaaatggtcacgctcaggttgctatctcgtacacacttggcgaggtatttactcatgagtattacatgaactatgcaaagcagattgagaatgcaggtgcagattctatctgtattaaggatatggcggctcttctgactccatatgaggctgaaacacttgttaaggacctcaagtcagcagttaagatcccgatccagttgcatactcactacacatcaggtcttgcttctatgtgcatcctcaaggctgttgaggctggtgttgacggcgttgatacagcaatgtcaccacttgctcttggtacatctcatgcaccaactgagtctatcgttgccacattcaagggcactgagtatgacacaggtcttgaccttgttaagctcaacgtgataagagattacttcatgaaactcagaaagaagtacattgacaacggtctgcttgacccttcaatgctcgctacaaatacaaacgcacttctttatcaggtaccaggcggaatgctttcaaacctcctttcacagttgaagcaggctggcaaggcagatcagcttgatgatgttcttaaggaagttccaaaggttcgtaaggatgcaggttacccaccactggttacacctacatcacagatcgttggtacacaggctgtgttcaacgtaatcatgggcgagagatacaagacagtaactaaggagttcaagggacttgttaagggcgagtacggtaagacaccagttgctatcgaccctgagttccagaagaagattcttggcgacgaagagcctatcacttgccgtcctgctgaccttctccagccagagtttgaaacaatgaagaaaggggctgctgagtggacagagcaggaggaagatatcctcacatatgcaatgttccctaaggttgcacctaagttcttcaaggacagacgtgatagaaagtacggcgttgacggtaagcactcagacgctgaaaataaggttcacccagtttaataacaattatcccacagtttcggctgtgggatttttttgcttatggctcttgaaaaatctgtacatttgtgttataattaatatacattttttcgggaggacgccaagatgaacaaaaaggaaataaatgaaattaagaagaatttcagcgatgactgcggcttttttaccgtaaaccacgttgttacggcatttgtggatgctgaaaagaacataaagtgcaagaccaatcagctttacaacactattccgcaggacgaggcggagctgataatgataaacctgaaaaaggtgctcagcggctctatcggcaaaaatctgctggaatattcgtttccaaaggacgcatatcttgagggtggggcacagcctttcatgtatgaaacattgcaaagcaagctgcttgatgaggaaaaggttgataattttctcaacgccatagttgaaaaggtggagtatgtgtcaacatataccattttcatggcacattgtacatattctgtgctgaaaaagaacaaaatggacgagtttgaggacgaagctgacactgattacaacttcatagtgacggcgctttgccctgtaaatctgcgtattgacgggcttgtgtatgatgaacaggacaactctatcgctaagaaagagtcatgcgacagaattgttgagcttccaagcgatggctttttgtttcctcttttcaatgatcgtgcacctgatatcaacggagtgctttactacacgaagaacgctaaaaagccgaacacttccgttgtggaagagcttctgggttgtgagttctcaatgacctgtcagaatgaaaaggaaactttcaaggatatcctcacaagcgttgtgggtgatgagcttgactatgatcttatcactaccgtgaatgacaagatttccacatttgttgaccaaaatgctcatgaaactgagataccgacaattgacgaacataaactttcgtccattctgtgggaagctggagttagtcaggataagcttgataatcttcctaaagtttttgacgctgcggctggcgggaagccactcacagcggtaaaccttgtggagaaaaggaccgtagtttctgctccaagcataaccgtaaatattggcaaggacgcagttgacaaggtaaaaactcagatagtcgatggcagaaagtgccttataatcaatcttgatgaccctgagatagaggtcaacggacttgaaactacaataaaataagcacaaaaaaaaggcagctcaacgctgccttttctttatataagctcgccaaacgagaatttgccgttttccagtatcagatagctgtgtgttgaattttctttcgggatagatactgaacccggatttatgtaggtgtaatcgccgcagtctttaataacaggtacatgggtgtgaccgtgaagaagaatgtcgccctttgaaagtggtggcagatttgtgcagttgtatttgtgtccgtgagtagcaaatattctcaaattgtcacagcatatataagcatattccgccataacagggaagtcaagcaccatttgatcgacttctgtgtcacaattaccacgtacgcacagaagcttgtcttttagcggattgagcatggctatcacctgctttggtgcatattcctttggaaggtcgtttcttggtccgtgatagagaatatcacccaaaagaattagtctttccgcaccgttttgctcaaaggcttcaagcatttttttgcaccagtaagccgaaccatgaatgtctgacgctatcataagtttcatattttacactcctttatttaatgatctcagatgcaagcttgtgcaaagacacatactctggctttattttgttatatatatcgcagcctttttcctttttgaactcttttaccattctgatataaagctgctgttttgtcgtggcgtcaatgactgcttctcttataagcgccagttcgtctttgttgcatttgccgtcgagtagctcatcaagttttacggatagtacatcatggtaaacaaccttttcagttttctgagccgtcatcgttttatcttcatcagcggtgtatgtattatcggattcctgtagtcctttaagtcgcagatatcttggcctaagaagcttgtaaaaatctgtagcctgctttttatatacctttgcaagagagttgtgaagctcctcttttgtgttagactcagctataagtttgctgatctcttctatttgctcttcgctgcaaatgtttgcaagtatgcttcggagatcgttgtttttttgtgtggtacacttttttctaccctttttcactttgacgatagtttcaacaacaggatcactttctacttcgacaatatcaggtgcacaggcttctggttcttcttcgacctcttctgtattacaattcatattttcgtttagtgtaacagaataatctatagccgcagactcagggtttgactcatctgcttcgtcaagagttatctctgactctgtctgaatttctgctgtttcttctgtttcctctgctttttcgactatatgtttagtcgattcttcatcttcattgttttcagtcggattaaccttatgattagcgaaattaatagcggtttgtattgtcctagttctgtagaccatagcatttgggctgtcaacatacttaccgtgccagaaatcatgaagaaagtcaaaacctctgtcattgctgataacaaaaatattcgtataagtatccttggctaccagataacccagaagtgttgaaagctgaaaatccaaagcatttttgccaccaacgtttaccttgaagtattcaatatcagcctttgatgtaagaactttctggtgcatttcaaagttaatggtatcggaattttcactgtaaaaaattatgacggtatcagtttcagttaaattgtctatgccttgaagtcctttggatttgacattttcaaagtctaccaaataaattttcatgttgatctatcctttctttttgtgtcgtataagaatcgtagctgcgattataacaataagtccgcctgtcgcagttgctatcataagtatggcatttttgcccttttcatcgttctcactgctgtcaggaacgacctcctcataggtataagtttttgtccttaacgccttgtctatacaagaagcaataagtgcatgaccttttttattagggtgtatatcaaagtcatttatgttggtaagttcctttccgtgaccgctgaattcactaaaaacatctgctactatgtatctctcattttcatcttcgtcagtggagtgttctttgataatgttgttaagttttgaaatcttatccttcgatatactctggaaaacagcagccgcagtgaaattatcaagcgggtcatatagtgtctgaacgattatttcacccttacttttagcttcaacagcgttaattatatcatctagagtgctcgtaaaatttttcagcgccttatccatatcatcagacatatccttcatatccattgcaatgccaataatatccttggttttatccatcaaatcagacaatgtgcttttagaagtaatgcccagatcgttcatcaaaaaatctatgaaaagaccaagaatgtcattgccacctatggatataataacagcgtcgctgtctgcaaggtcagcgtcaaattcgcctgaattaatgcggtcaagaagctgctgtgaagtgtcgcccacaacagcagagttcacaagcttacagccgccagcgtctttaagctcagcgtcatactggtcgtgaagaagatttgcataagacgcacaagaatatctgttttcactgtagccttccagaccatagccagcggcgattgaatccccaagcacaagtatattaggcggaacatttacttcatgctttataacttcagcgttacaggcaaggggtgtggcacatgccataacggttgccgtgaaaaaagccgttaattgttttaacatcttatcatctcctatatgagtatattaaccttattatataatatattgtaccacattcaggacaattgtacaacatatttttttgaaatttcttgacttttttagtgtgttgtgataatatataataaaagaatatgaaatcagtttggaaagcgagatttattatgactgactattattaccctgtcctcagcgatgaaacgagtctgcctttgtatgtgcttggaatcggtgcgagagatagagaatttcattttgtaagagaagatggctatcctaatcatcagataatatactgcactcgtggtcagggccacattatatttgatggtcatgagtatgatataaagccgggtgatgcattttatctgccgccttctgtgccgcatgagtattatcctgttggtgatatatgggaaacccactggataacctttgagggcagggaagcaattgaaatgctcaagcatatcaagcttgagaaggctaaagtgtttcacataaatgatatcaatgctgttgatgccatatttaagaagatactttatcttatgaagactaattattactactgtggtcaccagtgttcggcatatctatatcagtttcttattgagctacacagagtcgtaaacctacaaaatggtagtcaggacgggcaaaaactcaatcagctgcagcctgtaattgattatattgataagaatttcagaaaagaacttacgcttgtggagcttgctgatcttattgacctttcaccgcagtatctttgcagacttttcaaggagtgtcttagtctaagaccttttgagtatctagcaagaaagcgtatacagcaggcaaagctgcttttattggaggataagcttaacatcaatgaaatcgctgcggaggtaggttataacgattgcagttatttttgtgcggtgttcaaaaagcatgaaatgctttcccctgcagaatttcgttctcttcataaaaaagctggcagctaaaatataagacccacgggaaaaacctgtgggtctgttttttataatatcgtgccgccgccgatgacatattcaccgtcatagaaaaccactgcctgtccctttgagatagctttatgaggttctttaaaagtcacgagtaccttgccatcattcattggtgaaactgtacattcagcgtccttttgatgataacgtgtctgagcagtgcaggttataggatctgtgagggtgtcaaacggaataaagttcacatctcctgccacaaggctgtcactgtatatttcatcagccttgcccataataagcctgttatgctccatatcttttgcaacaacgaaaagcggttcactatatgaaatgcctacgccctttcgctggccaatagtatagtgtatcagacctttgtgtttaccaagctttgtgccgtcagaaagaacaatatctcccgactgctgttcaccgcagcgttttgtgataaagcctgcgtaatcaccgtcagggataaagcagatgtcctgagagtcaggcttgtttgcatttataagcttgttttcttctgcgatatcacggatcttgtccttgtgcatatcaccaacggggaagagagtgtgagcaagctgttcctgcgtcatgctgtaaagcacataactttgatcctttgacctatcaggtgagcgtttcagaagccacctgcctgacttttcgtcaaactctctggcagcgtaatgccccgtagcgatatggtcaaaacccagcagctttgcacgctcatagaattttgcgaatttcagatgtttgttgcactcgatacacggattaggcgtgccgcctgccagatatgtatcaacaaaattgtctataacatagtgcttaaaatcatcagaaaaattgaatacatggaaatcaatgcctagtttaaaagcaacaaaacgtgcgtcctctacatcattgagagaacagcacgttcttgttttatccagaccgatgtcctcattgctgtagagccgcatggtagcccctgccacgtcataaccttcatcaagaaggagcttgaccgaaacagagctgtcaacgccgccgctcattgccacaagaactttatcagccattgcagttctcacaatcaggagcagactgcttacctacgaacggagttggatctataccctgtcttttatagtagtcagaaacagcggctttcattgcttcctccgcaagaacagagcagtgaagctttgctggtggaagaccgtcaagagcttcaacaaccgccttgtttgtaagtttcaaagcgtcttcaagctttttaccctttatcatttctgtagcgatagaagatgtagcaacagccgcaccgcaaccaaaagtcttgaacttaacgtcagttataacgccgtcattgaccttgatgtacattttcattatatctccgcacttagcgtttcctacctcgccgacaccgtcagcatcctcaatctcgccgacatttctcggatgcgcgaaatgatccattaccttttcgctgtatatcatttttttattcctcctaatcaagtgtatagtcgtgaatattctcagttctgcaaattctttcccaaagtggtgacatacttctcaggtgctttacgataggtggaagaacctcaagaatataatcaacatcttcctctgtgttctcgtcattgatagaaagtctgagtgagccatgtgctacttcgtgtggcagaccaagtgaaagcagaacgtgtgacgggtcaagtgatccgcttgtgcaggctgagcctgatgaagctgcaacgccctgaaggtcaagtgaaagcagcaggctctcgccctctactccacgaacagatatgtttacatttcctgcaagtctgtgttctgtgtcaccattgagccttgactcaggtatcttgagcagaccctcgataagtctatctctcatctttctaacacgctcgttctttgcagggatatcctttacagcatcagtgatagcaacgccgagagccacgatagaaggtacgttctcggtacctgcacgcttatttctctcctgtgctccaccgtagataaggttaggaaggttaatgcctgtttttacataaagcgcgccaacaccctttggagcgtggagcttatgtcctgaaagtgagagcatatcaatgttcatatctttaacattgatatcaatatttcccacagcttgaacagcgtcagtatggaaccatacgccatgcttgtggcaaacttcgccgatctcagcgataggctgtatagtaccgatctcgttgttagctgtcattattgtaacaaggcaggtatcatcacggatagcgtcctcgacctgttgtgcagtaacaagacccttgtcacctacaggaagatatgttacctcaaagccaagcttttcgagatactgacaagtgtgcagaactgcatgatgttcaaatgcagttgtgatgatatgcttcttgccttttttttctccaagctgtgcacagcctcttatagcccagttgtcagactcagagccgccagcagtgaaatagatctcgttgaccttcgcaccaagagcgtttgcgacctgttctcttgctttaagaacggcttttgcacattccattcccaaagaatatatacttgacggatttccgtatagctcagtgaaataaggcagagcggcgtcaagagctttctgagatactctagtcgtagctgagttatctgcatagacaaatctcttttccaattaaatcatacctttcatatatagatttactattttattatatacttatttactacaaaatgcaagtgatttcgttaatttaacagaaatttaacttctactgaatttctttgagcccatgactgcaagttcgtcacaacgttcgttttccggatgtcctgcatggccttttacccagttgaaattgaccttatgcacctccagcagatcaagaagcttttcccacagatcactgtttagagcctttttcttgtccgatttcacccagttgtttgcacgccatttttttgcccagccttttgtaacagcgtcgattatatactttgagtcgctgtaaagctctacctcacatggctctttcagtgctgaaagagcagtgataacagcggtaagctccatgcggttattggttgtagagggatcaccgccccaaagctcttttgaattgcctttatatcttagtataacaccgtatccacccggtccaggatttccagagcaagcaccgtcagtgaaaatttctattttcttcatttaattatctccgtttttgtgatgattattatgcaaaatatattatactacatttctctctttttttcaagtacctctcaaggtttaatattttaatatttattacttttgaaatgttcaaattatacaaatgacttgaatgtctttgtataaaatgagaattgacttaaaggacattaagctttataattgtagtgtaacattggttgttaagacagaaaatcatttgatttggaggtcaattattttatgaagatcaagaagattcttgcattggcagtagcgcttacatctgtttttgcagttgcaggttgcggctccacaggcgacagcagttcaaaggtatcaacagtaaagaaagttaaggttgaggacacacaggaaatagaggctatccctgacgacgctcagaaaactatccgttggatgggtacatatgaccttaatcctaacgagaaaaagggcgaggataagtccgttgagatgacccttttcaacaacaagggtggcaaagtagagtacacaagagtaactgacagcgaaaaatttgaccagctcgccagtgctatcatggctcagcagaatgtgcctgatattttcaagtatgagtggatggctttccctgcacaggtgcttaaggatatgtatcagcctgttgacgatattgtgaactttgacgatccgctgtgggctgatgtgaaaacaactgctgacaagttcgttatgggcggcaagcattatgttgctcctataagcttcacagtcggcacacttatgatgtatgatcaggacgttatcgacgctgagggtcttgatgatccatatgagctatatcagaatggtgagtggaattgggataactggtatgacatgatgtcggagtttgtttcaaatgctcctgctgatgttgagagatttggtatcaatggttggttccagacacaggtcattcagcagaccggtaaaacaatggtaaactatgacggagagaagttcacaaacaatataaatgaccctgatatcgaaagagcagaagatctgctttatcaggtaggtaagaacaaccttgtaaacggcaactggcttggcaatgctaagcaggcgcttaaagacggcaatctgctgttctactgcatgggtacatgggctatgacaggaaataacggaccttctgacgctgacacttggagagtggtccctgttccgtctgatcctaacactgatgaaaagtacatgacatctgatatgacggcatatatgtgggtaagaggctcaacagctaaagaggctgtaaagtgttggtatgagtgctgcagaatggctaatacagacgaaacatataaggaaaacggcaaggagaaattcctcaacgctaaccctaactggacagaggatatgtatcaggtgatcgttgactgctcatcttctgagtacaatcaggtgtttgactacggctacggaatttcttccacaatgtctgacgacaatgcaaacgaagacggcaactgcgtaacaagaaagctttatgaatacacaaataaggctgacgaaaacggcaaacagttctcatggacagagctgagagaatcatacgccgcaactgttgacgctgagcttaagactatcaacgacgctgttgttgcattcaacaagaaaaattcataagaatactttacaagacctcgataaaatcggggtcttgtttttgcataaaaataaggctctgagtttttgctcagagcctttgctattgttatgtttagttgtccatgcactcacgaacagatttgataaacttgcccacatattcaggagcgtctttgccgtgttcctcaactatcttgacaacagcacttcccatgataacgccgtcagcgtactgggacattttctttgcctgctcaggatttgaaatgccgaagccaatacagcaaggacagtggttttcatttctgataggcgcaagaagctcattgaagtctgttgttatctcagagcgcatacctgtaacgccaagtgaagataccacatacagaaagccttttgacttttctgctatcatctttacacgctcgtgtgaagttggtgcaacgaggaatatagtgtagataccatttttctcagcttcgccctgaagctcttcacgttcctcaaaaggcatatctggaacgataacgccgtctatctgagtttccttgcaaagctcaaagaactttgctgtgccgaacttgaagatagtgtttatatacatcatcaaaagcataggcttgtcagtctgtgtgcggagctttctcacaaggtcaaatatcttgtcaagatttgttccaccactgagtgaacgcagagaagctttctgaatagtcgcaccctctgcgatagggtctgagaacggcacgcctatctcgataatgtcagagccgttcttatacatttcaagaacgcacttttctgttgtatccatatcagggtcacctgcggtgataaatgtcacaagcgcctttttgttttctgctttgagtttttcaaaacaagcgtctatcctattcttcattaaggtctacctccctgtatcttgctattgagtatacgtccttgtcgcctctgcctgaaaggttgatgacaagtattgagtccttatccattgtaggagcaatcttaagcgcagcggcaacagcgtgtgatgactcgatagcagggattataccctctgttcttgaaaggtactcaaaagcacaaactgcttcttcatcggttatgtcaacatactgcgctctgcctatagagttaagatatgcgtgctcaggtccgatacctgggtagtcaagacctgcggaaatcgagtaaacagggtcgatctgaccatattcgttctgcaagaaaagcgatttcatgccgtggaatataccaagtgagccttttgcaactgtagccgcatggtcaggtgtgtcaacacctctgcctgctgcttctgcaccaacaagcttgactgacttgtcttcgataaagttgtagaatgcacccatagcgtttgagccaccgcctacgcaggcaacaacgcaatcaggtagtctgccttccttttccataagctgtgcctttatctcagcactgataactttctggaaatccctaaccattgtaggataagggtgaggtcccattacagagcctatgcagtagaaagttgtgtcgatatttgatacccaatctctgaaagcttcattgatagcgtctttcagtgtagcagtaccgcttgcaacgcctgttacctttgcaccaagaagattcattctgtaaacgttaagggattgtcttttcatatcggtctcgcccatgtagacctcacattccagacccataagagcgcaaactgtagcggtagcaacaccgtgctgacctgcaccagtctcagcgattatgcgcttcttgcccattttctttgccagaagtatctgacccaaaacgttgtttatcttgtgtgagcctgtgtggttaagatcctcacgtttgatgtatattttagctccgccaagatctttggtcatcttttctgcataataaagcattgacggtctgcctgcataattgtggtaaagctcctgaagctccttgttgaactcaggatcgtccttgtatttatcgtaagctttttcaagctcgtgaacagcagtcatgacagtttcaggaatatattgtccgccaaattcgccaaatcgtccaattttactcatttatatccttctttcggtattatttctgatagtttcaactatcctttttatcttgttttcgtccttaaagccatcggtttccactgaacttgaaaagtcaacgccataaggttgtaccttttccatagcatagcagatgttatcctcgttcagtccacctgcaaggaaaaacggctttgatatgtttacctgtgaaaatatatcaaggtcaacacacttgccagttccgccgtaactgcctgctgaaaagctgtctataagcagtttgtggacgggaagtgcatcagcttttgcaatatcatcagcatatttcacacgaacggctttccatatctcacagtcgcagttttcacggagcttatcaatatactctgcgttttcctcaccgtgaagctggataacatcaagcttctgtgcaaagcttttcagaatattctctataggctcgtttacaaaaacgcccactcgtttgatttccttattaagaagaagttctagatcgtagaatgtgtcaatgtctaccgtgcgtttaaaaccctccgacagtataaagcctgcataatcagggtggtatgtgttcacataaagaatatcgtccacacggcgcataccacatatcttgatttttgtcatttatacgccctctctcagttcatggagagttgtaccgatattgccgcttctcataagcgtttcacctataagcacagcgtctgcaccaaggctgcgtacctttttcatatcggcatttgtttttataccgctttcagaaacgagcactgcatggtcgcctactatattgctgagcctgcctgtggtttcaaggtcaacgtcaaaagtgtaaagatttctgttgtttatgccaagcatatcaggcttaaaaccaagcgtctttttatattcttcctcgttgtgcacctctacaagacattcaagtccaagctcgtgtgcaatgtcagaatattctttcatctgaccctcgctgagtatagccgagataagcagcactgcatcagcacctaaggctcttgcctcgtagagctgatattcgtcgataacgaagtccttgcggagtatcggcagctttacagcctctcttatagctttgagatattccgcagagccttgaaaatagtgctcttcagtgagacaggaaatagcattcgcaccgtttttctcatactcgcaggcgattttcactgggtcaaaatcagggcagataagtccctttgacggcgaggctttctttacctcgcttatgacagagagggtatcacgcttgatagattttgaaaaggaaactgtctgatactctttttcggctgccatagcttttatatcctgtcttgaaacttttgatatatctctttcaagctgttcttttcttttgtcgcagatattgtctagtatcattttttatcctctgttagtaagttcaacaagttcttcaagctttttaagagcctttccgctgtctatcatttcagctgcagtctttacgccctcttcgatgctgtcgcatttgtcgcagatataaagtgcacagcctgagttgagaagaacgatatctctctttgcacccttgatagtgccatcgagtatacctcttgtgataatggcattgccctttccgtcctcgccaacgatgtcagcaagcttgcctcttttaagaccgaagtcctcaggctttatctcatacttgataagctttccaccatttatctcgcaaatagttgtaggagctgatatagaaacttcgtcaagtctgtcgttgccgtaaacgagcattgctctctttatgccaagattcataagcaccttagccattggttcaagcagatcagggtcatatgtgccaagtatcatgaagtctgcttttgcaggatttgcgagaggtccgagaatgttgaaaacagttcttacacctatctgcgctcttgtaggtcctacaaatctcattgctgagtgatatgactgtgcaaacaggaatgaaagaccgatctcgtcaagggacttttcagcctgctcatgtgttgactgaattttaactccaagagcctcgagaacatcagccgcaccgctctttgaagaaacgcttctgttgccgtgttttgcgactttctgtcctgctgccgcaattacgaatgaagaggttgtggaaatgttgaagctgtttgaaagatctccacctgtgccaactatatcaagagtacccttgacattgacttttgacattttttctctcattacctttgcaaagcctgttatctcgtcaatagtctcacctttcattctcagagctgtgagcaggcaggcgatctgagcattagaagctctgtcgctcatgatgatatccattgctttataagcttcgtcctcagttagtgactttccatcacatactattttgagatactttttaagctcaactctttcgctgtcaggaagagctgcagactttgtttttgtggtctttatgcctgcgatatcgttcaggaagttttcgattatcatgtttccaacttcgccagtgagaactgactcagggtggaactgaacgccataggttgggtgttctctgtgtcttattgccattatctgagctttatcgtcagttgcaataacagacaggcaggtaggaagtgaaatactgtcaacaacaagtgagtgatatcttgcggcttttattgtgcttttcagaccgctgaaaagtgggtttgcagtgttaagattgatatctgtctgcttgccgtgaagctgctgctttgcatgaactatctttccaccgaatgcttcggctatcgcctggtgtcctagacaaacgccaagtatagggatcctgccactgaatgtctttatgacctcttcggaaattcctgcgtcctttggataaccaggaccaggggagatgatgatagccgcaggtgacattttttcgatctcatctatggttatctcatcatttcttgctactgtaatgtcttttgtgagtacgcctacagcctgataaagattgtaggtaaagctgtcatagttgtcaataagtaaaatcatagtaatcttcctttacagtacaaacttatcaatgaaagttttgtcgttgaagtagtttatgccgatagcattccttatttctgaaacagtttcgtttgaaacctctattgcacgttgtgtgccttttttaagtatctctatgagctgctctttgtctttctcatattcctctcgtcttgctctgataggtgcgagaaattcttgcataacgttgttaagaaacttcttacatttcatatcgccaaggccgccacgctcataatgttctttcatctctgcgaggttcttatagtcagggaagtatttagcaaaatcttcatccttgctgaatgcgtcaagatagataaataccggattgccctctgtgtgaccggggtcgcttacattgatgtgtgtagggtcagtgtacattgacattatcttgtttttcagcgttttttcatcgtctttaaggtaaatgcagttgccaagagatttgctcatctttgtgttgccgtctgtaccaacaagtctgttgcagcttgcgttgtctgggagaacagcctcaggctcaacaagtatatcgcacttataaattctgttgaagctgtttactatctctcttgcttgttcaagcattggaagctgatcttctccaacaggaacatacttagccttgaatgctgtgatgtctgctgcttggctgataggatatgtcataaagccaacaggaaggtttctttcaaagtttctcatttttatctcagacttgatagtagggtttctttcaagtcttgacattgtaactaggtttgaatagtacattggaagctcataaagtgctggtatatgtgactgaacgaagaatgttgtcttgtcaggctcaagtcctacagcaagatagtcaagcattacctcaagaatgttttgtcttatcttctcaggattgtcagcgttatctgtaagtgcctgaagatcggctatcataacgaattgatcaaattttcctgtgttttgaagttcaactctttttctgagagaacctacataatggccaagatgaagtgatcctgttggtctgtcgcctgtaagaataatattattgctcatgttatttatctccttaaaaattataatttacttgcttcttttattgcatttataacagccattgccttgttgcatgactcctgatattcgttctcaggaactgagtctgcaacaactccgcctcctgcttggatataagccttgttatttttgaaaagcactgttcttatagcgatacaagtatccagcgaaccgtcaaatgcaagataaccaactgttccgccataaaggcctctttttgttgtttcaagctcgtcgattatctccattgctcttaccttcggtgcgcctgaaagagtgccggcaggaagaactgccataagtgcgtcaagaggtttcttatcttctctcagtgtaccctttacattcgatacaaggtgcatcacctttgaatatctttcaactatcatcatatctgtaacagttacggagccgaactcagaaacctttcctatgtcgtttcttccaaggtcaacgagcattgtgtgttcagctctttcctttggatcgttgagaagctgttgttcattgtggatatcttcgtcgtaggtcgctccacgcttgatagtgcctgcaattggtcttgttactactgttctgttttctactgataccagcatttcaggtgaagcgcctgcaacagcataatcattgtgcttaaagtagtaaaggtaaggtgacggattagtggagcggagcattctgtaaacgtcaaagctgtctggcggattgtctatctcaaatctctgtgacggaactatctggaagatgtcgccctctttgatgtattccttagccttttcaacgtttgcgagataatgttcttttgtgatgttggattttactgtgatgttgtcctccattgtctttggagttttcataacaggcttgtaatttctaagagtttcaactacttcgttgcatatcttttcacattctttgtatttagtttcaagatcatcgctcttattgatgttgaggattattacagctttgtttgaaaggtgatcgtaagcaacgatcttttcaaaaaggtgcaggtcagcgtcaggaagcttaagatcgtcctcaggtgggttgcacagtgttttctcaaagtatcttatcatatcataagcgaaaaatcctattagaccacctgtgagctttggataattattaaatctcggtgacttgtggccttcgattatctcagaaaagaaagcgataggatcatcgacttttaccgtttcatcagccttgcctttttctttgacagtaacaacgtgcttgtcaagaatatattcgcatttaggatcaatgcccacatatgaatatctgccccactggtctttattatctacagattcaagaatgaaacaatcatcatacgcctcgtgcagacagttaaaaagttgtattggcgtacatgaatccatgagaagctcatagaatacaggcacagtcttgtagttttcaaaaagttcctttacttgttcaatagcagggtacagcataaatattcctcctaaatgcttttttgtcgtaaaattgacaataaaaaaagtcctgtcatcacacataacatctagttatgggacgatagaaccgtggtgccacccaatttcccgataataaattatcggctcacagatacgcattctgactggcagaaatcaatatcctgtcctttaacgcaggaatcacggcgagtgatactcgtaaaaactttcacaccgctcctcacaaatccattcatctgaagaaaatgtatcagctcacacctaccgctgactctctgtgaccttttgcatcaaactacttacttttgctcataggatttatcgtattaactttagttttattatattcctatgtttctaaaatgtcaatatcagaaaatgtaaatattattgctattgtgtaaatattcttttgcgatttggatttataccaaaataaataattttaaattttcaatattccttgcatttataaataatgtagtgtataataaagtaatagttaaagtaattgagaaaggaaaatatatgaaagtacaaactaataagaaatacaccacgattgcattttatgcagttatcgttattgctataaatgtgcttttggtagtggctgtatttaaatttaatacgatcttaaagcttatttccacacttgtttctgcacttacgcctgttatagttggtcttgtgatcgcatttcttataaatcctataatggtgaattttgaaaagctgttcagaaataaagtggtaaaaaatccagctaagaaaaagcttaccagagcctgctcagtaactgtagcgtcacttgtttttctggggatagttgttggacttacttatgttgttgttccagaacttataaattccataattgatatttttaacaatgcgtctaacatcgttgttaaagtgcagggttggataaataagctgtttaaaaactatcctgatatcgaaacaatggctacggagaaactcaaagctttttcaactgatttgggaaccgttatcgagaagatacagccgatgtttgaaaatattctttcgggtgcatggggcgttatcaatgttcttaaaaactttgtatttggatttatcgtttctatctatatgctttgcagcaaggaaaagcttcttgctcaggctaagaagataatcattgcaaacacaaaaaagtctacatgtgagaagattatgagagtttgcactgaaacaaataaagtttttgcaggttttttgagcggaaagatcattgactcggcaataatcggagttctttgctttataggtctgactatcatgaatatgccttacaacatcatgataagtgttctagtgggtgtaactaatattatcccattttttgggccgataatcggtgcgataccatcaactgcacttatgctttttattgatcctaaaaaagccattatacttctcattttcatagttattctacagcagtttgacggcaatatccttggtcctaagatacttggtgattctactgggcttccgggtttttgggtgctggtatcactgttcttctttggaaatttgtttggtttcataggtatggtcattgcagttccgacttttgcattgctttatacttttacacgagagagcgttgttcagcggttaagaaagaagaagctccctgtagataccgactattatatggaggatgttgagcatttgtataagaaaaatgaaaagcgtattccgcttacgcctgaacagcttgacgccatggtcatcccaagtgctgatgaggtaaatgaggtcaacagagaggatgatccagaaatagttgacgatcacaacgaaaataaagatcagtaaacgcaaaagagcggcctgttcacacttcatagtgagcagaccgcttattttatttcatgtattttttctgtatttttgcaatatgtatcacagagtatattactataagtgcaataagtattgttaatgtgaccttgaaaacagacgattcaaagtatgacttagctatcttaaccttcgctttgacttgagaacgttctactttagttgtggaaacgagatctatagttgcaagcacctcacctttgtagacaagttccattttaccaagcacatcgccaacttcaacaggtgcaacaacgttgtcataaacggttattttcttttctacatcatttactgatatatctacaggccacagccttgtaaaaccatttgcaggtttaagatttgcataatctatgccgtcaccatagcttacctttacatcacggacttcgctgtctttgtccacaaaatccgttgctacaagacttgaaaatgcccatttgtaaagattgatgtgatcaaggaggttgtagtaaacattatctccaccatatatggaatcaggatcttcctcgcccttcttcacatcttcttcaagcttatccattggtgcacccattgtcacaataagatatgtggtgccttcatattccgcatatgaagctaaacatcttccagcggagtcaagggtgcctgtctttatgcctttagcataggagtagtaataatcggtcattgagtcaagcataaggtttgtattataaatatctgtaccatctgagtgataagaggtggatgccatatgatagcttggcagacagacaatatcacgaaatacctgatatttgcttatggcatattcacaaagagttgccatatccttgcaggacgaataattctgttgcgcccacagaccatgtgcatttgaaaagtgtgtattttccatgccgagtttttcagctttttcattcataaggtctgtaaattctgttatggaatcggacacattcaaagcgattatattcgctgcttcacatgaggatgggataagcagtgccgccaggagatcataacagcttacttcttcgcctggttgtatatcagctgttgaagcaccagtatcatatagttcatcaaatgcttccgagcctgctgaatagtatgtatctttcagtttttgttcatcacctttgaatttgtctagaagcaccacagcagtcattatctttgttagggaagcaggcacgcgctcgtcctcaccgtttatgtcaacgatagcttcaccgctgtcaagattgaccatatagaccgcttcagagtaaagctccaacggtatcgcttttccgtcatcgtcatagcctgatgtaggtgtaaaattgaatgcgtctgcacacatcgcaggcacaagcatcattattgccagcgtcatggataatatcctgctgatttttcgttttagtttcattgacagcttcctttcgcactgtatgtaaagagccttgctcattcagttttctcataaagtatattagcaccctgtttgcccacacgtttcactctttcaagatatgtgagtatattaagcgttacctgtgcatattcacgagatatctttgcattaagtgcaaagtctttagaagtgaactgctttggcaggtcctccgggaggaacatatcaaagtcggcagggcagtcaaggtgtatctcgtcaataagtccctttggtatcctgtcatgacgtgaagatccacgctttttgttctttgaccagccgttaagcaatcttatctcctcggtttcaagcatacaaaggcacaaatgaaatcgggggttatcaagggtgtattttattttgtacagttcgggcatgacttcatagatagtgtattttctcggcgatttgtgcttttctgacaactctcctgtttcagtatctatccaacggacatatttgaccgcagggatagggtagaccactgtcacgtcgcagtagtcaagaaaggcttcaagttttttcagcagtttgttgaactgtcttgtttgtatctcgataacaccgttctcgcctacgatatcagccacatatcctccaatgcgtatctcctgattttcgccatatggctcaaaatagtttttcaaaacagcatgaagcgttttctcgcctagagttccgatgccgttgcgttcacggcttttacctatgattttatcgcaagcatcttgaaatttcagcctgtccgtaagatcacctcagtttttattatatcagatattcactctcacgtcaatcacaaaaacgcataaaaagagcctgagatctgctcaggctctttaatcataccatgatccatcaggttatgctgtccgcagttatcttgtcccactggtcgcaatacttgacttccattttgtccattctttcgttgtaaagctttgagatagcaggtgtatcatatgaatagatcatatcgtctatgttctgttctacataatccatatcaaccggcaaacgcttgattatgaaatatccatatgtgtcattctctgtaagttcagtggaaatgtcgttttcttttagtttgaaagcgtcttttacaagctcctcaggatatccagtcgtatctttattgaaataatatcctgttgaaggatcttcaagaccgagatcccagccgtacttttcaataagcttgtcaaagtcttctccgtcctgagcttttttcagaacttcttctgcaagcttcttagccttttccttagctttctttacaccgtcatcatcaagcttcgcataagctgactgctttgcgctcgctttgtctgaaagtgacatactgtcataactgtcagcggtactgtcatcaagatctacctgtgcatagaaagggatcataacgtgaatctcacggcaatactcgtttgtatccttgactatttttttaaagtcctcttttttagttgcatacttaccgttattcttaaaaagagtatcgtttactttagtatagatagcggctgtttcaagcattttcctgtaaagatcctctgtgaggtaagccgacttaatgtcattaagataagcttcatcagaatcatagtttgcttttgctttagctatctggtcatcaattgtcttgttgtcatcgtctgtaagtttaattccgttttcttctgcaagctcaggtgcaacaagttcctgcttaagtgcagtgataacgtcctccataagaagcttaaaaccaccgtcagttgacttgatagtgtcaagggttgctccgtaagtggaagtgtacttgcttatagtataataataatagtatctgaaagtatcaaaatcaatatccttgccgtcaatggtgcaaacgataaagtccttagtatcaatggacttgccgtcaattgtaagggacggctcaggtgtctgtttttcagttgtgctgtcaacagctgaaacagaagaatccactgtggaagatacggttgatgagctgtcgttatttttgctgcatgaagtaaagctgcaaatagctattgtgagagctgctgtaacagcggctaatttctttatcataataattgtcctttcctttgagagaaaatcctctgcataacataaatttaattatatcttattattgtgatgatactgtgtgataattcttaaactttctgtgaatgaaatatatattatccagcgtgatacagttgacaatctaagcctgggagagtataatataaatgactttaatacgaaaagaggtatcccatatggattttggcaaatatattgctcacagaggtcttcactcagaacttgttcctgaaaattctcttaccgcattcaggcttgcggttgaaaaatgtctttctatcgagcttgatgtacgtctaacaaaggattgccgcattgtggttttccatgacaatgaccttatgagaatgtgcggcattgagggcaaggtgtttgattacacatatgaacagctttctgcctttaaacttaaaaacagtgatgaaaagataccactgttgtcagaggtgctgaaaactgttgacggcaaagtgccacttcttattgagcttaaaggcggtgcgccattcggtgagcttgaaagccgagttgaccatatgatgaagaaatacaaaggcgaatttgcagtgcagagctttaacccgttctcagtgatgtggtttaggtttcattcacctaaagtcacaaggggtcagcttatctcaaaatacagaaagaatatagaccttgaatatatcgaaaggttcatttgtgctcagccgtttatatggcgttttatatcaaaaccgcagttcattgcagctgaccttaggtcaataagccttgaaactgcatttcaggccgttgatatagatgcagacttgctcacatggacgggaagaggcaaagagcttatagaaactgcttcacagttttcaaagacagttatagcagagcagtttcctgatgattttgatttttctgacaattgggaggaaagctgtgaataagatgcaagaccttccattgtgcgaccttaacgaagtcaaacgtactgcaaaacgcactgacagcgatatttcaggctgtaaatttagcggagaatatcttgaaagcgaagatctctcctgcctgtcatttataaactgtatgtttgaaaactgcacctttaccgattgcgattttgagcgttcctcattcgttgatgtgacgttcatatcctgcgatctgtcaaattcatcactggactcatcctacctcagcagatgtgagttccgctcctgcaagctcgttggcgcagagttcaaggattgctccattcaaggtgtagcctttgaatcctcaaactgcggatatgccatatttgataaatgcaagctgtctgaaatccaggtgaaaaacagtgatatgtcctccgctgagcttgtttcctgcaatttaaaagcgtttaagacaagcggaagtaaatatctcggcacatcatttttcagaacggctctcggcggcgttgatttttctacctgtcttgtaagtggactgcgcgtatctgatacattcagagaactccgaaacgctgttttttcagccaatcaagctgtggagctttcaatgctccttggaataagaataaaataattttagccgctatgacaataaacgtcacagcggctttttatcactttttatcctgttctatcagtattttcacagcgttcaccgcacagtggatacctcttgtggtgtcgtcgctcacattgtcttcaaggtctgcctttgaacgctccacgttccatatagctgttataacagctccacagcggacgtgtcttgtgatacctactgagaaaactgcggcacattccatttcggaagtcatacagccgcaccttaaatatgcgtcccagcggtaatttatgtcgccgctcacaggcattgagtcaggctctacttctccataaaagctgtctttgctgtggacaacgcccacatgataacgcttgccaagcttatcttctgacagtgccgcagctgcctttgctagtgcagttgtgaccgtgaaatctgccacagcagggtagccctcggggagatattcttttgacgtaccttcgccacgaacagccgccgaagctataacaaggtcgccaccgctaacggaaagatccattcctccgcttgtaccgatacgaataaatgtgtctgcgccgcattttaccagttcctccactgcaattgccgcagatggtcctccgataccggtcgagcacacagttaccttttcgccgtcaagatagcctgtataaacattgtattctctgttttgagccacctgctttgcgtcatcaagaagtgccgctatttttggcactcttccagggtcgcccggcattataacatatctgcccacttcttcagggatagttcttatgtgaaattgtctttcaccgtccataatgcttgccataaaaattcctcctctcagaattattcgtcgtatggataattattttcttcgtataattcattttctgcaaaattttttccggatttctgctttttctttatatgtataagcactatgataagcactattgctatagtcgcaaacagcccgcctaatccacagaaaacaactgttaatatggtattggttgtatcatttggtgcataaaacgtttcagggtcgtcagggtcacagaatatctggatcgtttgtcctcttctgtatctgatgttgctggaatatgtattgctgtgagtggtgtagagctgtccgtcaacgttatatgaatacactggtgtgtaaactgtgctatatgatacgtgtccgtcatcgttctcgtgtcgttcatctttgctgagaatatctgatattatagcattgacttcaagagtacatctgtttttgagctgagtttggtgtattgcaaaacctattccaactgcaagaaatgtcacgccaaccaacatgaaaactaacgctattattttcattgctgatttgctgtaatgcacatgagatcttttgtaataacgcatatttttcccccatttaagcataaaagccaacaccttaatatggcgttggcttttgttttatcttacttttccattttcattgaaatgtcaaacgccttgactgagtgtgtgatagcaccgatagaaatgatatcaacgcccgtttcagctattgcacggattgtttcagaagtcacgtttcctgaagcttctaaaagtgctttgccatttgtcatttcaacagcctttgccatatcttcatttgtcatattgtcaagcatgattatctcaacgccaagtgtaagagcttctttgagttcttcaaggtttccgacttcaacttctatcttgacagtatgccccattttttctctgagagcgtttaccgcaccagtcatgctgccatatgcgtcaaggtgagtgtcttttagcatagcgcaatctgaaagattgtatctgtggttttttccaccgcctactgtaactgcatatttctgcaaaactctaagacctgggagcgtttttcttgtatccgcaacagatgcctttgtaccctttacaagctcaacgcatctgtttgttgcagttgcaacgcctgacatatgctgaacgatattcagtgccgttctttcgcctttgagcaaggctcttgttgagcctgttatttttgcgataatgtcgcctttcttgaccttttcaccgtcatggataaatatctcacatttaacattgctgtcaagaagctgaaaaactctcattgcaacatcaattccacaaagaacgccttcgtcctttgaaacatactttgctgtagaaactgaattttcgtcaacaagataatctgtcgtaacgtctatatagttgatatcctccagcagagctgttttaatgatatcgtcgatctgaaactgcattaatctcatttgttttcctccattttttctttggatttgagcttttcgatagcgtcctttaatacgatataagcgacagttgtaagagaccttgcttcaacataatctctgtctattttgaaattaccgtcacaaaggaaattttttagctttgtgacttcttcaagatcaggcggcaaagcctccttatcagggataacgaaatatgcacgctgcattatatctcttatctctgttcttatgccctgaggaatgtgcggggcttcattgtctatcttgaaatcgtatgtttcaaggtcaccactgtcagagtttatcttctcattgatgtcagccgcagcacgtcttgaaaataccaaagcttcaagtagggaattgcttgcaagtctgttattgccgtgaacacctgtatgtgaacattcgccgcaggcataaagcctatcaatgttagttcttgcatatgtatcaacatttatgccgcccataaggtaatgatgacaagggaaaataggtatcatatccttggtcatgtcataacctgcttcgagaagcttttcatttatcataggaaatctgtttctgacaaactcagggtctttgtgagtgatatcaagatagaatttgtcagagcctgttttcttggcttcagccatgatcgcatgagaaacaacatctcttggcgcaagctccagacgatcgtcatagttttgcataaatctttcgccgttgcagtttttaagataagctccctcgcctctgacagattcagatataaggaaagtttcacgagtgtgcttgttgttaaagcctgttgggtggaactggatatagctgaggttttttatctctgctccaagctcatgagcaatagttatgccgtcgcctgttgcgatagcggagtttgtagtgtattcgtaaactctgcctattccaccagttgcaaaaatggcgtatctgcaattatatgtcgtatattcgttgtcattagtcagcacaagaatggaaaaacctgtttcggttttctttgcgttgcacataacggcattttcgagtatttcaacattatctagctgttgaacatttcttagtagagttgtttcgatctccagacctgtggtatcggcatgatgaaaaatcctgttcataccgtgtccaccttcgagagtgcggtgataagatccatcaggacacttatcaaagtcagcaccaagctctatgagtttttcaatgtcaatataggcttcgtcaacaaggacctgagtggactcaggatcattttcaaatccgcctgctacaaatgtatcatgtttgtgatattcaggcgagtcctttggattgtcataaacgcctgcaattccaccctgagcaagggaagagttacacaaggtcagctctcttttggaaagcacaagtacatttaaatcacgggaaaggttaagtgccgcatatagacctgccgcaccgcagccagcgataataacgtcataatttttgttgttcatatttgtaacctctttgtatggcggagtgtcgccaagtgttatgtaaaatcacaccagatattgctctgaaataatttatacttattctattataccatatatttttttctttttcaactgttatttgaatatataatacacataccttacattattttaagtgcaacttaacaaaaaaatgactgcctgctcccgaaagggaacaggcagtcggaggtttattatagatcaactaataatcaaatattagtcactctgcaaattgctttgtcagcaaagattatttgccgtagtaagccttgaggtacatttccttaagctcgctcatcagtgggtatcttgggttagcacctgtgcactggtcatcaaatgcgtcctcaaccatgttgtcgagagtgtcaaggaagtgcttctcgtctacgccgtaatcagcgatagtcttcttgataccaactctttccttgagtgcctcgatagcgtcgatgaacttgttgagtgtatcctcatcgttcttaccaacgataccaagtgaatgtgcacactcgcagtatctctcaagagtatgtggatactgatactgtgagaaagtacccatctttctaggtgttgggtcagcgttgtatctcattaccattgtgataaggagagcgttagcaatgccgtgtggcaggtgatgataagcaccgagcttatgagccattgagtggcaaacaccgaggaatgcgttagcgaatgccataccagccattgtagatgctgtagccatttcctcacgagccttaacgtctgtctgaccgttgtcatatgcacctggcagatacttgaagataagcttcatagctctcagtgcaagaccgtcagtgtaatctgtagccattacagatgcataagcctcaagagcgtgtgtcagagcgtcaatacctgatgcagaagtcagacctcttggagctgacatcatcatatctgtatcaacgatagccatgttaggcatgagctggtagtcagccagaggatacttagtacctgtcttttcatcagtgataactgcgaatggtgtaacctcagaacctgtaccagaagatgttgggatagcaatgaagtatgccttctcacccatcttagggaatgtgtaaactctcttacggatatcgatatatctcatagccatatcgaagaagtcagcgtctggatgctcgtaaagaacccacatgatcttaccagcgtccattgcagaaccaccgccgatagcgataattgtgtcaggctcgaaagctctcaactgagcaacaccctcaagtgcacaagcaagtgttgggtctggagcaacatcgaagaatgtttcgtggagaatacccatttcatcgagtttatctgtgatagcctttgtataaccattcttataaaggaactggtctgttacgatgaatgcctttttcttgcccataacagtcttcaactcgtcaagagcaacagggagacaacccttcttgaagtataccttttcaggtgctctgaaccaaagcatattctctctcctctcaacgactgtcttaatgttcagcaggtgcttaacgccaacgttctcagaaactgagttgccgccccatgagccgcagccgagtgtgagggaaggagcaaagtcaaagttgtagaggtcaccgataccgccgagtgaagaaggtgtgtttacgataagacggcaagtcttcattcttgcagcgaacttattgagcttttctctctcgtttatgttatctacccaaagaactgaagtatgaccaagaccaccgttgtttacgagaagtgcctctgcgatgtcaagagcgtcgtcaaagttctttgacttgtacataccaaggatagttgtgagcttttcgtgaccgaaagcctcttctggagctgtgcttgtagcttcaccaataagaacctttgtatcctctggaacttcaaagccagccattttagcgatagttacaggacgctgaccaacgatcttagcattaagagcaccgttgatgagcattgtctttctgatcttgtcagcctcttcatcattaaggaagtagcaacctctcttaatgaattccttcttaacatcgttgtaaaccgtcttatcagcgataactgtctgctctgtagcacagatcataccgttatcaaatgtcttagaatgaatgatagagtttacagcgtttacgatatcagcagaagaatcaataatagctgatgcgttaccagcaccaacaccgagagctggtgtaccagatgaataagcagcctttaccattccaggaccgcctgtagcgaggattgtgtcagactctctcattatcatatttgtgagttcaagagaaggaacgtcgatccaaccgatgataccctttggagcacctgctgcaacagctgcatcataaacgatcttagcagcagcgatagttgacttctttgctcttgggtgtggtgagattatgataccatttcttgtcttaagacagataagtgtcttgaatatagcagtagaagttgggtttgttgttgggataacagcagcgataagaccgataggctcgtaaattctcattgtgccgtaagccttattttcctcaaaaacaccacaagtttgaatattcttgtacttattgtagatgtgctcagcagcatagttgttcttgataaccttgtcttcaacgatacccatgcctgtttcctcaacagccatctttgcaagtgggattcttgccttgttagcagcgatagcagcagccttgaaaatcttatctacctgctcctgtgtgtaggtagcgaagattgcctgtgcagctcttacttcagcgatcttagcagtcagagcttcctctgtatcgacgatgccgactgttttagcttcactctttgccataaaataaacctccaataaattaattattgttttttactcttgataacccccactcgggttttatcttagttatattatatacgattgttatttttttgtcaatcttataaagttacagcttttttgatattttacgtcgctttattatgcaatatacataaatattgaacattgttttatgatagattaacaattcatgaccgtcaaattgcacaatagaaatcagattgataaaaaattatcatatatgctgcctgaaagaagattaataaatataagataaaatctaaaaaaaaataaaacagttgtgaaaataacgaaaaagtgcttgacatttagaaaatctgtagtataatatagacataacagagatacatagaaagcgctgagatgtaaaggtaattttacacaataaggctgttgaaaaatcgatgtatactctgaagctcgacttaataccatattttaaaataaaaggagatatgacttatgaaacttgataactttgtagcatccagcgacatctatgatgtttatgaatctgatggaatggcagtcaggatctataagaagcctgaatacaaggaaaagtgtttgtatgcggctcttacacacgcaagagttgaaacaacacttggcaattccttcataaagatgcctgttcttcacgaggtttccgttatcgacggcaaatgggctattacgatggactttataaagggtaagactcttcagcagcttatggacgaaaatccagacaagaaagacacgtatcttaaccagtttatcgacattcagtgcgagatacacgctcagtatatgccacttctttcaaagctgaaagataagatggcaagacagatcaagactcttggtcagatcgacgagataaagaagtatgagcttctcacaagacttgattcaatgccaaagcatatcaagctttgccatggtaactttgagccaaagaacgttatcatcaatgacgagggtacttatgttatcaattggggttctgctagacaaggcaatgcttctgctgacgttgcaagaacatacctgctgttctgccttaacaatcctgatcttgctgaggcttatcttgataagtattgcgtaaagagcggaacatctaagcagtatgtacaggcttggttgccaatcgttgcagcagcacagctcattaagggcaaaccagaggagaaggatctgctcatgaagtggatcgacgttgtagattacgattagtcttttcgtcaggttgtaacaaatttgtaacctcttattgtgcaaatagctaaaaaatgatttatcccgattatgagtttcgtcataatcgggatattttgttacaattttatataatccctttacagagtaattttcatgtgatataatgtgaaactgttgaaatatgacataatgatttaggactacagaggttattcggaggatcaatatgaaaaagctaatgatagctgttgctatagtttgcactatgtttgctttgccggcttgtggaaaaaatgccgataataaaacagaaaataatgttaatcttacaaataatgacgtaacgacagctcagacagaggtttcagatgaagtgccggacgaaactacttcactccctgacagaagcactcttgaaaagataccagatgaggctgttgattcgtttaatcaggtcgtagatgtctgcaaggagatatatcctttggctgaaaaaacaaaaaggctttatggttatacaggcactaagactgtgaacaaaaagaattgttacatttttgttatatatgataaaaatgacgatgtgttgacaaaggtggcaactgtcgctgccgaggtcgcatcagataagctttacgttcttgatgatgaaacaggaagtgctgaaaaaatcaataccgaggatgttaaaactcaatctacagagtcatgggcagatcaagtaactgagtcttttgctgaatactatcagagcaaagaggttaatgaccatcttgctgcagttgttgaaacagccgcggttaaaacagttcgctaatactttatataaaaaaatcacaccagagaattttctggtgtgaattttttttattcgatctcttcgctgttgtcagtatcagtgcttgtgatgatatttgttgcatatgtaagtgtaagcaggctgtcacctaaatggacattttccacaactatgttttcatagtcgatgctaagatcataatgtgaaaaattccagaacgctttcagaccaagatttacaagctggtctgcaatagcctgagtgttagccttcggtatacaaagcacagctacaacaggggagtttgcttcgcaaaagctttctatatcattagtgtgacgaatcggtatgtttcctaccacttcaccagtgagcttaggttttatatcaaatatgccaatgagattgcaaccccttgtttcaaagttaatatgtgtggcgatagctttaccaaggtttcctgcaccgataagtatggtcttgaaatgcttgtctactccgagtatcttgcctatttccattctaagctcgtcaacgtgatagccatatccctgctgaccgaatcctccaaagcagttaaggtcttgtcttatttgtgaagccgtgagcttcattctctctgaaagctcccttgaagatattctttcaagtccttctttttgaagctcacctaaaaatctataataacgtggcagtcgttttattactgatgcggatatcgaaccgtctttagacatatatttacactttcctttactaataaacatgattgataaataaataacaatatcacataatataatagcactaatcttttcttttgtcaaggacttgtaaactctctgcggtcttaaaaaaagcagcctcgttttacagaagctgccttatgtacattaattttattctagatcttttttctttacagaagcaacacagaagtcgatgcgttcttcatcatcttcttcatttcctgaacctgtgagaggaactccttttgttggatcgatcccgtcaacggccgtaacaagtcctgtgccctcgccaatagaagcacccggtactctgaactttgtaatgtcgataggctcgatagaggtctcaacaggcttttcaagctgtggtatccactcgtatggtacacgataagctctgtagatcatgttgcttttgaatgttccagcaaaattcttgaaataagggtttacaaattcccaaactatttcatggtcaggtgtgacctcaagaagatgtccatctgaaccttccgtaataagagtgtttccgttcggaagtcgctgtgcagagctgatgtatgagctatagaacttagaagcgtcagtaaaaagcagattccctgcttcaaggggagtgtactgccatgttatttcaagtgtaacaggattgaattgaagtactcttgagtaatctctgtgtgaattgttcactcctgtgagggaagcagggttaggtgtgccgtagccaccctcgccaccgttatcgaataccaacaggtcgccctctccaggaagtccctttggtatcatgtgcaggtggtgctgaccaattatccagccaagcttctttgtggcttcgctttcgttgaagttaggacctacacgccatactatcttacctgttgatttctcgataattccgagtatgtttgagtttcttgcgtcaaatatgatattgtctgggtggaagcgtttgtcacctgcgtcataccacttgttttcaccaagggtagagaagttgtttatgtgcatccaatctccacctgcctcaccgtgaagaccggggtttctgaacaatgcgttctttgcggcctcgtcaaagccaagctcatcaaagtggtcgcttgcacgccagctccaaattatattgccttcccaatccacttcgatgatcttatcgtcgataagtcttttgtctgaaatatcgtggttgtaaaggttctcgtgagtaaggataagtgtattgccactgtctgtctttggctcaccatttggataatagtaacccacagtgctgccctcacgctgaaaatcatggtgctgtctagccatatagaccggttctttacccgggtcggcaacaagttcagttttgtcgaatttccatacgatatgaccgtcccagtctacctgaacaagatcaagttgatcctgatatgcatatttacctcctcttgctcctgttgtgcccattacatatccgcctgggagtattttgttaggaaatcctcccagtccagcccaaagctttacttcattgccattcatatctatgagcagagcacctttagcggacgggaagatcgtatagccgctgtaggctttttctttgttgtatattgtaactcctgttggataaatgcttggataacccatgtctgattcctccttgtttatttgtctgcttttgtcaggtctgccgtaacgttatctggaaatgctttttttgctgcatctggataataaaattcccttatgttgtaactgtttggatatttaccattctcatacgcccacttatttatttcatcaagatgagatgcagcttcctcagaaagtcccagtttaatactgtactgttcccagtttgttttgaaatcatctggttctattccatatttctttgatattttttcagccgactcatctaagttgtcatttatgtatttaacgctttcatcaagtgctttaagatagttcgtaagagtttcagtattgttctttgcaaagtcgcttgatgttataagataagcagatacgtttatccctatatcttttgcagatgcgacctgagtccagccctctgcttcatatttttttatagctgagcctgtaacgatagcggctgatgcctcaccgttatgtgcaactgctatctgagttgatatggaatctgtgttgacgtttttctgctttgacgggtcaagtcctaaataagtctgagcctgccagttgaagtattctgaaactgttccgatagaagttatccatccttcactttcatctaaagcatcaagatcatctttgtattttggtgcaacaaaaagacctccattatatgaaacgctagaacttagatctgaaaaaatcacaagattagtgttatcgagagtatttccaattctgtttacagcagcaaaatctgcaagcagtcctgtatctgctgtgcctgttgcaatagcgtcaactgtgttaatgccggcagcgtattctgatgtttcgagagatataccatatttctcaaatattccttgctccataccgatatagtcggcatactgatctggctgacctgtcatgttcgcaactctcaaaacgctaagctctttaccgtctttggtaaccttctttgcggtttttccgcttgatgaactaccgcatgatgcaagaagagttactgtcaatgctgtcgatgctattattgcgattatcttttttatgttcatttttaaatctctcctgttaaattaattattttacgtcaaagtgtttaagttttttcttgccaataaactgtaggatcctgtcagcagcaaagccaatcatagcaagtgtgacgattcctgcaaaagcccagcttgttttgtaataaagcttcgagctgtttataagataaccaaggccatcactgccgaccagcatttcggctgccacaacacagatgatagctgagctaagtcctagtcttattccagtgtagatattagataccgctgatggtacaactactgtgaaaaaaactcttgctttttttgcccccatgcaggaagctgcttccacgagctgcttatcagttgaagccacacccgctatagtgtttacgaacatagggaagaatgatgcgtagaaaataagtgctacttttgattcttcgcctactccgaaccacattagaaagagtgtcgtcaatgcaatagcgggcacaaatcggaaaaagctaagtataggttcaacgagccagcgtacaggtctgaaatttcctacaataagacccataggaacagcaaaaattattgaaagtagccagccttttattactcttccgacgcttgcaacaatgtcactccaaagagttccgtctttgataagttccttcatgctgtcgattgtttcctttgggcttggaagaaaatattcatcatatttcaaagatcctattccccaaagggcaattattgctacccatgatatgatgccacattttagtatcttctgtatagcagaggactttgttttattattttccatctttaatgtcctccttattaaatgtagtacagctctgagtcatcaagagctttgtttacgagaatatttgtagtgttttcatcaatagtgtaaagcttcttgataagtacttttaccttatcacctttttttaagcgggaagcattaagtggatatctgcctgttactgagataccgtctatggaagctttaacctcaaaggcgtttcctctgaatgaaacttcttccacaacggcatcctccattgagctttcaaactggtgatactcgctgtcttcaaatttgtttatctcgataaactcaggtctgattatagctgaagtcttgccctctgctgtttcaaagcctttgagcttgctgtagtcctcgataactgcggactgaccgataaactgagcaacaaaaggagttttaggttcaaggtatatctcaactggattgcctatctgctcaactcttcctctgtttgtgataacaatttcgtctgcgacctctattgcttcgtcctgatcgtgtgtaacgaaaatgcttgttatgcctattttatcaatagtatcacgaagccatgttctcagttcttttcttacctttgcatcgatagctgcaaaaggttcgtcaagtagaaggagttcaggctgaggtgctagtgctcttgcaagagcaatacgctgcctttgacctccgctgagttggtcaggataacgcttgccaacgtcaggcaagccaacaagttcaagaagctcagccacacgttgtttgataaacttcttatcttttttctgaaccttcagaccataagctatattatcgtaaactgtcataaaagggaagagcgcatagctttgaaaaacaaatccgatacctctttcatttgatggaagcttgttgacatttttaccatctataataatatcgccgctatcctgtttttccaaacctgcaagcatacgcaggatagttgttttaccgctgccgctcggtccaagcagaccgataagctttcccttttcaataccaaaacttacgttatccgaagctttaaaatcgccaaagcttttattaatgttttttaattctatatacatagcttacaactccaattaagatatattgctgtgatagttccagtgtcaacatcgctgcattcgcatattgatctttgacaatttaagctcctcactttcatttcatatcaagtcgatatgattagtatgtttttattatacatgattttatggaaatgtcaatagctatgaatgatttttgtgaaatcatacatatatgataggaatactttattattgttgtacattttattcataactaacatatatgagaaatatgatatacagaaatgtttgataatactcttgacaaagtacgtaaatagtgatataatcactatattcatagtaagcctatatgaataatataatatattggaggaaataaaaaaatgcttacagaactgacaaaccagaattactacgagctgatatcagcagacaaaccgcttgttatagaattttactcacctacctgtgttcactgtaaaagaacagaggcagggcttaacgaagctgcagaagagcttggaaaaaccgctatcatagctaagtgtgatatcacgtctcagccagatcttgcgaagagatatgacgttacagcactgccaacactcctttttataaagaatggtgatatcaaaaacaagcttgagggttttacgcacaagctgataattcttgacaatattaagagattataataaaatcagtccgatgttttgagcatcgggcattttttttgagcaaaatgttatgttacaatagatagttgacaaaacaaattgaaaaacaacttccaaaatgatataatgttaagtaccaccaattggtggtacttaacattatatcattttggaagttgtttttcaatttgttttgtcaactatctattgtaacataacaaacattcacgggaaaataccgtcaaccctcttgacttcatttgcatggcatagctgttctcttactgcgaaaaataatattacaaagaaaaaaggaggaaacagcaatgaagatgaagtcaatgataacaggcgtttcaatggcgatagccgcaggaacagtggcttatgcagtcacagaggcgacatcaagcgaaaagaaaatgctcaaaagccgcacaggacgtgctatcagagctatcggtgacgtaatggacggcatttcaatgatgatgaaatagccctcatgcaggagcgtaccatggtggtaacgctcctgttttttttgcatttttaactctgacttatctttttcagcagcgtaagagcgtcgataacatcgacctttccatcaccgttcatatccgcacgctttagctgagcgggatcaagctgtgtcttgcctgcattgtaacgcagcatgagcaaagcgtccacaactgtcagatacttgtcaccattcacatctccctgctgcagggtctgtgaagcggcttttcttgttatttttatggtgtacgtccgttttacaccgcttgccgccgtgcaggtgaccttgacagtgttttcgccggttttaaggctcaccttgccctttccagacacctttgcacttttgcccagcggatttgcattaacagtaacagaagaaacctccgcattgactttggcagtatagcttgcggtgaacttatcgaattttggtgaaacgctcgtgcctgaaacgctgagggatttaagataattgttgttatctccactgcttgtaggctttgggcaaagtttatcaggcatattgttgtaaacaggtatcttgaactccattgcgctgttcaaaatatcctgagaataggcgttttttaggcttatggcttcattcgcctgaccgaaaacgcaggtcatatactggtgataataaagtccgtttccgccgtctaccatatcaaatttttgcagataaagggtatcctgaccctttgttatgtagcctgtgcctaagaatatcgagccgcccactatggacttgtactgatttgtccaaggaagaagataggtcggattagtagtttttgcatacttacagcccatttctgcggctgtcatggtggaggtcgcataagcctgaatgtcaaagaagttgaaataattctcatagcctttcacagtaccaagggattgcggcgcaccatttacgccctgctcgttcctgcaccttgaagcaaggtgataaggtgaaacgcctgatttctttgcagcgtccataaaggtctgcgaatatgtatactttttctttgtgtcaggacaagtgtagcttttgctcataaaagtgtctgcaagaatagtttttacaccgctttccgtctgatacgagggatcatatgactgattttcaaacataaaaatgtatgtatcgttgagaaaatttctcggatccatataatacattattatctcttttgaagccgccacccacgagccgtcaagcccataccaataaccgccgttaaaatcatatgcacccttttccattgacttccaagaagccagtgccgacgagtggacaaggtttctgcccacaacacattcttcctttaacgcagtgttccaatccacgccaagcttctgagcggtaaatatccactttgggtgctgttcatggagcgttcgcagatatggcttatagctttcaggaaagccctgctttgtcatatagctctcaaaatcagcgtcagaactgccctgcgagccgcttgatgttagctgaacatatgcagcagaaacatagcccgtcaaattgccgcatgatatcttataccatttcgcaccgcttgagtcggtggtttcggaaagtatagtcaggctgtcgccatagcttactgtgcctgttttagaatagcctgtgcctgcaccgctgcgaacgttcagaacgtctgccgtacagcttcccttcatatttgccgctgaagctgtcaaacatgaagccgccattgacgctgcaatagcaaatgacaggatatatgaaatcatcttttttatcaactcgttcacctcagaagatataggcaataccgcaacaaggcacgcctatgtataagtccttatttttacacacattggtttgtacatttttctgtatcaagtacaaaacttcaccctcattatagtacatttctcagggctttgtcaacagtctttttgattcataaaaaatttacatttagcaaaatgcagctttaacttaaaggttacagatttattacagcctatttagtggctttgctgttgatcggtacatacatattgtgacacaaatgctctcattataaatatatccaaaaaaatgtgcttattttcgctgttttgactattgacgtgttactttatattgtgatataatcctattacgacaaaggtaacagaacttgtaatattttataatgaaatattacaaattaaagacaaaacaatagtaaacaaaattaatcaagagcaaaatactgacagaaaaacacgattttgcaacggaggtatcaaatgaaaaaaataaaaataaacaagatggcgctgtcggtggcaacagcgtttcttatgctcacgagcattgtttccacagtggctagtgcatcaggcggaaacgagataaagctcacaagcgacaagaactttgcacaggcaggcgacagcataaacgtaaaagcgagccttgagcctgataaaacaggcgttgcaggcttcactatagacctgcattatgacccgtcaaaggtaacagtatatgtgccgaccgatgaggagagcgagagtacatacaatgttggaagcaaattttccgttataaccaactatgttgcttcatcaggaactataaaaatagtcggtgcaaacctcacaggttctaacataaaggacagaacagaccttgcccttgcgactttcaaggtaaaggacggcgtaacaggcaagataaactattgggtagaggttgaaacgatggtggcggaagctgacggtggatacaagtcagtttcatactcagcacctacagagggttcaccgctcactgtaagtgcaggggaggagatcacaacaactcctgcaacgaccactaccactgcttcatctaaggctgaagctactacaactacatcaaagtcgaccacaactacaacgactacaggaaagactacgaccaaatccgaagcgactaccacaactacggctaagtctgagaaagttacaacaactacgacaaagcctgttgaaaccaccacaacgactacaacagcaaagagcgaaactcagaccaccacaaccgcaacatctgcacagcctgagtccgaaccgcttttcacacacaagcagggtgacgctgacttcaacagcgaaacttcccttcagttcggtttcaagctttctgactacataacagactattctcagcattacaatgtaaaggtcaacgtaaagtcatcaggcaacgcaagcggtgcagtcggtgcgttggttgacggaagctggtctgcacagagcacgaagctcacaggtggcgaggaagcacagtggatatactcagatcttgacccttcaagaacaagcgacgaggttttcgtacagctttattacttaaaggcaaatgcagattttcagatagcttccgtggaagtaacgcctgtcaaggaagcagttgacacatcagctgttacaaaggtcacagcggcagaaccaaagcctgctgacgatacaacgaccacaactactacaacagcaagcacagagccaaaggctgacgaaaacacacagcctgaaagcaccaccacaacagcagccagacagcctgaaaatgtcggtgcggctgttactacagtaagcgagggcgacagttctcaggagcttacagaatcacaggcaacagaaaagatacagcagatagttgacgaggcctcatcgcaggctgacagctcaaaagtaaatccgtcaacaggcgttgaaatgacaaagaacattcttactgtcattgccgcaggatatgttatttttgcgatatttgcatttatcttcaacagatttgccgcaaaggatgaagaaaagtaaccgaatatatttcttttggctataaaaacggacgtttccatcggaaacgtccgtttttcgtcaggaacaccaaggggatagtatgatcctgcattttattgatcttctgtaacaggcggaatgaaattctctatggcgctgagaagcttcgggtgtcgtataacaaaatgtatagcaggcgcatttccctttgatatcatcgcccactgaccttcatggatcagtatttgcaaattgcagaaggtctgccgcttagcatatttaaggctatagttttcatgtgtctgtgcatagcgttctgtgctttttaaatgtgcagaataatcatcatagctgtaaagaacatcactggcacagaatacacccgacaggtcaagggcatggggacgtgtttcaaattcctctcgggaaagacagcatatctcgtcctctatggtcatggtttccagtatgctctcaactcgctttttacgatcgctgacataagcttttatatctctgccccggcggtcgtcaatgccgtttctgtcaagtatactattgagcaggtcattatccatagtataaacaggcaaagcagataaaatactcctgcgcctgccacgtctgtgagagtcggcagtgagaaaatcgctgaaatctttttccctgtcacttcggtatatctccataagcgggcaggcgtttgaaagcagatcattggcacgtttacgataatatccaagctcctttttggacttggtcagataatatctgccctcactgtgaaagcctgccacggcttcccctgaaagagccgccgcacctgataccttcagcaaatgcaaaaaagcattattctgtacgtttttcaaatagtaaggcgctatctgccccgtcatatacatcggtatccagctttcaagaccaagcatcatatcttctaaggagcggtcaagatcatgtatctgacaaaggtgcagaccctttttaagcatcagagccataccgaacatccacttcttcggaaattcgggatcatcagccatttccttcataggcatatcactatacattatcacaggctcattagaacgtgacaagactgtggctttcagaaaatcaagctcgctttccatcatttccttgatgccaaaataactttttgacacaggaagctgaaaaggcaatgcaggtactttcatttcatcaaaacgtatcgcctttatgtattcgttcaggtcaaactcatcaagcttatcaagaaactcttcaattccaccgctttttatctctctgctctgtctggcatgatcgctgaacagccatttgcatatcacttcataacgctgtgacacatcctctatatcactttcattacagcccacaagctgtgcgaccgctgatatctctgtgggagttctaagctcccttgcagtaaagcctgctattgcggcgacaaagcgttcagggtcggcaggctttctagtaccgttccgtatgcggaaaacggtggaaacatcataatttatctccttgcacatacgcttgatgtttatatcaagggctgagataagggtattgaaattttgccgcatagactctctgtcggcaggtatgatatcttcacagtcaagaaaggctctttttatgttctcccttgtcatatcgccatagcctttttcccttgccacagcctcaagagcgttgcaaagcccgacaaacgccacagtgtctatctcaggtattctctctccgcttctgtatctgctaaatgttgagggagatatccctgacaactcacaaagctcctttgccgtgcaggaaagctgttctatatacttaccaagctgttcgcaaaacttcattttaacgattcctcccgctgtcatatggtattacgttaattatatatcatatttatcaaaaaaggaagtcccccacgatatataatttcagaattggcatatgactattatgaaataaatcacaaatttattcatagatttgttataatgtgataaaggatatcacattaggggaaatacaaagtaatggaggtgtgcttataggataatagcgaacatgagaaaaaatataatatcaaaaggagatgtatattatgaaaaaacgatcactgcaaggaaaaataaccgcttttatccttaccctatgtttggcagcaccacaaatgtctatgttgacatttgccacagattctacagtcagtaatgaaacggaactgaagtcagcattggaaaatacagaattttcagagatcaggttgggcggaaacattgagaccacctgggaacttgatgtggagcgcactgttactcttgatctcaacggatataccctgagctgcagctcggcagatgatgagataattcgggtgcgcagcaacggagacctaacagtaaaggacagcggcactagtggcaagatcgacgggcagaacaagaactgcggatttgaagtcaagggtggtacgcttactctggagagcggcagtatcgtgaattgcacagattccgacggagacggcggcgcagtggatgtatccaacactggtgtaacggaaactccggtcaagtacggcaagttcgttatgaacggcggtactattaaggattgcaaagcaggtgatgacggcgctgctgtggatataggcatgggctgcacatttacaatgaacgatggtacgatcagcaactgcagagcggaggacgacggcggtgctgtatttgtcaagcagggcggcttcttcgtgatgaacagcggaacgatcgaaaattgttctgcatgcaataatggcggtgcggtgaacatatacgaaaatggcagcttcaccatgaccggcggcacaattaaggactgcaaggtagacttgggaggtctcggcaatgcagtatatggcaaaaacaatacggcgatcgttgtcatttctggaggtacgatcgagaactgtggtgtatttccatggtcttttgatgagttcacagtgacatttgattcagacggcggaagtgcagtgtcagagcaaaaggtattgaattcttctgcgatcgagccaaatgaaccgaagaggaacggctatgattttgctgggtggtatctaaatgatgcaaagtatacctttgataccaagattactgggaatattactctaaaagcacattggacgcctgcggcaactttaagcagtattaacatgatcgatatcgaaaacgtgaagctcgattatcagccgggcaatgccccgcaggcatcggccaagcgaacaggcaccaatcaggacaaatacgatattctcttcgagtgctggaaaaatcgggaaaaggacgccgacgacaccatgcacacggttggctactggtattctgatgaaagcgtttattcggacgacgatgttcgattcaatacctttgaaaagggcggaaggtatatatattccgtgaaacttcaggcaaaggacggctataccttcgatcgcaatttgaaaaatgaaaatgttacactgaatggagcaagcctgccgtctagcgcgtgggtcatggtgatggatgacggcaagacctgtcttattagatatggaacagagctgcgccccggtcaggctgttgaagagatccgacttgatgccattatcaactttaatgccggagataaaccgcttttcagcaccggtgtcattgaccctatcgttgacaccgatcatcagcggtgggacgccaatgacggcagcggttatggcattacctccagcgactactggaacgaacgctataacggtaagctcattacggaatttgaagccgacaaaagctatacctatggcgtatatttcaagatttccgatttgggcattgaagagggctaccgcttcgatcagaacacgaagctctatatcaacggcgaagaaatcaccctgacacccgatcagatcgatgtggatgatagcggtgaaaccatttggttcagcaatgtattgaccatgacgccgtccaccgtgaaagttattgacgtggtggagataaatgatgtcaccatcaacttcaaggacggcgacaaacccgtgtttaccggcaagagtcctgaaggcgtgaagtatgcatacaattgcgagtggtgggaattggacagcaagacaggtgcgatctctgcggatttcttcagcggcgcttatgaaaataagataaccacttttgaaagtggaaagacatatcattacggcgtgtatgtgaaagctgtgggctttgttgagagtgaaaatacctcttacatattcggacccgacacgaagctgaagatcaacggcgaatttgtaaattacaaacgctatgaaaatgatacgagcgacggctctgacggcaccttgtgggtcatcactgaccttactatgacgccaaaggcaaatgatacaagttctgacaacagcgatacaaactcagacaacaaagacacaagttcaaacaacagctcaaatacaaacagcaactcaaacactgacagcaagaaccctgtaaagaacaatgcaggaagcacaaatcctaacacaggcaatgaccttggcggtatcctctttactatccttatcacaggaagcggacttgtgatcgcaggcagaagatcacgcaaaaacaaataacaacatgagctgacaaaaaacgggcgtttcaaagcgaaacgtccgtctttttatatccatatcaaatttacttattctgtgccttaaagataacgcccgttacctttggacctgcgtttattgcaattgccgcacctatttggaaacactccacaggtggatagcccaccttcttcgtcatagcctgtgccatttcgtccctgacgctctcgtcattgccgtaaacgatgcagtaaggtgtctgcggtatcatttcctttacagtcaggtcaagtatctttggcacaatagccttgtcgcctcttacctttgtttctgtaacgatagcatggtcatgtatcctcatgataggtctaaggcccattacctcgcccacaaaagcagccgcagacggaattcttcctgacttctttgcatatttgagtgtatatggtgcaaagaaaataacgcagttctttatccagtcctccataaatgccacgatatcagccgcaggaacgtcctttgtggctttcattgcgccctgaatgactgcgtagccatatgcaccagtgtagctctcgccgtctatattgtatatagtgaacttgccctttgactcagggtgagcggaataaaactcctctgccgccataacagcgttgttgtatgttgccgagccttttgagtttatggtagtgtttataacatcagtatagccctcgctgtagagcttctcaaaagtttcctgatattcaaaagctgttatctgcgatgtaacaggtatgccgtcaaaatcgtcaagcattttgtagaatttctcgttatcgaaatctatccttgatgtgtagctgtcatcacccattgccaccttgaaattcattatctggatatcaagcttcttttcaagctcctcagtgatatcgctcgctgagtcggtaagaaattttatttttgccataaattcaccctccgtttttttatttattttattcgtcccatgtatattgcgtcagcttgccctctctgccaaggtcgggatagtcccactgtcttaacacctcatagcaggctattgccactgagtttgacagattaaggcttctgagcgttttcctcattggtatcctcacacagctttggggattttcataaagcagtttctcaggcagacccttgtcctctctgccgaaaattatatacacttccctatcctgcggataatccacatctgagtgtaccattctgccctttgtggtaaagaaatagaactcgccgctgttcttagaaaaaaagtcatcaatattatcatactcgtatatttcaagcttatcccagtaatcaagccctgcacgctttagctttttgtcgcttatctcaaagccgtaaggcttcacaagatgcagtgccgcacctgtcactgcacaagtccttgaaatattgcctgtgttctgcggtatctgcggctctacaagcacgatattaagtctgttcatcttcggtaacacttccagatatcacaaatttgtatagtccctaagctcctgatagcttgtgagccaaggaagctgaccctccagcataagaccgtctgtccatggcgtctggtagctgtatgtagtcttgacagtaagctctgtgaacgctgtggctctgttcattgcgataggcaggctgtcacccttgagaagtcctccaataagaacacttgtgaacatatctcccgttcctgaatagtgtgcaggaacataatcattctttattttccaaaagctgttattttctttatcatagcctacagttgacattccgccgtctgcaagatttacgcttgtgataacaacgatctttgcgccctgctttgaaagccttacaagccatgattttatctcagagctgcgcattgaagccgtaggatattcctcgccaagaagtatagccgcctctgtgaggttaggcgtgattatatccgccacctttacaagctcgaccatacggctgcaaagctcctttgtgtaggtcttatatgcctttccgccgtcacccataacagggtctacgaccttcagggcatcaggaaaagcctcgaaaaactcaaggcagtggtctatctgctcgcttgaagctagaaacccgctgtacacacagtcaaatttcatatccatttttttatagtgttccaatgcaggcttcataaagtctgtaagatctctcataacaaactcgctgtagcccgtgtgtgccgaaagcacagccgtaggcacaggacacacctgaatacccatagcggaaagcacaggtatcacaactgttagcgaacaccggccaagacctgatatatcctgaatggaaacaacctttttacaaccctgcataataaaaccctcttaaaaaatactcataagcattattataacatatccatcaggatttttcaatagcccatggcttgccggcaatatttttttcactatattttttcatattgttcatatcaatataatatgatttacgcgctttatgaaaagcaacaaaaaagtgccatttttcgcactttttagactagcacctacaaaattcatcatgataatttgtacaaatttagtcttgcaaaaacgtttaaaatagtatataatatatctgttaaagtaaagtgattttgtttataatatcaaaccaaatatcaaagaaagaaacaaatgtatgaaaataaaaaaagaaataaacctctttgcgggaatgttcaccgcagaggaaatatatcgctatggtgatatcatactgctgttaggtcatataatatatcttgtgctgttttatcggttcggagtataccaaatggtatattataactatttcagcgtagcattctatgcagtgatgtatttcctgcttcattttaagaagataggcaaaatatcatttacttaccttgtgcttggcgagataatagtacacgcctgcatgggtgcttattacataggctggtcagcaggatttacgcagataatgctgtgtataatacctattccatttttcatttcacaaaacaggaaagcgataccatatatactttcgtcctttgatgttgtagtgttcatagtcatgcgtatcatagtcacaaacagggtcgcaccttacagctttgataccaacagagagaatatcttatacatttacaatactctatgcagctttattataattatctatgtatcttccatatacattttcacaaatgagcataacaagcgtgaagcaaaagcacagaacgaaaagcttcaaaagctcgctactatcgacccactcactcagcttttcaaccgccgtgccatgatggattttatcaaaaagatagaaagcaacagccgcaggacaaacagcgtatattctatgtgtttgggcgatatcgatgatttcaagcacgttaatgatacatatggtcacgaagtcggtgacgaggttcttagagtggtatcagatgttatagctggaaacgtgcctagcgagggctatgtgtgccgttggggcggtgaggaaatactattcgttgtgccaaatacagacacagaaagctgtgagaagatagcaaagagcatttgccagaaaatacatgagtgtacatttaaggaaaattctcgaagtttcaatatatccatgacttttggagtttactcagtgactccgaacgaaaactatgacgagggtatctcaaaagtggataagttgctatacaagggcaaaaatcagggcaaaaactgcgttgtatctaaataaaatcaaggcagccgtgtaggaaaaactccacggctgccattttcatgcctattttgcagagagatatcctctcatgtctacagaaaggcgttcctcaagacatataagctccttggcaatgttcttggacttctcgtctgccgccttataattgttgagatatccagacagggacttcacgcccatattacagccgtctgttataaaatctgccacagcgtcatcactgctctctgccgcaagcttgaagttggttttaagccatgccatgccctttgccatagcaggcggctcttttccactgtcatgatatgaatttaaaagtccctgaagcttctcttgtatctccacatgccctgcaagatttttctctaacgttcgctttagctctccgtttgaagtgtatttcagcgaatcctcaatagactgcacgcccatttttattcctgcatcgcactccctgagaagctttattgtatccttttctatcatctaaatttgctcctttcataattgcaaatagttttccacaaaaatttctctttatgcctgcataaatccaacaaacccattgaaaaatctttaaatttgtgatataatttcttcatggcttatgcctgaagtatataagggggtattttaaatgggagaacacaaacattacaaagagtcgggcaaattcagcccagttggagcagtgctcatggtgcttgcaacggcagtatgcggcggattgcttttctggctctatctgctttttgagggctggtgcactatcatctatctcaatgttatcgctgcgatagctgtgtcatgcgcacttggctttgtgggaggaaagatagtcagagcattcaaaatgcgaaacacagttgtggcagttgcctgtgcagtggtgggctttttatttgcctcatattttaaatgggcgctgtatgattacaacgatctgaaaaaatatggctatgagcttatgagtgaatacacagcctatgattattatgacgagctgaatatgcttttcgatgaaaacacagacggcttcggtgattattatgacttttatcaccagaccaaggcatatgatcttttcagcaacgattcaacaggcgatttcacagacgaggacattgccacgatgcagaaaaagtctgtatggcagtttttcgagcttgacaagcttcttggcaaggataaaaaatccgcacagaaaagccttgaaaagtcatacaccatgaacgcatatgactacacctacgatttcaggaagtatgacaagacaggtctttttgacataatcgcacacccgtctgacctttggaatgatataaagtctatcaacaaggagggtcgctggtcttacaagtcatcacattcatcaagagataacggctcgcttgtgaacggcacgatcctgtggatagtatggggcagtgaatttatccttctgctggctttccttgtgggcggtgtgagaatcaagtcaaaagagccttttatagagtctgaggacgattgggcagaatacaaaaacctcaaggatgcatacaaattcatggtgcctgaggacataaagtcatttaaggtttcaatggagcaaagcccttacacgctttttgattatcagacggctgttactcaattcctgcctacatatatggtgatagattgctatgtgagcaagtcaggcaatgagaattatctaacagtttatcagcagacgatcaaccctaagaacaaaaatcctgacacaaaggtgcttgtgaaaaacctctttgttgacggtgatttcatgaacaggctctattcccttgcaaattttgctccgcaaatgcaggacgttcagcagactccgcagtaaagataacaaaataaagacatacaaaacaggatgacttagatttcatcaaaaggggatatgattattataatgaaatatgttaaatatgtattgatgagtttcatatatgctcttttgtttaatttaactgcatatttaggagcagggatagcttctgttatttctatatttattttttttattatttatgcagcggtacagttgactttttttgttaagttaagcagccataatataaaaatatattgtttgggtgttatattgaccatttgtttttctgttataatcggttatatattttacgatactgatttttttattcatatatttatggctttcaatggtgattatggaacacctaatgcaggaagcggcttcggtatgattctaagttatagtcttaatgggatagcattactttgttcaattctaattggtatatataatatactgactaatcgacagcaataagtctaaatagttcaatctaagttaggtggtatagagcatccccaatatttacagagttattatattttttctgctcattttttgcgaataattttaattaatgtaggtgtctgggttcagcaatattttatacatatcataactaggaggaattgtagtgaaaaaaatagcatagtagctgttatatttacattgattgtttctatgtttttatcttcacgaaacattgtatatgcggcagaagataaagcaagggcgataacaattcatatgcaaggactatctgatgaggcgtattatgttgatcttctaaagataacaaaataaaaacatataaaaaacacggctgagaaaatatcagccgtgttttttatgccaatttttatagcttacagccaagcgccgtaaatagtttcgcccgtcagttcacggtatgagcgcaccttcaggccgagcatatcagctctcgcctttgcgattacctgtgcaggtgaattgtagttcaccactgtggcaggctcactgtgagaagtatagtcaagcttatcctccaccgcctcggctacctcatagccctgggctttcattgtaggcttgcctgacacgatagacttgttgttaagctcctgcggttttatgaccatcacattgtcagactttagtgttatgtcaaactgaaaatccgccgagtcacaatactgacccatgcctataaccgtcacctttgcagttccaacgttcacgttgtcagagtaaactgttctgtaatcaacgtcaggaataagcgtttctccgtctacaaaaacgtcaaatatctgtgttctctccttgccagtgtatgacatagagccacgcatatttgtggtacagcccacaatagtgagctttgtttttatgctcatatccgcactgtcgcttccctcttggacactgtcaacagtgtcaagaaaagctttcactttataaacatatcttgtttttggaacaagtccatagtctgtaaatgaagtgccgtctgttacagttgctatctgctcaaactctgcgtcctcagcgtcggtctttctgtaaacataatagccgtcagcctgcgacacctcgtcccatgttaaagttagcttatcagagcagatatcctgcgactttacgttatcaggtgcgttcagaagcactgccgcactgcctgtgacgtaaatatcgcccttgctgttgtcagcaaagctgtttccgcttattttaacctgagatttcttattagcttttattccgtagcctttatttttattgcaggtgttgttgaaaaactccacagaagcgctgttgtcagccataaaaccgctaagaccgttttcttcaaggacattgtcagaagccttaccgcttccgccagtgaatataagtccatgatttttagacttcttaacagtgttttttctcacatctgccttagcttctttgattatctttatgccgttggagcctgctgaggttatagtattgcctgatatggtatttttatcagaaccgcctgaaacataaactcccgacacgcctggctttttaatggtatttgagcttacctcattgcctgaaccaccgcttatataaacgctgttctgctttgtgcctgtaagcttatttttggtcacagtcacctgtgacgattcgctgagccatataagatccatggaataattatatctgtcatagtcatagcttatatcgttagaacctatgaaaattcccgaaacgtccgtgagccttactgccgaaccagctgtttttatagtgttgtctactatcttcacaccctttacagtgtaattgtaatcagggtgtgagtatgacttttcaagcttcttgccgaatatctggatagcatacggctggggataataatatgtacccacaacggttatgtcgttgtttcttattatggtgttggcattatcgtcaagacgatcctttatgcctgcatagcctgaattaggcacatggaaatttgcattttcataatcggtcatgtacttgaaatctatggcacagccaacgtttttcatagtattgttttcgattatacattttttatgattaataagtacgatagctgttccgctcatattataaaatgagttgcctgatataagtgtattagtataatatacaccaagacaagctgaatgtgagccaagacctcttataaggtcatggaatttgttgttctttattacagcattgtcgcaaggagtatcatcaaaaggctcatacgccgggaaaacatcactgttacttatggtatccagctgtatagcctctttctgaaatgttcccgtataaccatgaaaatcgcaatcctcgatagtgatgccctttacaccgcctatctcaacatgatgaccattgtaattgttttttatctcaacgttctttatccaaaggtttttcatgtgaccaaatctcatattagaaaatggtcttgaagtaggcgaagggttgccgtcccaacagcctccctcgataacgatatttctctcgctgccatatccgcctgcaccgtttgcctgagcgttctttatcatacagcccttgtcaaagtttctgacgatagtcgctccgtcctcaagatacagccaagtgtttgaatatatctccaaaagcttgtctatcctgtattttcctttcggcacaacgacctttatctgcacagagttggagccgttgtcaatggcatagtcaagggctttctgtatcgccttcgaggagtctttctttccctttttgtctgcgccgaagtcaacaacattcacttcaagcgctcccgaatatccgcttatttccgctccactggcttttgtgccggtgatagtggaataatcataagcaaagcaccttactgtcataagcataatggcgagtaaacacgccgctgcagaggcaataaaggtgcgagttatctttgtcaattctcatctgtcctttcgttgtcttagggttatcgctgctctctttttgttctttttatctttttagcagaacatattttacacatattcaattataccaaatcatgccccgtttgtcaaccgaaaaacgtcaaaaagacgaaagcaataactcacaaagtcaacacatgatacttgtgcgttatcacaacaaaaaaactgcggtgaaaaatttcactgcagtttttaacaaatatgcctttttatcctagcgccacatcaagtatcatcataagcaagaagcctagcattacgccaactgttcccatgtgaccttcccccagatgtgcttcggggataagctcctccaccaccacatagagcattgctcctgcggcaaaggcaagaagccacggaagaagcggttggatagcacctgcagcaagaacggtgagaagtccgaaaacaggctcaacaattcccgaaagagtgccaaggccgaatgctttcgccctgctcatgcccgattgcctcagcggcagtgcgatagccgcaccctccggaaagttctgtattcccatgcctatggcaagtgcgatagcagaagccagcagtaccgagctgtcattatgtgccgccagtgcaaaggcaagacctactgccatgccctccgggatattgtgcagtgtgatagcgaaaataagcattcccgaacgctttagccccctgcggacgccctcttccctttcaggctcaggtaaaaaataaggcattgccttgtcaagccccataagaaacagcacgcctagtgcaaagccgcctgcggcaggtatccagcctatcctgccgagagcttccgcctcgtttatggcagggataagcaagctccacacgcttgcggctatcataacgcctgcggcaaagcctaaaaaggctttctgcaccttctcactctgcccctcttttctcatgaaaaagaccacagccgcacctaacgtcgtcatagagaatgtaaagcccgtgcctgccgcagcccaaagtagaccattcatactattatgtttcctttcagacagtattatgtcagatacaatgacatatcttagtctatgaaaagcctttacgctgtgtgaaaaagcctctgccgacaaaaaacgttaaatttgtctgagattttcagaatatgacccgtcccaagtgaatataatgttctcagcagggcattacaagccctttacgatcgtatgatcagtttatttttaggaggaaacagacaagatgaacactatggatcttaagcttaacagagagatgctgtcaatgacacggactatccttgacgcctcctgcgagcaggctgtggaaaaggattttctgctgcccgactattatcccgatattttcagggtactgaaatgcgttatcacaccaacagtacagagccattccataaacggcggaaagatcagctttgacatggcagtgctcataagagtgctttacatcagccagaacgacaagcggataaactgcatcgagcagaaaatgaactacacaaagtctttcgacctgcaaggggattgcggcgaccctatgatatggctcacaccaaaatgcgattatgtcaactgccgtgtggtaaatcagcgcagacttgatatcaggggtgctgtgactatccacgcaaatgtgacgggcgaagtaactgtgcctatagtcacagacgcatttggctgcggcattcagcttaaaaaggttgctgttacataccctgcaaaacgtcttaccgctgcaaagcgtatcacactaatagaggaattgcagctttctgcggcaaaagcccctgttggcactatcctgcggacagattgccgcattatcccacaggaacacaagatgatagcaggcaagcttgtgacaaagggcgacgctgagataatgatgctttactcctgcgtaactaccgatggagaagaaaccgctgaaacaatgcggtttactctgccgttctcacagataatcgacatagacggcattgacgatactttcaccgcagatgtgaggataacccctgcaggctgcgatatcataccaaagtctgacgattccggcacacttgaatgtgagcttgtgcttcttgtgaactgcgttgccaaaaagctttccacctgtgagatcgtcacagacgcatattccacctgctttgagtgcgaggctgaaaggtgcgaaagcaagcttgacagcgaaagcataaagttatctgacagccacagtgttactgcaaagctttcctgccaggatggcgagatacgctgtgttcacgacagttgggcgaccctttccaatgtgacatcaaggcttgacgaggaaaagaaagcctttatcatttcaggaagcgtgacgttctgtattatcggcaggaacgaggacggcactcccctttatcttgaaaacgattcgccttttgagcatgagatacccattccggagaatgtcaatggtgagatatccatatcccctgacctgtgcatagaaaactgcacatactatcttgcagacgaaacaacagcggagcttaaagccgatatcaagataggcggcgaaatgactattcaacagacagggactatgatatcagagcttagggtactcacagataagccgaaagagaaaaatgacaaatacgctctgaaaatatgctactgcaatgagagcgacgacatctgggagatagcgaaaaagtattcaacttccataacagccatacttgaagaaaacgagcttaccgacgataaaatatcaaaacagggaatgttgcttatcccattaatgaactaggaggacagacacatgaaaaacgatatttacaccgacattgccacacggacggggggcgatatctatataggcgtggtaggtcctgtccgcacgggaaaatccacctttataaaacagttcatggagcagttcgttataccgaacattgaaagcgactaccgcaaggagcgtgccattgacgaactgccccagtcctccgcaggcaagactatcatgaccacagagcctaagttcattcctgaggaagctgtgaacatcaccctagagggcggagcaagcttcaacgtgcgaatgatagactgtgtgggctacataatcccaagcgccataggctacattgagaatgaagccccgagaatggtggtcacaccgtggtttgacacggaagtacctttcaacatggcggctgaggtgggaacacaaaaggtcataacagaacattccaccataggtcttgtggtgacaacagacggcagtatcaccgaccttccacgtgaagaatacgaggaatgtgaggagcgtataatcgacgagctgaagcagataggcaagccgtttgtggtgcttatgaacaccactgagccttactctcagcagacaaaagacctttgcgaacagctttccgacaaatacggcactacagttatgcctataaactgtttggagctttcggaaaaagagataaaagagatacttacgcttctgctatactctttccctgtgaaagagataaacatctcaatgccctcatggataaactctcttgacaagggtcactggctgaaagaagcggttttcggacatatcaaggaagcggcttcagccgtgacaaatcttcgtgacatttcagactgtgccgaaaagatatgctgctgtgagcaggtgtcctcaggctcggtggctgagatagaccttggaaaaggctcggctgtcataaaggtggaacttgaccctgcgctgtttttcaggataataggcgaagccacagggcttgagataaaggacgaaaacgaccttatgccgagaattttggaacttgtgaagataaaagaacgtttctcgaaattcagctctgcccttgatgaaatggagaaaacaggctacggaatagttatgcctgaaatgaacgagctgacccttgatgagcctgagataataaagcagggtggaaaatacggtgtaaggctcaaagccgccgcaccagctattcacctgctgaaaaccactatcaacaccgaggtagcacctatcgtcggctcggaaaagcaatctgaggagcttgtgctttatatgctcaacgattttgaggaatcgcctgaaaagatatgggagtcaaacattttcggcaagtcactccacgagcttgtgagcgagggtctgcacacaaagctttcaaagcttcctgaggacgcacgcatgaagataaaggaaactatcgagcgcatgataaacgagggctgttcgggacttatctgttttattctctaagagtttcataaatgaaaataaactgatccaccaaaaaaagcgttacactgtgaaaagtgcaacgctttttatcttgtataaagtgttaatttactccctctgcaaagctgatcggcacaccgaaaagcacgcctgcattaggctgtgaaaggtcgcctgtaacatcagttatcgcctttcttgcaacatctacctgatcgtctgcaacggcaacgaaaattgtcttgcccttttgtgcagcatcctcgccgctgagaatagatctcagaacgccgatcataggcagattatccattgtagaaatagatttcgccattcccacgctgtcaatgaccgttcctcctcttatgcctgcctgtgccagcgaacgcatgatttcgtctactaactcgattctcttgataaccaaaaacaataactgcattttgatccgtcctttcatctcttatttcctgaatgacgcagccacccagtcttctttttctcttatctcaataagctcaaagccctctgctttaagcctgtcaagcacctcatcttttctctggtcgattatacctgaaactatgagcgttccgccgtctttgataaatccgccgaaaatcccgctcatgcctataagaacatctgccacgatatttgcacaaagcaggtcatagcctgtgcctatctgctccaccagagccttatcgtctatgatatttccgcagtaagctgtatacttttctgcgcttatatggtttttctctgcattttcctttgctatcttaacagaattttcgtcaacgtccaccgctgttgcactttcagcaccaaggagcaatgcgccgatagaaagtattccgcttccgcacccaaggtcaagtatcctgtcgccctcatgaagatttttctccacaagctccagacaaagctgggttgtgttatgctgacctgtgccgaaagatgaagcagggtctatttccagtatctttctcttttcgccctcggcgaccttttcccatgacggctttataagaagcttttcgccaacgcaaaggggcttgaaatactgtttccagttattcgcccagtcctcttccttaacgtttttaagctcatattcaagtctgccgaactcattgttcacatcacgctttttgagcgctttaagctccagcttcatagcttcaagattttcaagaccctgagcgttctcagggagataaactgtcactgtagtttcacagttttttagacccataaggtcatcatctatatagtcccagttgccgtccttatcatcaagaaagtcctgaaaatcctttgcgtccttgataacaaagccgtttatacccattccaagcagacttcccgttactgcttcgatgccttctgttgtggtatatatatccatttcaacccaattcataatatcaattcctttcgataatatctcattataacacatttttgcgattttgtaaagctttttgactatgatttattacacaaaattaaatattgataattgtatatacttatcaaatatcaactatgctgagtgcaaacaaaaagcttcccgtcaaaaaaacgaaaagctttcatgatcattttttcttatcgtaagcgtcaaaggcttcctcaacagtgccgtccacctgcaccttgccgtcctttaggaatatcgcccttgtgcaagtttcctcgatagccttgcgtgagtgggaaacgaacagtaccgttacaccagtggcgataacatcatttatcttgtcacggcacttcttctgaaagtctgcgtcgccaacgctcagtgcctcgtcaacaacgaggatatcaggcttgatatttatattgatagcaaagccaagacgcattttcattccgcttgaatatgttcttacaggttggtcgatatactctccaagatctgcaaaatcaattatatcctgctctatctcctttatctgatcgtcattaagaccaagcagatagccctttagatagatattttccatacccgtcatatccagtgaaaagcctgctgtaagctcaagcaatgcggcaacctttcctcttacagtgatagtgccgctgtttggaaagcttacgcctgttatcattttcagaatggtagattttcctgcaccgttctttccgattattcccacagactcgcctgggtatatcttgaagctcacgcctttaagagcagggtgcttctttactcccctgttttttgtgaaaatagccttaaagcgtgccttttcgtttttatataaaaagtattctttttttacgtccaaaaattcaataattggctcagtcgcttgattttccatttaaaagtcagttcctttcagcctttgttacagaacgtcaggaagtatcttcctgaacttcttataggtgtgcgctccgaggaatatcataaagataaactccgcatagaacactatagtttcagtggtatagttagaatcaaaaataaacgtgtctgtaagaaagctctttctatagccgtttacaaaatagtttatagggttgaaatacatgagttttctcagccacaaaggtgagatatcatatgtgttccagaatatacctgaaagccagaaaagtcctgttataacagaatttataagattttcaaaatccttgctgaacgcactgagaggagcagtcatccacgaaagcacaaggaagaaaaaatacatcatcagcgcataatagataaactgaagattgtaaatactcggtccaaagcccagacacagcaacaccacatacattatagcacacagcaaaatgtggatataaagtcccgaaagtgaggtaaaggtcatgatatttgaaacagggaaggacagctttgttacaaactgcttgttgcttcttattgaccttgatcctccaacgatacattctgaaatataaaaccacggcacatagccggtgagcatgaaaacgaactgagtatactttccgttaatgaaatgcactccaccgtttctttttagacctatttcaaaggcaaaccacagtataaacagggtaaaggtcggcttgataagtgcccaaatcggacctaacgctgcgcccttatacttctttttcagttcgttcaccgacaacattcttatctgtctgagctttcccttatgctctttcaatatctgggtaagcccgaaccaatcaaacttttttccttctatttttatcatctccgtcaaaaacgctctttgtccaaagcgctgtcgattattctttccgttgacctgccgtcgcaggcagacatatatttttccgtgaaacgctcaactccctcacggtcaaagctcttttcactgtcaagcacagcctgtgcaagcttctctccctccgtcaccaaaggcgcaggcatatctattttataatcaagataaaagctcctgcccttgctgtagctctcaatatcaggggcaaatatcacccacggctttttatacagtgcatactcgaacacaagcgacgaatagtccgtcacaagcacgtctgccacaggcatgagcctgtttgtagcaatatcgcagttagtcagtccgctgtgaagtctggggtgcatttttataatgactttccaagcctcgccaagctttttttcaagctctgcggcatactcctcgcccacgcaatgacaatccaaagcattccccctgaacgtcggcgcataaagcactatcttcttgcccttatagtcgggatatctctcaaagaactcacgtctgcactgctcgttgtagctttcatcaaagaacacgtccgtacggctgacgccaaggggctttacgatatcttctttcagcctgaacgcagacacgaaagcctttacgcactctttactgctcacagtgataaggtcaaaatttcttgtaacagagcctttgaaatgggaagatatatcctcctcgctgtcatagccgaactttttcaatgctccgcaggaatgccaaagctgaaccactgtggtttcctcacgctttttgcaggaagtcacaggcacaaaatagttgcatatgaacacagccattgcatttgcgtaagctttcataaagctcatcatatatttaagccccgagaccattccacagcttgaaaggtcacagtacatctccctgaccttatagccacggctttgaagctccgcttttataagctccatgctctcaggagtagaaacgctgttaaggtctgcaaggataacgagctttttgtctatatcctttttctttgacagcttgtagcacagcggcaaaagcgttttttgcagtgctgattttatgtgctgtcttattatacgtttgcggctctccattatcccctaagaaacctcttatatatcttgcctgtcagcgatttcggcattatgaaaatgaaaaactgaaaagtgcatggaacaataaagtcccacagatttgaatatcccatacggaatatcttccacctgacattcacaaaggactttgtgttcgcccagtttcttcttctctcataattgttcgccgtaactctgtacatcacaagcgttttgtcaagatttattccccttgcgccgtccgcaagcattttcaccacgaactcatagtcctcacagcgttttatattgctgtaacctcccacgctcaaagcacgggatttcttataaacaagggtctgattattgaacggatttctccgccttgcatatttgtgtatttctttattggtcaatggcgttttctttgtggctatcacttcgcccgtctgactgtcgaactcgtctatataagccccaagcatatctatctcagggtgcttcgccaaagcataaagcgacctttcacagcggtcaggcttagcgatatcgtcagagtccattttgactatatactcatttttgcaggcgtctatacctctgttagcgcatcttcctgtgccaacattctccttgagccttatggggtgaaagcactcgtaattctcctcatagtagtctactacctcgtcaagctcttttgtgagctttccatcgcacacaagcacaaaatcgttcgtcacataggtctgtgacagcatactctcgatacttgccctgagatgttcaggcttctctcctgcataaacagacataagcacgctgtattcaggcaactccacatttttcactaccatagcgcaccgtccttttttcattctgtcaaaattatccccacaaatctgtaagctattccattataccattaaaaccgctgtttgtcaacgcaggcggggcttaacttttcccaaaatcaacaataaaatgttgaaaaaaatagcgcatttaagcaacaaaaggcaaataaaaaaatgaaagaaggagcgtattgcactatgatcgattatagcacacttaatagtaatttgaaaagaggcattttatcaaaaataagttatagccttaacgatcgcaataaatactatggatatttcataggtcataacgagaaatgctattgtcaatatagctttatacatttctctcaaatattcccaacttttacacccaaaatgagcaaacaacgcaaatgcgcagtcccaacttttacacaaaaaaggcggcattttactgccgtcctttgtatcaagactttatccgtcactttatgaccttagcgcatatcttttcgtaattgtctatcttatagttgagtctgtcgatagtcgcagctatctcctgctgtttttcaagaaggtcttttctctgctcgataagcagattttttcttgcctcgatagtgctgtcgccctgctgatacaaagcaacatactcgataagggcttctatttgcagacctgcacctctcatgcactttatgaactctatccaattgcatgagctttcatcatagtccctaagaccacttttcgttctcggcacaggagggataagtcctatacgctcatagtatctcagtgtatcgggtgtaagcccgtatttctcactaacttcagaaatagtcatagctttacctctctattaaagtgcattatactgctcgtctgaaacaggctcgcaccactcgttcgatgcgccctcggcaggtatctcaagagcaacgtgtgtgaaccactcgtcctttgttgcaccgtgccaatgctttacctcaggggcgatgtaaacaacatcaccagggtgtagctttcttgcaggctgaccccattcctgataccagccctcgccatctgtacaaagaagtatctgtccgcccttgtggtggatatgccagttatttctgcactttggctcaaaggtaacgttaaaaacacctacgcccttgacattcagcggtttaagatagctgtttccgataaaatactgagcaaagttcacattaggctcgccaagaccgaaaagcgagtctgagcagccgtccttttcctcagcatacgcttcccctaccattggaaagacagcccaagcgttaggccagccaacataaaatgcggcgtgagtgatgatctccaccatttctgtctttgttactccgtgatttttagcattctctatatgatatttgatagaattgtctgtaatgccctttgccataagagctgttaccgtaacgatacaacggtctctcagtgagagcttgtcctctcttgaccatacctcgccgaaaagaacgtcatcattaagctctgcgaatttaggtgcaaggtcgccaagactatttctgcctgctgtctgttttactgccatggtaattacctcctggagttttatttattgattacattttaccacctggagttagctccaagtcaagaccttttctataaaatcgtcgatatgcacaaatcgtcatgcaaaatttgttatcaccgacaatagcttaacgctagtccgacacattaagaaaatcttatgaaacagttaagctaatactcgtgcgaaagcttctttagtatggtatcattgatacagcaaaagcaaaggagcggtcattatgacaaataaaaacaaaaagcatatcgtaatcgccactgcaatcattattttggttgtggcattgcttatatacagatattacattcctgatatgaagcccaagaagcagttcactcctgcatcagtggaatacacctatgacgacagcgtgacttcatctcagcttgcggagtataatgcccggcaggactggcagctcacattggtgaacaacgacacgcctatatgtgagaattgctcagtgatactcaccgcccttgacaatggtcatgcagtggactgccgcatttacccacagcttcagaaaatgtttgatgacgcgcgctcgcaggggatatatccaactatcacatcatcgttccgcaccgcagaggatcaacaggacatacttgagagcaaatatgagcactatcagaaaataggctacagcgacaaaaaggcgaaagcctatgcggaagaatgggtggcgatgcccggcacaagcgaacacgagcttggtctgtgcgtcgatatcgcaagcggtgacagcagagttacaaatcaggaagtatgggattggctcgccaaaaacagctacaaatatggctttatagagcgttacacagccgaaaagcaggatattaccggcattatcccagaagaatggcactacagatatgttggcgaaaaggcggcaaaggaaatgtataaaaatgacctctgtcttgaagaatatttacagaaggtgtcataaaaaatgcgggcggccaacgtttgaccctacgcaaaacagcgtatacacatcatttgtaggggctggcgtcctcgacagctcacttatcaaagttttttacattcacagcactgtatcacccaccgatacagtgcttttattttgcaaactgatttttgagtatcccaagcatatcctttgcctgctgttcaagctgcgacctgagataatagacaccgaaagatatatctttcacgccttttatcggtatcgcttttagcggacctttgtaagcgtcccctattgcggggaaaatcataaaccccagccccgcttccgccattgcaactgcgctttcataatctccacagaatattatcttatccaccttgccgttcgcaagtatcctgtgctgcaaggcaaatatctcgtcaggacaggtgtggcgctctataaaaataggtctgcctgagatatcgtccacatcaaggctagccgcctttgcaagggggtgatctttctggcaaagacacataaactgacagcggcaaagctccacatagtcaaaaggctgtttatgaggacttttaaatgacaaaagaagctgtatcttctgatctttgagctgattgtctatggacttgaagggggtgagatctatatacggcaaaagatcatcataaagcctggacatttctcttagggcaggagtcaaaacgttcagctccgcctgattgtgacagcctatgcttatccttacaggttcgtcctcaagcttttctgacagcctgaattttgctgagcctgctattttaagtatctgctctgcgtctgaaataaacattattccctctcttgtgagcgaaacgctcttgctcgttcgcacgaaaagcttcacccctagctcgtcctctaaagaacctatctggtggctcaccgcaggctgagtgatgctcacagattccgccgccttggaaaagttaagatactgcgccacagccaaaaagcactccaattgtacagtattcacaataaccgcccctttatgtttgtttatttccgcaaattgtttcgtttggtaaacaattcttaataaaaattaaatttgatagtaatctataaaattcttttattcattataacatatttgtatttcactttcaagtaaaagtgtgatattattaattaaggcaaaatgttaggtgcaaaaatgtaaggaggcgaacaatttggcggataacagaaaaaagaacattctgcggtattccaaatacattcatctgaaaatagaatgtgagataaacaccatgctcgcaggcaagggtataaccgccgctcagagccatgtgcttatgtacataatggaacataatggcgagcctgttttctcaacggcgatacaccacgatctaaatatttcccgtgcgacggtatcagggcttataaaaaagctccgtgcaggaggatatctctcctatgagggcagtgatgatgacgagcgtcacaagaagataatagcaaccgagaaagcctataccctccagcaggacatttgcgactgtcttaaaaagatagaaacaatggctttccgtaatttcacagatcaggaacttgacgaaatggaacggctccagaaaaaaatgatagacaatacaatataaaaataagcgagaggagggatctggcttgaaagaaatactagcacagatcaaacagtacaagaaggactccattctgacccctgtctttaccgcacttgaggtctttatggaaatgcttctgccttttataatggcgaaaataatcgacgacggcattgaaaagggcaacatgacaaacgtttatattttcggcggcgtaatggtagcggcggcaatggtcagcctgctttcgggctttcttgcaggaaaatatgcggcttcggcttcatcaggctttgcctgcaatcttcgtgaagctatctaccgcaaggtgcagacttattcgttctcaaacatcgacaagttcagcaccgcaggtcttgtaacaagaatgacaactgacgttacaaacgttcagaacgcataccaaatgataatccgtatcgcagtgagagcaccgctgatgctcatctgctcaatggcaatgtgctttgcagtaagcggctcaatgagcactatattccttgcagctatcgttcttcttggcatagttcttggaatcatcgttaaaaagacgatgaaagttttcacagaagctttcaaaaagtatgacgacctcaacgcaagcatacaggaaaacgtatcagctatcagagttgtaaaggcatatgtaagagaggacttcgagcagaagaagttcaagaaagcctcaggcaacctctacaagatgttcgtaaaggctgaaagccttatcgcactgaacaaccctgttatgatgttcgttatctactcctgcataatgctcataagctggcttggcgcaaagaatgttgttgcaggcactatgacaacaggcgagctttcatctgttttcacatatgttatctccgccatgatgtcacttatgatgctatctatgatattcgttatgatatcaatgagtacagcaagtatcagacgtatctcagagatactcaaggaaacacctgatcttcacaacggtgagaacccagcaaaggatatgaaagacggctctgttgacttcaacaatgtaagcttttcatacaagcacggaagcggcaaaatggtgcttaacaatatcgacctgcacataaagtcaggcgaaactatcggcatcataggctcaacaggctgtggaaaaacaagccttgtaaatcttatcagccgtctttatgacgttgacgaaggctctgtatgcgttggcggcaaggacgtaagagattacgatatggaatatctgagagatcaggtctctgtagtattgcagaagaacgtgcttttctcaggcactatccttgacaacctacgctggggcaacgaaaacgccacagacgccgcgtgtatcgaagcctgtgaagctgcctgcgctgacgagttcattgaacgcttccctgaaaagtatgaaacttatatcgagcagggcggcacaaacgtatcaggcggacagaagcagcgactttgtatcgcaagagcgcttctgaaaaagccaaaggttcttatccttgacgactccacaagcgcagtagacactgcaacagacgcaaagataagagcggcattcgcaaagtctatcccaggcacaacaaaattcattatcgcacagagaatttcaagcgtccaggacgccgacaggataatagttcttgacggtggcagagtaaacggctttgacacacacgaaaagcttgttgaaacaaacgagatataccgtgagatatatgaatctcaggtaaagggcggcggagatttcgacgttcagtcagcaggaaaggaggaagcttaaatgcctaagccaatgaataaagaaatgggcggcaagcctaaaatgtcaggcgaccagatgaaagtcctcggcagagtaatgaaatatatgctcaaaaactataagttctcatttataatagttgtggcgtgcatacttattcaggctgtcaccacacttgcgggaatgatgttcatgcagtcacttgttgatgactacatcacaccgatgctaaagacctccagccatgatttttcaccccttgcaaaggctctcggcggtcttgctgtagtatacgttgtgggcattgcggcttcatacgcatacaacaggataatggtaaacatcggtcagggtacgctgagaaacataagagatgatctgtttctcaacatggaaacacttcctatcaagtattttgacacgcacccacatggcgacatcatgtcagtatacacaaatgacgttgatactctcagacagtttatcagccagagcatacctcagcttataaactctcttgcaacacttatatccaccctcgtttccatgataatcctcaacattcctcttaccatactctctatcgcaatggcatttgtaatggtaaaggtgaccaacgatctcgcttcaaagtcaggagcgcactttgcggctcagcagcgtgaccttggcgcagttgacggctttatcgaagaaatgcttgacggacagaaggtagtaaaagtgttctgtcacgaggataaggcaatagaagactttgtaaagataaatgacaagctgagagtcagtgcaaacgaagctaacaagtacgctaacatcatgatgccgataaacgcaaatatcggaaacctcagctatgtgctttgtgccattgtgggagctatccttgccataaacggctatgcaggtcttaccctcggcactatcgtaacatttgtatcccttaacaagaacttcacacagcctatcacacagataagccagcaaatggcattcgttgttcaggctaccgcgggcgcaggcagagtgtttgacctcctcgaccagaagcctgaaacagacgagggctatgttgagttcgttaatgcaaaatataacctgaacggtgagcttgaagagtgcaaagagcgtacaggcatatgggcttggaagcatcgtcatcaggctgacggcactgttgactacaagaaaatggagggcgaggtcgtatttgacggtgttgacttcggatatgacgacagcaagatagttcttcatgacataaagctttttgcaaagcctggtcagaagatagcttttgttggctcaacaggcgcaggaaagacaactatcacaaatcttatcaaccgcttttatgacattcaggacggcaagatacgctatgacggaataaacattacaaagataaagaagcctgctctgagaaaaactctcggcatagttttgcaggacacacaccttttcacaggcacagtaatggaaaatatccgctacggcaaccttgacgccaccgacgaggaatgtatggcagccgcaagacttgcaaacgcaaacggctttatagaaagacttcctgacggctacaacactgttctcacaggcgacggctcgaacctttcacagggtcagcgtcagctcatagccattgcaagagcggcagtcggcgatcctcctgttcttatccttgacgaggctacctcctctatcgacacaagaacagagagtcttgttcaggctggtatggacgctctcatgcagggcagaacaacattcgttatcgcccacagactttcaactgtcagaaactcagactgcataatggtacttgagcagggcaggataatcgagcgtggcacacatgacgagcttattgccaaaaagggcaagtattatcagctctacacaggaaacttcgcagaagaaacagcataaaaggggctattccgcccaaagaaaaacgccacggagagaatatctccgtggcgtttttgtgcaataaaaatgcggctgacaaaagccaaccgcaataaatcttattcttcttcctcttcgtcctcatcgaaatcttcttcatcgatgcccattggacgaggcatatcatctgtcataggctcatctgctcttctgaaatatgagtcgaaatcaaaacgtcccatgcagatacgctcccagtatggtttacccggctcaagcaccataacattatgctcatgaacttcgataacatcatagatcttgccgtatgaatcctttacctgatcgccctttacaacattggtcattatattcaccttccttgtcatatcttgaattataccacattataagagccttgtcaatcggcttggaaaattttttgccctaaatacttaccttcttcacagccgaccacttgccgtacactttggtcttgccaattgtcttataatcccttgccttgacgtaatatgtctttttgcttttaagaccttttattgtgcctttgttctttgagtttccgctgagccacaaggacttgcttttcttaaagccgctgttgtcggcatatgacacttgatagcctgaatttgtgctgtgctttgcaagagtgaccgctatcttctttccgctcttgtcgcccttggcagaaatgctctgtccctgtgggtttatcttgaaagtctttgttatcttacctgtgtagcttcccttccctgtgacagtcaccttagcagtgcctatgcccttgtttgcggagtagcttacagtatagtccctgtcctttttgagggtgacatttccgtcctttacagtgacagcaggcttcagcgccttacctgtccacacctgatctgacaccttgacagacgccttcccgacagatcttttcgttgctgatcttacctttatctcagcggaatatccaccgtataccttcttacctgacacagtttcataacagcgtactttgtaataataatctgtgtttgccttgaaaaatccatctgtaaactttccttttgcagtcgtccccacggcagagtattttccctttgcacctgtttttctgtatatctcatagccgcatttgttagttgatctgccagaaaagctgatctgtatatccgtgttattcacagaattaacagacaatcctgatactctcggcaggctgatagaagaatcagcgctctttgacactgccgcagactttgagccgttcacagcgttgtctttcagcgaagccttgctgtgagagcttacgcttatgccgctttttactgagccacttatactgttggaatttacactcacagaactgctgtaatttgacacgcaaatgccgttctgcttgctgtttgatatcttatttgagcttagaaccacactgccgcagtggtctgtaacaagcacgccatgcttgcctgcgccagaaacagtgtttgaggccgccttgcccgaagcgttcttgctgaacacgataccatgccccacggcatttttaactttgttgcctgagcactcgccctttgatccgttataaataagaatgcccgtgtcccccgcctttgaaatgctgttggactttatcacagcagaagaatttgcagccactgctatgccatgctttttcgctgaatttacgctgtttgagcttgcaatatttttctcagagccgttgtagatatttattccgttcattccaacgttctctatggtattgttctcaaaggtattccctgagctgtcagtaagggaagcaccgtttctggctgagcctgaaatgtagttatctgttatctttatattatcacactcgttgagagtaagaccatttttatccttgtaattaacaccgtcctgctttgtaacgagaatatttgattcgatactgcaattctcagcgtcattaagtgcgatagtggttccgttgctctcgattcgattttcgacgatctttactcctgccactctgaaattatagtcagggataacaccgttgtccttgacctcataccctgtcaggcgtatgccgcttgtaatgccatattcgtcatcaccgcttacagagatagtgttagatgaaataacagagtttgcgtcgtcctcaaagccgtcaactgcttcctccatagacttcaccacagggggattgaaattgttgttaggcaggctggacattgccttgaagtctataccgcttgcgcagtttgtgatagtgttatttgttatggtacaattcttataattgtacattatcattgccacatcgtcgaggttctcaaaaacgttgccctcaataagaatatctgtataatagatacccaaagtggcggaatgagaaccaagacctctgcaaatgcctgagaaaagattattctttatgaccacattttcgcatgatgtatcgtcaaaaggcgcatagcctgcaaaaactctgctgttgttcatgcaatcaagctgaatggcttcttttttcctgtagcctgtatatcctgtaaaagtacagccctctatggtgacgtcagccgcaccgcctatctccatatgatgaccgttctcgttatttttgacgtgcatatctttcagaagaatatttctgcaatgtgcaaatctgatatttgaaaaatctgcggtatttggccactggtctgtgtttccgttccaaagccctccctcaacgataacatttttaacgccgtcatagccgccgataccattattatcacacctgagcataggtccataggaaatgcacctttttatctcaacgccctcttcacagtatatccaagtatcgctgtataccacaagtgcagaagaaataagatacgttccctttggtatcacgacctttgtgaaaatgccctgccctgaattttcctgtgcagcgtcaagtgcctgctgtatctgcttttcggtcatggcgtttcctgtgttgtctgcaccgaagtcattaaccacgttataagtgacgatttccattccgtctgtatcaaaatacgcacctgtcacagccgtatctgccgcttctgccaccgatgttatagccaccgagaagccctcgggaatcgctgtgataacgagcaagagcgttgtcaaaagtgccgctatccgtctgaaaacgtttttttcactgataattctgtagtctttaatgttcattctgctgtgttctccttaaagttcggctatatttttcttgccgctgacaattattcgtacaaatagtattataaatcatttataagtatctgtcaacaaacgctaaacttttcgtgaacactgcacaaatttggctgtgtatttttggcacaaaaaaagctcccctgacgcataaacgtcaagagagcctttaaagcaaaatattttactgcacttccactttttcgcccatgatagacctgatagcgtgaacacggcacacctctgcacactttccgcagtttgtacacttgtcatagtcgataacagcgtggttattctgcactgtaacggcacctgacggacagtttttctcgcacagcttacatcctatacagccgttaggacaaacagatcttgtcactctgcccacatctcttgatgaacagcagatatccacagcctgagagatccttctcactgcgataagaccatttggacaagcttttgcgcaaagcccacagcccatgcactttgctttgtcgataacggcaatgccgtcaacgatagatattgccccctgagagcagaccttgatacaatcgccgtagcctaaacagccgcttgtgcaaagcttgcttccgtcataaaacctgttgcacgccgcacagctctgaatgccgtcaaaatcgtatttatgcggtgtatgagagcaatctcccgaacagcgcacgaaagccacctgtggctctgctgcagtcacttcaacgcccattatctcggctatcttctttgcagcagcctcgcctccaggacggcaaaggttacattccgcacctttgttcacgatagcgtcggcatagtctgcacagcctgaaaagccacaagcaccacagtttgcctgcggaagagcttctgcgatagcgtcaacacgctcatccacctcaacggcaaaaacttttgaagccaccgtcaacagaacgcctgccaatatgcccaaagcggcaaatatagccaaagggatcaaatattccatatcattctcctctttcagaatttcagtttttgttgtgtttcattatattattatccataaaatcaagggtcatcttaatgcggtttttgatattaacgtccgctgttcccgaatcgtgatcgaccgccgttatgatgctgtctgggtagagcttttttatacgctttattatgcctcttgcacaggtgtggctcacaaggcagccaaacggcaacagcatcacaacacctttgcagccgttcttcaacgctgaacacatttctgcaccgataagccagccgtcccccattgtttcgccaaggcagccaaagttttcaccgtagcttttcaaggatctatagtcttccataggctcgaaaccgttttgtacaagtgcagaattcattttgcaccaaagcgttttcatataggcaataaggacttttgctcccacacctgccaaggtttttcttccgtaaatgttatcatcatttgtacaggaatcggcaaggtacattatgtatggaacaaagccgctcatatatatctgacaaccgagatcacggaggtatttctccgtttcgccgttgccgagagcacagaattttatgtaaagctcccctgttacggcgacctttttgaccgatctgcttttatcacaatttattgtagcaaagctttcgcatatcttgcggaatatgacgcacattgagatcggatcggctgctttgccatgttcaaagagacgtgacagcctgctgttccataggcggactttatcaagcgtttcacccttttttagttcatagggtgaaagctcattataaagatacaaaagcaagtcactgtaatagatcgctgcacaagccgtcagcaccattttaggcgttatggaaaatccgctgtgtttctcaacgccgctgacattaagtgacaccacaggaacattttgcagaccggctttcaaaagagcttttcgcagcagcataatgtaattgcacgctctgcaccctcctcctgtttgaggcagcagcagggctgtttttgcggtgtcatatttgccgcttttcaatgcacatatgaactgtcctattatgaggttgcagggaaagcagacatcattatttgaatattcccagcctgcgtttatcatttgtgaccgactgtattcgttcaccccgataacgtcgcacttatatccgccgctaagaaatgcatatttaagcagcggaaagtggaagtcaagcattgatggtatcaatatagtgtgggtctttttcatcggctttgtaaattcaacccttgatcgtttcatatcgataaattattatcagattattcccgaaaagcccataaagcttagcgaaacgatagacgccgcaatgagcgttgcaggcacgcccttgaaagtttcaggaaaatcgcagttttctatccttgctcttactccgctgaaaagcaagagggcaagagtaaacgcaagtcctgttccaagtgcatttgtaagggactgaagaaaattatagccgttgtctatatttccgatagtaacaccgagaactgcacagttggttgtgataagaggcagataaacgcccagtgccttatagagaggcggcatcatctttttcatgactatctcaacaagctgaacgaacattgctataacaagtatgaatgccactgtttttagatactctataccgaaatgctcaagaagtctgtatacaggatatgtgatagctgttgcgcatatcataacgaatattaccgctgcgcccattcccacagatgatttcatctgctttgatacgccaaggaaaggacatattcccatgaactgagaaagcacaacgttatttacgaacacacagccgataagtataagtatgtagctcatttttatgcctcctcactctctgttctgcactgacccttgcacaaagccgcatttgggcagcctgagcaggatatctcctttggcggcttcttgttcgctatcttgttcacaagtgcgataagacagccaagcacgaaaaatccgcctgccggcatgatgaacactgtcataggatcgtcgcacaggaaaggtatcttgaagccgaaccatgagcctgttccaagtatctctcttatagatcccattgtgaaaagcgaaagtgtaaatccaagacccattccaagtccgtcaagtattgacgggaatatcttgttcttgctggcaaaagcctctgctctgccaaggataatacagtttaccgtgataagtgacaggaatacgcctaatgcactgtaaagctcaggtatatagcctttcataagaaactcgataagagtaacgaagcctgcgattattacgatgaaacaaggcagtcttacagcctttgggataacgtttttcaaaagggatataacaaagtttgagcagacaagcacgaacgttgtggcaagtcccattccgataccgtttttcgccattgttgtgaccgcaagcgtcggacacataccaaggagcgtaacaagcgtcgggttttgctttatgataccctttgtaaattcatacagattagaatttttctcagccattgagtatctcctccttatgctcgtcaaaaagcttcacagcctttttgcacgcagatttcattccctttgaagaataggtggcagcggtaacattgtcgatagaattttcatcagtgtcaacaccaaagccctttagctttgaaagaaaactatcgtcctgcacctttgtgccaagacccggagtttcgcctatagagagaaattctatcccctccacagttccctcgctgtttatacctataagaaggtgaagtccaccctttgaatagccgtcctcagttatttcgataacgcatctgccgttatctttatctgtgataatggagttcacgccctctgtatcaaatgtgacaggggtcttgctgtcaccctcgccgtcaagcattatctcataatcgcccttgccgaatatctcctcacagccctttttcatatcgtctgtaagaacacctgtattgtcaacatatgtggcattataggcaagcaccaaaagtccgctgacaactatacatattatagtcagcaccaatggaggcattattttatctttcattcagacttcgcctccttcttctttgttatagcccctaaaggctttgtttttgttatcatgtctatgtatggtgtaagtatattcataagcagtattgagaatgaaacgccctcaggataagagccgaagaagcgtatcacacaagtgatgataccacagccgataccgaatatcaccttgcctgtttttgtaacaggagttgtaacatagtcagttgccataaagaatgcaccgagcattacgccgcctgcaagtatctgatagataccgtcctcgccgcaaagatatgagaacacgaaaactgtgcctataaatgccagaggtgtatgtactgagattatcttcatcattataaggtatatgccgccaatgagcaaagccgccgcagacacctcgccaagacagccgcctacttttccaaggaaaagatcgagataatcggcaggggcggaatgtgccgccgcaagaggtgttgcacctgttacgatattgtcagggtcatagaaaggcactacccagtgtgtcatgttgcctgtgaaagcaagcataagaactattcttcccacaatagcagggttggcaaaattctgtcccaggccgccgaaaagctgctttacgattacgatagcaacgaatgtgccgatagcagcctgccaataaggcattgtcacagggagattgaacgctaaaagcataccggtcacaagtgccgaaacgtcctttgtggaatcaggtcttttcattataagattgcaaagcctttcccatatgagtgccgttatcatgcagaagcctgtaagcatgagcgcacgtccgccgaaaacgtaggcagacattgcaagcgcagggcaaagcgccacaagcacatgggtcatcaccttagaggtagaaatattatcccttatctgaggtgaagggctgacaagcattttttccatattttcttacctccttacgttcttatgaaagcttttgcaagctgatttttctctgcaagatctctctttgcaggacagacgtatgaacacgaaccgcagttcatgcaaagacccaccttgagcttcataagagcttccttatctcgcctgtcataagccttttcaagctctgtaggcataagattcagcggacaagcagagatacatcttccgcactttatacagtttgtctgtgtgcacctgtcctcgataccctttttcttatcagccttttcaccaaatgcaagaatggcgtttgtggtctttgtcacaggggtgtcaagctcataaaggcacattcccatcataggaccgccaaaaagggcttttctaaccttttctttatcgcagtcaccgaatttcagtatatcctccgcagaagttcctataggtactttcacattgcatggagtagataccacgtcaccgtcaacagttatacgctttgatatgagtggcatacctgttttggaatactcgccgataaagcctgctgtggtaacgttcattacgataacgccctgatctgacggaagctgaccctcgccaactacacgtcccgtggcattgaatattatcaccttttctgcaccctgaggatagcatgacttcagcacctttacttcgatactttcatcatcagccgacttttcacgcataagctttatagcctgtggcttgttgtcctcgataccgataacgacctttttaagccccagcatatcacgcacgagctttattccgcacataacatcgtcagcgttctccatcatctcacggtagtcgcttgttatgtaaggctcacactcagcggcgtttataacaagggtatcaaccttgtatttgttctcgtcaaagttgagctttatgtgcgttgggaagcctgcgccgcccattccgcagcagcctgactgccttacggcttcacaaaggctcgccttgtctgttataacaggcggctttacgtcaggtgatacctcctgctctccgtcggtatcgatctccaccattttgcacacctttcctcctgctgtgagcagttcggatatcgccgccactgtgcctgacacagacgagtgaacagggcatgacataaaagcgctgctttcgcctatgacctgtcccacaagcactctgtcacccttggcaactgtcggctcgcaaggtgctcccatgtgctgtgacatggatatcttcactcttgcaggcagcggcatggcgatagtttcgctgttttccgtcccctttttgtgggaaagaaaaatgctgttgagtttcataattttcccccttatcatactttatgactattcaaacctgaatttatcatcacttatacttatcctgctctttatactgtcagagcaataaactacgccattttcattaatggcaataacttctatatcttcatcactgagccacctgtcaagctcaacgcttccgccaataaaaatgcaggtagacagaaaatcggtttcaatgccgctctgccctgtcacagtgactgaaacaaggtctgtttcgcatggatagcctgttgtcaggtcaaaaatatggctccactttttgccctgtgcttcaaaataacgctcatatccaccagaagtggaaacaaatccgctgccgcttgtgaagctaaggcagatgttatcgtcatcaaaagggtctgtgaccgcaaccttgaaatctgttttatccggcttctgcccgtaaagaagcgttgacgagccaaagctcaccaccgcacaatcggctttttcgctatccaaaagctttttcacttcgtcaagggcaaagccctttccgtcacagcccacgtctatctgtgtgccgttttcaaggacacattcgctccccgaaagctttatattcccatatcccacagcggaaagagcagtctgtatctcactttgctcaggcactctcggttcttcaccggtaacgttccaaagtgctgtcagcacccctgcggaaatatccgctccgccgtatttttttgtaagctctatgctcttctctataagccgtgcagtttcctcagaaagctcaagcctgccgctctcattgagccgtgataactccgagccttcctcataaggcgaataaagcttttccaaagcctttatcctgtccttcaccgcctcagcgtcgccgccgtaaacagcggctgtgcatgggcaatccatggcgaaaaatgtcgcttcatctggctttttatctaagtgcatcatcaccgctccgcacaccataagagccgccgcacacgctaccgatacaaacagccgcctttcaggctttttcatttttatacctcacttgaaattagttgaaaagtgtgttataatatccgaagtatgataacatcggtatcaaaattcttatgtgcaagcgagcaaaatgtgttcgcactctttgataaacgccctcagttcaggatttttttccactgaaacctcgagcctgttcaccttttttcctgccataccaaggatcctgtcaaggtctttaggctgagcagaaagatattttacacagcgttccatggtttcctcagtgtcaagctcaaaaagcttgtgggagttgtgaggattttcagagtaaagctttctcaaaagcatataggtgcatattttcaccgccatgtccgtctgagtttcaaggccctttatgccgctgtcttttataagctccctcagcagctcgcttccctcgtccggacagcctaacgcagagtttttttctctgaccttgactaaaccgaacacatcttcataggaagcaccgtaaagctttataagagcaatgatgatattgacgttctgctttttgccgtgttcaacggctgatatgcaagactggctggtgccgactgctctagccgcacagctttgtgtatagccgctttctatccttgcggcggtaagcttctcacctatcctgagagtcagctcatctttgctgtcattgctcatgtaatatctcccatgtataaaatcatattggtttttcaaccattattctattatactataaatttatgtatttgtaaatataaaatctataaaatgacgtatttaagtgaaaaaaatttgtgcaggttttaaatcacttatcataaaagaaaaagaaagcaggtattttaaatatgaaaggctacagaatagcatttatccgtcacggaatgacgcaggcaaatcttgacggacgttatatcggtactaccgacttgccgctgtgcagagagggtgctgaccagctttatgaaaagatagaaaagtatgattacccttcggtgcagaaggtctacacctcgcctttaaaaaggtgcaaacagactatatctatactccagcctaacaggcttgtggctgagatgcccgagcttcgtgaaatggacttcggcaagtttgagaacaagaccgctgatgagcttatgaatgaccctgattatgagcagttcataaaaggaggacttgacaatcctccgccgaacggcgaatcaacaagagaggtcataaaccgctgttatgaagctctgaacatcatcatttccgatatgatgtacgagggtcttacaaatgttgcggtatgcacccacggaggacttataatgaatatgctggcaggctttggcgtgccaaaaagaaaacctatggactatgcctgcgatttcggcgagggctttgaagtcatggtgacagcttccatgtggcagcgttcaaacgctttcgaggtaataggaacatatccgccaaaatatgaggaaatgcctgattacactgttgaggattattatactgacgaagaggataagtaagcagtaaaaaacagaaacgaggggggaaaaggcttgacaaacaaagagataaaactgtcggcaagaaaaaatataagccagaacatgggaaactgcgtatcgctcacggcatttttgtttgcggtgtttgtatttcttggtctgtgcgagcttgccctttttatgcttttcaaacgcatcggctgggagtactttttctcgtggcagggaataaaagatcatgtttccgtaaggctattctggtttcttgacctcattgtcattataccttttgcagcttttgaaatgtggactgtccgcagattttttgttgatattgcaagagcagacagctatgtgggatcgaggcagtatataaactcacattcttatgtatattattcccacaccatgttttcttccattataattaattcactgaaattattttccgcagtacctttcgctatctcatcctacagcgtgtattattggggctgggtatgcaagctcagcgaacttacctccgcaggtcttctttgtttcatgttctcactgggtctgtctgttgtgtttttcggacttatggtgcattactggatatcccttgcccttgcgccatatataatgactctaaacccacgcaccaacatttttgacgcctgcgatctttctgtaaggctcatggacggtcagcatggcagatatatctcgttcctgctgagctttgttatgtatatccccgcacttctgttagtatatcctgtttttatcatctatccatatttcagactaagctatatagtgtttttgcaggatataatgggaagctactggcaggacaaaatgccgtcaatgataaagcgctggaggaaatacagcaaatgactgtgacaataacaaaagaagaaaatgaaaaagcccttgaatgtgtactgcgttcaaggggcttttcaaaaaggctcataacaaggctcaaacgcactgaaaacggcatgacaagaaagggcgtccttatccgcactgttgaccttgtatatgaaaatgacatcatcatgataaacgagggtgacggtgaatctcttgaccctaatcctgacctgaaagctgatattctctatgaggacagcgagatggtggttttctcaaagccgccttttatgccctgccacccgtcaataaagcatcgtgacgatacgctgggaaatctttttgccgcactttatccaagcctcgcttttagacctgtcaaccgccttgaccgcaacacgagcggctgtgtgcttgtggcaaaaagtcagcgaagcgccgcaatgctccaaaaaagctttgaaaagacctatgttggaataataaaagatctgccccactgcggcgggcgtatctgtgcgcctattgcaagggagcaggaaactataataaaacgctgtgtgagggctgacggacaatattccgcaacggattatcttgtacgcaaaaggctgggagatctttctcttgtggacttctttcttgaaaccggcagaacgcaccaaataagagtacactcggcttttatgggctatcctctcctgggtgatgacctttatggcgaggcaagccctcttataagccgtcaggctctccactgcgagaaaatgacttttcaaagccccgaaaacggcaggatagtgactgttaccgcaccgcttcccgaggatatgctctgtcttatgacacccgacaggtgatatccgtttcaagctccaccgagcctagcacttcatcaaggcggtcggcatactttagatagctttgcggatatttgtgacggaaaagccgccacacatcaaaaatatccgttctgttctcatacagggctttgttccacacccctgtgatgttttcttcaaggcgctgtttcacaagtgccgccacctggtctgagcttttctcgtcacggatatcaagagaagagtgtgcaagaacagtgagcttcaatctgcatacgagcctgccgttctcgttatcaagcttcaggctgtggctgtcagaggttatcctaacgtccatggggcttccattatattcgatcatatcataatactgctctgcctttcccgtgagccacagacagcctgatgcgtcagcgtgggaaagatagctatcaagcaccgtaccttttcgtataagggcggtcttttttatttccaaaagcggctcctgctgttccgctgacttttcctcatggctctccgcaaaatctcccagcggttgtttgatagagataactggcatagcgatatactgcggtgatcttatgcaggaaagcagatcgataaggcggcactccaccgttatgccgtttttcacacccatttttatgacctgtgtgaagttttctgaggacatcgttccccttgttagctgaacgttcataagctcctctgcggtattttccgccaagcaaagctccactccaagaaaaacatttttgtcctttatagcaaaagagaacagctcctccggagaggaaagatctatatttttattaaagcatattatttgaagatggccaaaaaagatctccctgcctatctgatactgacagccctcaatggcgtctcggatactcctgcctttgcaattgacagtctgtatattggactggctcacatcgagaggagtgtcagaacccatactctgggtcttaaagacctgcaatgacacattgtattccccgttctcatagtcaacgcccatggcgtggcaaagaacacgctcctcgatatccacctgcctgccgaaagatgaagacaacagcgtcactgctgcgataaaaagcacaacagccacctgtatcttacgctttttcatcagatctctccccctttttcacaaatatcaggcatagaagcggtattacgcctccgagaaatatgagtgggatagggctgagccctgcgtatgcgatgctctcccacttgtgaggcaagagccagaagagcgttgccgccgcaggaatcgccgctgttattatcacgcccgagccagaaccgagcttaggaaaaacatatctcaggcatctgcccgaacaatggaaatatactcccagcttatataccgagagcattacccacacgcccataacagcggcgtcatagcgttctattatggcagtgcgtgaaaatgccgcaagtgcgaagaatggcagttttgcaagaagagtgtaatctccaagtatcattgtgataaagcctaagactatttcaacaagggcaagccttgtgagcagaaaatacacagacgtttttgctgcattgccctttgttgagggtaaaagaaaaactatcactgcaagataagagcttcttgcaagctcgctgacagcagaatgaaaaatgccttttccaacgtttctttccgcaaggtgaaaatcaacgaatgtgaaatcttcaagagagcttataacaaggatggatgtcacaaagagaaaaagtacaaaaagcactgtccccgtttttcctatgaccccaaggcctgacattgcaacatatatcccgcaggcggcaacgctgagaactatcatgagccgtggtatataatcagaaaaataataatccataaaataggtgaaggtgccgataacataaaatgacactgtaagaaaatatgcaagatacattgtacaaactcccctgcctgcccactttgaacggctcaccacaaaggtgcatgggtcatcattaggaaagcgcttgtggaaagccgccataccgcatatcataactatctgaaaaactgtagacagcactgttccaagcataagctccaaagcgtttgcggtgctttcagggagaaatgtcatcattgaaaaggctcttgtacagataagcattgcaaaaaactgcattggcgtaagctttttcattggcttccccccttttcgtcaagcttgtattctttaatggtgctgtgagttttctcatatgaccgaaagctccgccttgaaataacgtcctttataccctttgagaaaaatggcgtaacaggagcggtgtaagatactgcaaggtcgtccatggagtttatatttatcatcaaaagcacagtgcaaagtgcaatgccataaagccccgagccgccgcccaccaggatatacactagccttaatatagccgtctgctgataaaggctcggtataacgaacgatgatgttgtggttatccccaccactataagcagaggggcggacacaagtccgctttttacggcagcgtcgcctatgataagaccgcccactatagaaacagtgcttcccacaggctttggaagccgcaagcctgcttctttcattatctcaaatagaagcattagcacaagcacctccactgtcaacggataaggcgttgactcctctgaaactgcaagattcagaagaagcttcaatgtgaagacctcagggtgaaagctcgccagtgcaacatacagaccaggaaaagccaccgctagaaagaacgcaatatatttcagccaccgcataaaggtgacgtaaaaaggcttttccgtaaaatcgtccatggtctgaaaattttccgcaaaaagcgatgggcagataagcacaaatggcgtgccgtccacaaaaacgcatatcctgccctgatttagccttgtgcatatcatatctggtctttcggaataagccatttgtgaaaacactgacgaaccgaagccttcgtcgataaaaggttcgatatatccgcttgtgagaacagtatctagctttatgcctttgagctgttttctcagcctgtccacagcgtctgagcttgcccggtcgctcatgtagaccatgcacacgtcggtggaagaacgctttcctatctgcatcatctcaaaccgcagcgatggtgttttcattcgtcggcgcacaagagaaatattagttcttattgtttccgtaaaagaatcctgtgcgcacattatagtctgttcgcttgcaggctcagaaaccgaccgcttgtcgtaaccttggataccgtaaacaacagcctttgaaagcccctccacaaatatgaccgcaaagcccgaaaacaaaaactgtatgacgtcaccataattaaagaccgtttttctctcggcggcaagcaggctttcttttgtcaggaagtcgaatacctgctctgcattgccctttgactttcgtgcagaaagctccattataggtctgaaaataagctctgacattgcgctcgttgagatcattccctctatggataccaacgcacagcttacggagcatatcttcacattcattatgttaagatccattgaattgcctgttatggtgcgaagggaagtcatggcggcgtcaatggtcttatctatctcagcgtttttgtagtttctgaaatcgggtgtattcattttgtttctcctacatgaaattttgttgtatttattatctgcggctgttatcagaatattctgcattaaagctgcaaaaaatagctttgaccatattggaggaaaacaaaatgctgatagtttttttcagagccgttatactttatatactcattgtcataagcatacgccttatgggcaaaaggcagataggcgaattacagccctcggagcttgttataacgcttctgctttcaaacatcgccaccctgcctatcgaggatatgactataccgatgtcaatgggcatagtgcctatattcacgctggtgtgccttgacgttatactctctcactgctcgcttaaattcagagggcttagaaagctcatatgcggctctccgaaaatagtcgtgtcccgtgggatcatagatcaaaaacagctcaaagacctgcgtttttctgcagacgatcttttggagtccctaagaagcatgggtatattcgatataaacgaggtacagcttgcggtggtggaaacaacaggcaagatatcggtctatcagaaagcacagtttcgacctgtgaacaatgacggaatgggcataaaaggatctcagaccgaccctccacagctcgttgtcgacaacggaaggataatatactccgcccttggtcttatcggcaaggacgaaaagtggctcatgaaaaagctaggagaaaagggtatgcccctgaaagatgtttacatctgcaccgccgacccctcagggcagatagttgccataagaaaagacaagggcaagaaaaaagtataaaggagcaagctcaatgaaaagattgaccgcctgcattattatcctcactgtcatagccgccatgtcagtgttctccgtatttgcggtaaaaaaagaaaacgataagttcataagccttgtgaacgccgctgaaaacagctacagaaatgaggacagcgacacagtccgacggctcgaagaactcgaaaatgcttggaataaatattatgtaagaatatcatatatagcacaatcctgcacacttgatgatatctcctatgcagtggcaaagctcccagccctattggaaaagggctctgaggaatttttgtcagagtgcgagagcatacgctcatggacagagaagatataccacactcagtatccccatttatattcggttttttaatgtagaaaaattgtgtctaaaacgttatcaaagtgtatgattttttcttgcgttattgtacaaatctacaaaaatcatacagaacaaggcggtttcaacgagtttttcttgacttttctttctgctaatattatacttagaatgtatgaataggataaaaaattttatcctgtttagaaaagaagtatcaatggaggtatgaaatgaacactatcaagttttgtgctaagtgcggagcgccaataggtccagaagaaaaattctgcggcggctgcggtgcgtctatcgccgaaatggaagccgaagcaggcatttccacacagcaggcagcacctgctcaagcacccgttcagcaggctcagcctgtacagcagcaggctcctcagtatgaccagcagtatgcacaaccagcaaacaactacgctcaggcagcagctcctgcggctgcaaagccaaatccttttgctaagcttggcgaatgggtaaagggtcacaagaagataacacttatcgccgctgcagctcttatcgttgttatcgttgcgatcatcattctgtgcaacattcttaaatatcaggtgatcgacgcaaaggatcttttcaaatttgaatttaagggcattgacggctgtggctatgttgaggcagagcttaactgctatgacaagagctactattcaatggcagacgctacaagcgctctcggcgaccttgctgacgagacagatcttgaccttggcgaccttgatgatctttccgactatgcaagctcatctgacaagtcatcaaaggtaagcaagtattttgcacttgacaagaaaactcttacaaaagcatttaacaaagctgatgattttacagaagctaagaagatgagaaatgcccttctcaaaacaaatagtgatggtgagtataagctgaagatcacttttgataagaaagcaaacaagaatcttaaaaacggtgacaaggtaaaatgcacagtaaagtacaacgaggattctctcaaggacaagaacataaagctaaagaacactgagtttgaggtaactgtaaaggatcttaaaaacggtgaggagatcgacttcttcaagggcgttgaggtcaagttctcaggttttgacggcaacggctctgctgacgtttcatatgactcagcatatccatttatctactatgattatgactacaagtcagatctgaaaaacggcgacaagtacactgttacagctaacatagacgtttatggcgcagaagaaagcggtgacatgacttggtttgaatatgacgacaagtattatacatacaagacagccgacgttaatgacggcaaggtaacaaaggatttcactgttgagggtcttgaaaaaactcaggagatcgacccgttcgagggacttgaatttgaatgctcaggcggtgttccatttgttaagccttactcagtaaaggacgagtctatccctgctgctcttaaggacaatgtttcttactcagtatcatgcgatgattatattggcatcggcggcacattcaaggtaacttgcagcccttattcctcacttgcaagaaatggtatcacactttccggcaaaaccgaaacaaacgattggggcgacactgtttatgttaagaaaataacagttgacgaaacattccctgcatatgtaacagctgacaacggcaaggctgctatggacagctatcagtcatatatcgacgacaagatcgaagatatgagaaaggatataaagggtcattacgctccatatcctgctgactttgacggcaaggtaacatctatcgagtcttttgattacgttgacacttatgttgcgttcacaaacaagaagaattatgattcttgggagaacacaaatgcactctacaatctttacaagataactgtaaagacagataaggagaaaaaggcagtttcattctatgcttcgatctactgctcaaatatcgttgcaacaggtgaaacatttactgaagagccttacttctcaacatcttactacaacaaagaagcagatttcaagaagaaggtaattgaagccgagggttacacaacaactaaggctggtgcggcttcaaagcctgcaactgacgattcttcatcggctgcagcaaacgaagcaacaactactaccacaacaacagcaaagaccgattcttctgtagcagaaacaactacatctgcaaaggacaaggcaacaactacaactctcgttccataagagtttaatagtgagaaacacgccgcggaaattttctgcggcgtgtgtttttatgtcctgacaactcttgaaaaccttgtcaaaatgtgatataatatttgttacgataataaaaagcagctccgaagaaccggggctgctttatgaaacgatcgttatttaaggcactgtgaaccattttcaaaaagcactttgttgagctttgccacatcatagcctttgtttattgcgtcaatgagtatgcaatcacgggtgtttttaggataaagctgagcttcacccgcaagggtcagaagtcgctgaacggtatcaatatcaagcttcattgcaagtgcgatagcgattatcttatccttgcttggaagtcttgctcctgcaaatatctgatatccatatatttgatttagctgggatattcttatgacctctatctttgtcatctttttctttttcacaagctcacaaagataacgtgcaaaatcctgtctgtcaagagaatccttattgttgcttagaaaactgttgatatcatcgcttccatttagctcctccataagctgtgttgtttttttcatgtcaccagttccttcctataataatttatttttttacatttttacattggagatgagaaatatgtcacaaaaaagcttatatgattttgaaacagaacagatcgacaaaatgttcgactgcaaaaactatttatttaaaaacagcaagcacgaaaaagtcattttagagagtgacacaggtgtaaaaatggtgcggcacattatctataagcctgctgacgtttctgtatatcaaaggctcgcattgataaataatccatatctttgccgtatctacgagatctccgaaagcactgaagcgtatactatctatgaagaattctgcgacggcatgactcttacggattatgcaaacggcgaaacactagcagaacacgatgccctgaacattacctgctccatatgccagggattgtatgctcttcacaacagcggcatcgttcaccgtgatataaagcctgataatattataatatgtgacgacaataatgtcaagattatagattttgatatttctaaaatttataaatctaatcaacgctctgacacccagactttgggaactgtaggctttgccgcacctgaacaattcggtatgcagcaatctgacgcaagaacagatctctattctctggcagtgcttctgaacgttcttttgacaggtgaacacccatcggtcaaaatgtgcgaaaacaagaaaattctgaaagtcataaagaaatgcctttctatcaatccagacgacagatatagcactgcggaagagctgtacaatgtgcttaataagatcaggagaaaactaaaatatgaaaaaatgtcctaattgcggaagaattcttcatgacgattccattttttgcttcggctgcatgagcgaaataaacaagaggcaagaaatagttctcgctacccccaaaaaagtttctttaaaagcaaaaataaccacaccaataatcgctgtggcattagtatccgcaactgttttcggggtgtatacttataataacaatagtgataagaccacggctgtgaaaaaaagcacacctcgatctactgccactgtcaccacaaatacacctgtgacaactactctgcctcccgtcaccactgtcatgactactaccacaaaaaagcgtgagcctgacaaggctgcccttgcgtcagatattgcagaaggagcggcattagcagagtcaaaagccgccgcagtcaccaccactaccacaacagaaaaagtgaacgagcctgtgacagagcctgagatacagcaggatataccgaaggaaaacacagaagacactcagcaggacgagcctgtcgagcctgaatattattcccctgatggtgcaagtcagatgacccttgacctgctcgattatgtaaatcctctccgtgagaaatatggtctgaaaccactccgtgcaagcggacagcttgatgaatgtctgcaaaagagcctgtatcaaatggacgactactgccaaggcattggcaacgtatacgaacatctctctgaggtcggtctgcctaacaacagcaaaatacgacaattcacagcaaacaacagctgtgtttcagactatgacgaggcatacacagagctttttacttggttaaaaaataatgcaagcttcggtctctcttacggtgacaatctgatcaacggtttggaagattacacatatcttggtgtttgctttttccatgatgatatagttcaggaaagaaaagaccatatgtggaatgacccagataatggtgaatacgaatctatgccgctatatcaatgctatgtttatgttatgaaataagccgacaatatccgacttgaatattttatgcgattgtgatataataaaggcaacacaaaacgtaaaaaacaaattacaaaaaagaggatatttatgaataatcagactaataacgagaatctatccaaaggcactaatggtcagcctgacgaatacagcgcttatcgtgatgaagaatacgaaagaatgcgcattgaaatggaaaaacgccgtgccgaaaggcgtgcaagagaacacaggcgtgttatgaaaaaccgtatcattgccatagcaattcttttggtgataatttttgtgatagtgaaagcctgtggtggaaagtcagacaacaagcctgctgctgattcatcatcacagaccgaaagcacaaagcaggcggaagcaaaaaccaccaccaaaaagaaaacctccgacaacagcaaagcagaagaaacaaagcataagatagagcagtcaaacggcatgacctttgttgacggcattcttatcgtaaacaagacctactccctgccatcagattatgctccgggcgtaagcacaattgcacagaacgcctttgacgaaatggcagctgccgcggctcaggacggcataacactctttgtaaattcaagctatcgttcatatcaggatcaggaatctctttataactcctatgccgcagagcgtggcacagaagccgcagacgaggtatcttcccgtccgggacattcagagcatcagacgggtctgacctttgatgttaacaccaccgaggacagctttgcaggcactcctgaggcaaactggctcgccgagcattgtgcagagtacggctttattatccgctaccctgagggaaaagaggacaaaacaggatatgtgtatgagccgtggcatattcgctatctcggcaaggaaaaagcccaggcggtaacaaagagcggtctttgccttgaagaatatcttggtgtcacctctgattacaaatatgccgaagatcagaactgctcaagcctgaacacctccgacacacaatcaagtcaggcggacggctacacagacggctattatcaggacaacacaaattatgattatcaatactgatacaaacacaaagcggacagccacaggaaagtggttgtccgctattctttactttgtcatacgggacgtcgagaacgccgtcccctacagccaaatatccgttacttattttctgagctttctgtgctatcagagctttccaaactgctgtcatcatagtggacaggctcagttgtaagacccttatctcctgcctctacggctttctcagtcatatcgtcaactatgcgtttgaaaactttgaacgccttattataattctcctgcatagtttccttagaatcgcccaaagtcttaactggcgttctcattgaaaggtggatatcattcggcatattctcgaagttaagctcctttgccatgatctccatgttccagctcatgcccatatcatcaacatacttgttgttcggaaattcctttggcaactcaggagtcattattgacttgaactcctcgtcagtgtttgagtctgttataacaagtatagactcgcccccctgaagctgtgccaagaacttagtgctgttcacgttctgttgctgataatcgtcgctgtgagaatttagcggaatcataatgacctcaacatggacataaccattgccgtcaagatcgtccgtgtatttttcaaagaactcctccagttcctcctgacgtgtttccaagccgttgtttgcgatcataagcactgtcatgtcagccttttctcgccttgcagcgtcaataaaaataaatgccgccaccgctatgataaatattgtaaagattatccacaccttgttgtgataaaagaaattctgcaccttttcaaagccgtgaagctctcttatctggtcatgctcttcctttatggaagactcgctttcgtcgataactccgcttttgagcttcataagctcgatacgttcctgagcaagcctgcgttcacgttccttttcttcctgacgttcacgctcacgtctttcagcttccgcctgctctaaaacctgcctttcacgctcctcagcctcacgcctttgctgagccagcgtgcgctcatactctgcgtcatcagcgtcctccaacagaccctggccctccagacttttgtcgagctttgatatattaatgtccttttcgtctttttttgacatatcactgccgtcctttgcgagatattttatatcatattagtataaaccaataatattaactccgtattaacaaaaaagagatagcattttcatgaaaaatgtctatatacaattaaagataaattgtgtataatatacataaatcaaataaattaagttgtgataataacaatttagtgaaaagaggagagatagcaatgcttgaaaagatcatacagaaaaacacagaaaaatcagagatatccgaacagctaaaagggctgagagaacagctcaccctgcttgaaaacaaaataaagaccgcaggaatgcctgttataatcacatttgacggctggtctgccgcaggcaaaggctcgatgatagcaaagctcatacgctctcttgacccacgtttttacaatgtggtttcctatcgtgcaccgaatgagcaggaaaagcgtatgccatggctgtggcgttattggcaaagcctgccgaaaaaaggtgagtttcttatccttgaccgaagctggtatcgtgacactgtgaacgcctttatgtatggtgagatagacaaggaaacaagggacacacgccttgaagatatctgcacctttgaaaggcagcttacagatgacggatatgtaatcgtgaaaattttcctgcacattaccgaagatgagcagaaaaagcgtatcgaaaagctggagaactcctctgttacaagctggcgtgtggaaagccacgatataaagaacatggaaaaatacgataagtttttccgcagatatgacaaaatgcttgaaagcacaaacacggcatttgctccgtggacttgcgttggggcaaatgaacgtgcctctgctgagcttgaaatgttgacagcggtcacaaaggcagtaagcactgcagtttccgccaaggagaagagcgagcattatattcccgaaccacagttcgacacctgcggatacaattatcctgaatataaaactattgaaatgcctactcttgcagaagtggatatgaacaagtcccttgacgaagcggaatatgagaaaaagctgaaaaaatatcaggacaagcttttcaagctgcaaaatctctgctatcagaagaagatacctgttataatatgctatgaaggctgggatgcagcaggaaaaggcggaaatatcaagcgcattgcggctgcccttgatccaaggggctatgaagttcaccctatcgctgcacccgaaccgtcagagcttgcaaggcactatctatggcgtttctggacacgtcttgaaaagaatggtcactttactatctttgaccgcacatggtatggcagagtaatggtcgagcctatcgaaaagctcacccccgaagaacgtgtgaacatggcttatcgtgagataaacgagtttgaaagccagcttcatgattggggcgcagagataataaaattctgggtgaatgttgataaagacgaacagctccgccgttttaacgagcgtgagaacacgcctgaaaagcgttggaagataaccgatgaggattggcgcaaccgtgaaaagtgggacacctatgagaaatatgttgaccgcatgataacacttacctcaacagatatagcaccatggacgatacttgagggcaacgataaaaaatacgcccgcataaaagcactgaaaactattgtgaaacgccttgaaaagcgtttggaaaaagaagataaataaaaaaaagcggcgaagcgtaatgctccgccgtcttttatttgccgtcagatcagcatccgcagccgccgcaaccattgtcgcagccacaaccaccgcagccgtttccacaaccgccacagccatttccgtaaccgccgcagccacagcagaatatgagaataaggataatgatccaccaacaaccgccaaatccacaaccgttcataaatgaaatctccttttttattaagatttataaagctgaagctttgctccgttgctttatattacagtttatgacgcagagaaaaatgtgttacaaaaaaatctgcaaggagaatttgtcctgtgcataagaatataaaagcgataaaaatgcgagaataacaagacgcaaaactgtcaagaatgtagctaagacaaagctttgtcttaaacattttaaggggtgaattttatgaacgaacagttttttgatagcgacagctttacaccaagggcaagagagcttgtgaaaaatgccgtcactctggcaggaagctgggggcatacttatatcggcactgagcatatcctgctctctgccgcctatgaggaggactccacagcctgtgcagtgcttctgcgccacgaggtcacggctcaaaggatagaggagcagatagaatacatcataggcagaggcacgccatgccgtcttacgaaaaatgacatcactcctaacgctgccgctgttttaaaaggcgcaaaaaggctgtgcgagagcatgggtggcggtatcgcaggaacggaatacattcttgctatgatactccgccgcagtgattgctgtgcctttgagatattgcagcagttaggggtgaactgcaacaagatgtacaacgattgctcattgtcaggcaacgagcctaatattttttcagacagaaattatcccaagctaaagacccttgaacgctacggcagagagcttacacgcaaaagcgagtgtgaaaaattcgacccctgcataggcagagaagctgaaacagaacgtatcatggagatactctgccgccgcacaaagaacaatccctgccttgtaggtgaggcaggtgtgggaaagaccgctgttgtggaggggcttgcgagaaagatcatgcttggagaagtgccgtctgcgttgtcctcaaagcggatcttctcccttgatataactgccctccttgcaggagcaaaatatcgtggggactttgaggagcgattgaaaagctgtatggacgaagccgcaaaggctggaaatgtgatacttttcattgatgagcttcacaacataatgggtgcaggagcggcagagggtgcaatagacgctgcaaatatcctgaaaccacagcttgcaaggggcggtctacagctcataggcgcaacgacttttgaggaataccgcaaaaatattgaaaaagactcagctatggagcgacgctttcagaaagtgaagatagatgagcctgatcaaagccagacctgccgtatcctcagcggtcttatagacaaatatgaacagcaccacagcgttgacatctcccctgaccttatcccatatgcagttaagcttgccgcaagatatgtcaccgacagattttttcctgacaaagcaattgatatcctagacgaagcctgtgcctgtgcggtcatagaacaaagcgaaaacaattctggtgagaaaatatcagacgctttcaacgattatgtgaaaggcaagctcacccgtgacgaatatctcaccgccataacagagtgccgcccaaagcgcataccacttgaaaaaaggcacattgacagcgttatttcatcgctcacaggcataaactgcgctgatatcggacaggacgaagccgcaaggctcacagggcttgaagataagctaagcgaaagcattgtgggacagcagacggctataaagtcactctgctctgccgtccgccgctgtcgtgcaggactaaagggcagcgaccgccccatgggaagctttattttcttggggtcaacaggagtgggcaagagccagcttgcaaaagatcttgccaaaacgctttttggcagagataacgccattgtaaagcttgatatgtccgaatacatggaacgccacagcgtttcaaagctcataggctcgccccctggatatgtaggctttgacgagggtggcaggcttaccgaacaaattcgccgcaagccctactgtgtgcttcttcttgacgaaatagaaaaagctcaccctgacatctacaatctgcttttgcagatactagaggacggctgtcttaccgactccgctggcaggacagtttctttctccaatgtccttataataatgacctcgaatatcggcgtgaaaaaacttgccgaaaccaagaccgtgggcttttcaaacagcaagtcaaatggcgaagccaagaaaaaagccatgctctcagagcttaaaagctttatgtctcccgagcttttaggcaggatagatgaggtgattgtttttaacgaccttaccctttccgatatggaaaacattacacgccttgaaatatccgctcttgaaaaaaggctctccgaacttggctgtacacttgcctgtcagccagaggtatacccttttatcgcaaagcaggcactttcaaaaagcggctctgcacgagagatacgccacataattaccgccctcatagaaaatcgcataagcgatatgcttatctcctccgcctgccgtgacttttctgtttgcgtatctgagaacaccttaactgtcgcacagcaccgcagacaactgtgttcatagaaattttacaaagtatagttgagggatattttacaaaagcccgcccatatgttataatatttttatattgttgcccaagcggcaaaaggaggataaaaatgtctgacagaaaatacaagctatattccgactccacctgcgatctgtcggaggatatattaaaaaatatggacgtgacgcttctggacttatcttttgaagtaaacggtgttgtaaagagcaagaatgacatgatgctgcctgaattttattcccaaatgcgaaacggagcagtaacgaaaacatcgcaaataggtatctccgactatgaacaggcttttgaaaaggaacttgccgcaggctatgacgtgctttatcttggattttcgtcaggtcttagcggcagcttcaacacttcctgcattgcaagagatagcgtaatggaaaaatacccagaaggcaagataatctgcatagactccctctgtgcttcaacaggcgaaggccttttgctcataaaggctgacgaaaagaaaaagcagggtttttccattgacgagcttgcccagtggatcattgacaacaggcttcacctatgccatgttttcaccgttgatgacctgaaatatctccaccgaggtggcagagtatcaaagactgccgccatagcaggctctattcttggcattaaaccgcttctccacgttgacaacgagggacatcttatcccagttggaaagatacgaggcagaaagcaatccattgaaaagcttgtggatatgatgtgcgaacgcatgggaaattgggataattccacagtagccgtctgccatggcgactgcctttcagacgcagaatatgcagccgaccttatgcgaagaaagcttggcaagaagaccactgtgcatatctgctacacaggtgctgttataggctcacactcagggcctggaactctcgctctgttctttatgggcgaccagcgataaaaatacaatacaaaagcggacgaagcccgaaaacttcgtccgctatttttatatgtgatatcaaaggccctttgcctttttcaaagttataccattatctccaagcggcatagcgtggtcaagtccaacgaacttgcctccctcctgccaaagaacttccttgacaaaatcatacttttcctcgtcccatgtaacaaaatcgtcctttacaagtccgcccgtgtcacctgagtttgcattgaagcaccagaaagtgtgatttacatgattgtcctttatgagctttctcatgtaggtcatccaagttaggttaggctctgtcataaagccgccccactcgcctataagaagcggtgcgatatcctgcttctgaatgtagaaccagttgtctttccagcaatctttcataaggctcttgtatgtgtagtccccctcgaaccaaggctgctgataaactgtcggaccatagtcgtgcggcgagtaaacaagcttatcctgatatttgccaaggtcgataggatagtcctttacgcccctgagatttccgccccaccagttgaaatagtaatcatcactgttggtggaggaataatccccatttttcttgatgttcttagggtatatttcgataccctcgaccattataagcacattaggatttttcgcaagcaccttgctcgctgccgtttcagccacatacttccagttgtttgcgtcctttgaatcattccatatcgccgcagcgtcaccctcgttaggcttgccgtggggctcgtttttcaggtcaaatgcaacgatagtgtcattgtccttatatctgtcggcaagccactccaaagcatggtaatagtcctttacagtgaccttgtcagtataccacagatttacagtatgaccgctggcattggtttccgctgaatggatatcaggcattactttaagaccgttttcctccgcaagcttgagaaaataatcaaatatctcaaggctgttcatagagttcagctcttcattgtatgcattattgtagttcgcctttggatattcgccctccgaccactggttgataagctccgctgacataggcactcttataagattgaaaccgtggtctgcaatagcctccaccgatgacacaagctcgctgttccaaagtccgtcaaaggtgttagtgcctgtgttgtagccaaaccagttcacgcccgtgagccaaacctctttaccgtccttatcaagtatcttgcttccgtctgtgtgaagccaatcatcaccctgtttagcctttgaggtacgctttagaagctttttaacgtccttttccgtgacctttttgtcattattctgattattgttgttattgttattattctgtgataccttgccctttttaacagtacactccacaccgtttagctttgcagacttaacattgagctttgttccagttccgatattacagccgatagaggtcgaaccgccctttgcgatctcgccattgtaatcaacattcgtgaccgtgagtttgttgcccttgaccttaaagttgccgttccagccgtcacagcttttgagctggtctatttcaagctccagcgtccactccttgagggcttcatcggagttgttctcaatgcctatctccatgcccgtcatgaccttgtcgccgtcctgccaactgttgtcccctgaataagagatgataaagcccttttcctttttatcgtccttgctttcctgagagctttcctcctcatcagcatcaggctcgtcctcgctttcatcagccacagagtcctcctcactggtgtcatcggtttctgaagccaccgcagaactgctctccgcctttgaagcagagctgtccacgtcttttttacctgatgttgccaccagtatcagtgcaataacaagccccactataacagcgcccatgcctgcaaaagcgataataagctttttgtttatgccctttttgcccacattctcctgctgactgtttacgtcttttttctcatcactcataagctttcccctttttactttttaatattatcatcttaccatattacataaaaccgtcgggttacacgcccgacggtcagtgtcacttcgatttctttgccgtttttaatatcaccaaaacaggtaatgccaatatagcaataatcaaatacatattaccaccccataaaaaatacattattttcagtaaatgtagcaataataacgatatctatttgtttattttcagtttctcgctaaggaacttctcctcaaacttgtctgacggcataggtctgccgaaataatagccttgtataacgtcagtttccagatctctcaggatatcgaactgcacctgttcctcaacgccctctgcgcaaactgctatatgcaggtcgtgagaaagattaactatcattttaacaaacaccgcagtgtcaggattttttgcgatatcatcaataaacgacttgtctattttaatggtattcagcggcatttcctttatgcagttaagcgaagaatatcccgttccgaaatcgtccagtgctatcttcactcccttgtctgttatatgcttcaaaagctccttcatcttttccatatcatggatagcaagactttcagtgacctcaaaacatatcttctcagggggtgcgcctgtttcgtcaaaaagtgtgtctatcttgtcaaggaaatcaggctcaattatctgacctacagacagattgatgttcattctcaaatcaagccctgcgtcagcccactttttgcactgtctgcctgcgatccttatcatgttctcacccaagagattgatatagccaagtctttccgccatagggataaattcggcaggggaaacctgaccgaactcaggtggattccacctcataagcgcttcacagcccacaagcttcttttcagagctactgaatataggctgatagtacgccgtgaaatgtgcaaagccgtttgtgatatccttgtgcatgagcctttcaagttcgatctgccttgaaagtatcctgccgatagtttcgttataatttatagtgcaattcttgccctgctttttcgcatatgaaatggcaaggtcgatccttttaagaaccgtgtttacagtatcgtcaagctttgggaacttcgcaacgcccattgaacaagtgcaatagcaagtgctgttagctatctgccactctgtgttgaacttatcatgtatgatcttgcatatctcgtcgatctcggcctgatcctgatctctcagaagcacaacgaactcatcgctgccaaatctaaaaatgctcagctttttattcttctgggcaaaatcctcaaagaatttacctatctctttaagaagtcggtcaccattattgtgaccatagctgtcatttatgtttttgaaattatcaaggtcaatgagcataacagtgctgttctcatcgctttcaataatgccctgtatactcttatcaagacttaatctgttaggaagacctgtgagattatcgtaaaagacctgcttttcgatgaccctctcataatttatcttttctgagatatcattaagtgtgcaaagtctgatagttctgccgtcatgccattttatgagtttttccgacacattgaaccatttgttcatgatctcggaataataatctcctccaaaaagcattccttccttatgagcagaaagctcacaccaagtcttgctgaaaacgtcactttcctttttgccgaccagttttcccaaatactgttcaaagctcttgctggcaaaaactatctcaccactgtcctgtgccactgcaagcacataggaattcatattatccataacgtcagtaagcgtacgagtagtgctttcagcatgttcagccgctctcctagtatggagcatgccagaaagtatatatgtcagacgtgaggctagctgtatctcctcaggtgaccatactctctcaggatcagaggacaaaagattgaaatatgcaacatacttattggtgtccttgacagcacaagtgagtgaacaaggatacaccacaccacgcagggatatttcctccgcatctccattcggatgagccttatccgcaacgtgaataccagtttgcataagtgcttttttcattgcattgtatctatttctattaaattctttatcaaaagcaaatacagtatatttatgtgtatcagcgatcagttcataactcaaaggttctgagttttcatagcctgaaactgttaccgtagccgcattgacataaagtgcagagcaaatactttcaagaaaattcttgcacacattatcaaatctgtcatcgctttcaagtattttcaaaaagctctcgaacttttcgttataggtcttagctggtatttccatacaaacagccctcctctgcttatataaatacgtctagcatcattataacatattttccgtaaaatcacaaggggaattatagaaatttatttataatgcacaaaacaaatgaccaaatttatatattattaaaaaacaagccccgtagttaagcttaaaaaagtttaactgacggagcaaatgtgaccgaaccgataagccgagttttgtcgagtgcgataatctatctggactgtacgtcgccgcacagctctagccacctatagccccaaatctgacgagcagccattgacttgcaagctaccattggtgttgcatcggataaggtttacatagcaatgacgtctccgccattctggtgggcttttaccccacctttccacccttaccaacaaaagttggcggtatatttctgttgcactggctctaaggtcaccctcggctgacgttatcagctatcctgctctatgatgctcggactttcctcataaacctagaacgtttacgctatcgcatagctcgctcacactatgattatatcacatgaatgacgaaatgtcaaatatgcctttaacacaagcagcccacagagctgttgtctgtgggctgcaaaacgccagagccgacatcggcaatctgatactctgcactatttctttgttgtaactgtctttacagcagaccatgcaccgtaatactttatgccattcactgtggtataggttcttactcttacatagtattttttatttccgctaagctttgaaactgttactttatctgtcttattgcttgttattaccgttttctttgctccgctgaatgaagaatttgtagcatactgtatctcatatcctgtcgcatgaccctttgcggcatagtcgatatagaagcccttgctcttagctgtaagcttctgtatctcctgctttgcagggtttatcacgaaagtccttgttatagttcctgcatataagccctttccagttatgacaacagttgcttttcccacgttcttattatttctgtatgaaacaacataatcaatgccctttctaagtgctgtactgccaagcttgacagtcacggacggcgttttaaacttgccgtcaaaagaataggtcgcaatcgaaagtgatacagaggcagaagaaatgctctttggagaaagtgcagggatatcagctgactcgacaactgccccacataccatgcagcttctgtgctttcttccttttacgcccacagccgcagccttgtctgttatccagtcgcctgcaacgtgacccttggcctttatttctgtctgtgcctttatgacctttccgcatactgaacagtgtgaaccctctgttttgccagcggtggtgcaagttgccgcaacagctttgtctgtaacgatagtatgaccctttgccccaacgtaaccttccttgaagctgtcatggcactccatacactcaacaagcgtgtagccgtctgtttcacagtctgccgctacaactgttctcttgtaaacatgtcccttggtctttatgacctctgtatatgtatccccacagcgtgtgcaggtaaacgttttttctccgtctgtttcgcaggctggctttactgtctgtgacgtatagtcatgaccaagtggtgaagtgaaattatccttgtatatatcaccacagttttcgcaagtatggagcgtatagccacccttatcgcaagaagccgaaactatcttatcgttgtacttatgacctgttgcattgatcaccttgctgtagctgtcaccgcatacagaacaagtaaactttgtatagccgtcattatcgcaggtcggctttactacctctgaaatgccatatgtatgacccaaagcttccagcttttcagtatacacatctccgcaatctgcacaagtgaacgtctttactccgtctgtatcgcaagttgctttctttgttacttctgctgaatagttgtgaccttttgcctttatcacttctgtgtacttatcaccgcaatttgcacaggtatatgtgataacctcatcgtctgtacaatttgctttctttgttacctctgcggaataattgtgtccctttgcctttatcacttctgtgtatttatctccgcagatcgcacaagtatatgtgataactccgtcgtctgtacagtttgctttctttgttacctcagaagcatagatatgacctttagcttttattacttcgctatagctgtcaccgcaagtatcgcaagtgtaaacactaactccgtctgtatcgcatgaaggctgcttaactgtcgtctttgtatacttatgtcctgtaggagcggtgaaatcatccttgtatgtatctccgcagtttgcacaagtatggagcgtatagcctcccttatcgcaagaagcctctgttactacgtcattatacttatgacccgttgcaggtatcttctctgtatagctttcattacattctgtgcaagtgtatgtaataactccgtcctctgtgcaagttgctttttttgttatctttcttgtgagatagtgcggtactataacattaggctcatcagccgtgccacagtaaacaacatttgcgccgtctgtagcagtgatatagtagagtatctcctcgtctgtgacctcataagccgcaatagttgccttgtaaaccgagcctgtggtatttctcatatcaacagacttccaactgtcggcagacttatttttatagtaaagcgttgctcccgcaaccttaacattatccgtaatatcagccgttatagctatagccttgtctggcgtcaaagttttcacaggggtgtgtacaataacaggcggctcaccctctaatggacaacagcttataacgtttgaagcctttgactcgttaaggtcagtatccaccactgtgaaataatagtaataatctgtgcctgcccgaacattttcgtcaatgaacgaaagctcgtccgcattaagaacagacttgttcactcttgtgaaattctgcttctcaggctttttgtcagcatcatattttgttgctctgtaaatattgtagcctgcaagggtatcataatcgtcctgcatccagctaagaaagttcttgccaagctgaccctcgcctgtgagtgacatagactgtgccgagctgtttgttatctcaaacttaaatctgccccaatcgtttcctgttacaagccacttatcatcagccgccgcagctccctttacacggatatacattgtgccaaggtcgatataagggtctatcttgaactcgcccacccattcacgggcgttcgcccaatcaccagatactgcgaaatcagtataaggctcgcttccgccgtatgtcaccataggctggatatccgacgccatatcacggttgaacttaacgtgcattttaactgtctgagcgccgctgaccttatctatcctgttgccgtccttatcagtgaggtaggcttctgtgacgaacgggtagatatccgacatatcatcatcaagtgtaagataaggctcttggataaggtcatttcttgaaacgtcccaatcggcgtcatagcactgcaccttcacaaggtcaggatttgttgttccccaatagttgccggagatgtcataggtggtacgtccgttatagtcttttgaagcatcaaatgaaccgattgctcttatattatcataattattaagataaaacgaattaagaatggcattatttgcgaacagtggattatacttatctgatgccccaactattattgacggttcatcatctttcttaccgtgataattaagtgctacatttttttcaaaacgatcataaggatatactctttggttgtcataattgtcaaaaagagtagttgtaatatcataagcacatataccgtaactgtttcgagatttcatactcatattagagaaatgagagttcgcaatacttttggcaaaaagcactccatatctaaatgaatagctatatgtaaaattacaatgatctattatagtaacattaaaaggcttacctgcactcaaagaatacggatcactagcataataagtcgcattatatatattaacatattttaatgacgcatatttcttatcataatcatcatcaaccagcccactatctttgaaatcaatataagaacccgttccggtaattgtcactgccttatcttcaaaacctttgcctggatacatctcaataagctgttcttctgtaccctcagcaataaatctgccctctacctgcaaataaacgttggcatttgcaccatacttattattagggtcagcagaccagaactgtattcttgtgccaggctcaactgttactgttacgccctcagggataagcacattgttttcaagtatccaaagcttatcgtttgtaagggtcatatcttcattgattattccgctgagtgcaacaccattttgaacagttaaagtatagcttgcagatgagctatacaaattgtcgtccctttcatcaagtccattcttggcggtaatggagatattgaaagttatctgaatatcattaggtgtaccctcttttatcttaaagcgaatagggtttgatatgcctgtgagtttctcgtctgtgtatgtaaagccattatttacagaagcgaaagtacctacatcagacaacttgatttcatcatttatgaactcaacgtatttgtttggtataccagcaacagagtctgcgtcaacttttacagtaatgtcagttgccgcaccccacctgttccatacagctatacccatgtcaatagtttcaccaggctgtgcaatgccgtcaccattatttaaagatgaaacatcttgataatcaagagtgtagacctcatcaaggctcagctcaggctgtgcttgttttgtaaggctgtcacgaatattaagcacaggatagctgtgaaagtctcccttgggagcaataaagcctacgctgcttgtagtggcgctacaaagctgacccattatatatcttgaactatactttgatttatctgtgtatttgcttcttaaaatagccgctgctgccgcaacatttggtgttgccattgacgtaccgctccaacaagcatatctgttgccaggaagtgtgctataaatattaacaccaggggctgccatttcatattcgcaattttgtccctctaagtagtcccagtttgaaaaagaagcaaggctcttattattgtcagttgccattacgccaagtacatatttatatcctgctggatagatatcttctgtattaaaatagcctgcattaattgcgtcagttgtcggcaagccgtcattacctgccgccgcaacgagaacacagcttgggaaagcgtcctgcaatgcgctttcaacgagatatgacctgcctgttccaccgaaggacatattgataacgtctgcgccattgtcagcggcatactttatcgccttggcgatatccgagcttgcaaagcttccgttcgcctgacctgcccttacgcacattatctttgcaccatatgcaacaccgactccgccgccattgccaggtgtcattgcgattatgcctgcaacgtgtgtgccgtgaccatgctcgtccatagggtcgcaatcgccgtcaacaaagtctacgccatgaacatcgtcaacataaccattgctgtcatcatcaatgccgttgccgggtatttcgccctcattcacccaaatgttgtctgcaaggtctttatgggtatagtcaacgcccgtgtcgataacagccacaacagtacctttgccgggagcttcctttttagcaggatcaaaacaatctttccatacgcctgttacgtccatgcaagggaaatgagtttcagcgtttatttcctcgtcggttgccgcaacagttgttgtgtctgtcttttcccacacaaagtcaggctcagccgacagaatgttttcattgtccgacagcttgtccacagttgcccaaacgtcctccgaggtggtcgcttcatagaacgtcttataaggggtcatgccgtccttttcgtcagtgttttctgcctttgtttcaagaataaactcaacgtctttcagatcatactcggcgcagatatcgctgtcatcatcaagataagccgattcttcaccctctgcatgataagaaagcaccgagaacagcactttgccaggagttatctccgtgctgtcacgatattcctgttcagcctccatatccgagatagggtcataagcgtgctgagttttgtcagccttgtctgcactgctttctggctgctgtgccttgttttctgactgctcagtaccgctatagctctctgcatcagccgttttgccgctttcttcagccgaagctttcaccacagcattttcgtcatacaacacaccactcaatgcagtggattgaaaactcaatcccaaacacagaagcaatgctactatcttcttactgttcataatttttccctccctaaccttattttattttgtattttaactataactaattatcgttgtattcattatagcacattaaaaatcaaatttgttaagctgtcagcttagttaaacgttttcggaaaatatttttttattttaacaattattttgttcataatatttctctatgcactgtttacaatttacaaaaaatctgatagaattaaaataaccaaatcaagggagcgtaaaaaatgagaacttgtcctcactgtggcagcgagcttcacgatgattctactttctgctttgcctgtatgtccatcgtcaacgagcgtaaagaattacttataaaggtaaacacgtcacgcaaaagaaccataccaatggtttgtgttgcagtcgctatcatagccgcatcgtcagtgtttgccgttgtcagcaagaaaaacaatgccgtagaaactaaaacacctgagcctgcaaaagctgtgacaacttctgacactgtaacgaccataccgcagacaacgactgccgccacaacaactgtacctactaccaccaccgcacatgcaccaacggcagatgagatagacaaaatttcaggcggtattaggcaggcttccacaggcacggcaggcactactaccactacaacaaccctgcctgaagaaactcagcccgaagaacaaaatgactatcagccaaatgaagctcagcaggaggaaaatacagctccagccgagcctgagccgtcatatttttccgaggacggtgcaaatgagctgagcagaatatttgcagacaaaataaataaaaaacgtgaaggcagaggctatgcaccactgagggtctgcggacagcttgacgatctgctgtcaatgagtcttgaaacattgactcatgtgcaaagtgagggcgagatcgatacttgctatgaaataacattggataagctaaaaagcaacctcagcgacgttggacttccctcagacagtgaatttataaggataagctatgtaatgaactgctgcaaaagctatgatgaaatatttgaatatgccaaaaaggtgaatttttcaaacgagcttttcactgatgaagaaggcgtccttacagtttattctcaaaggctagattacaaatatctcggctgcataatatatgatagatgtgatagtcagcaaaagcctaatggtgatatttcatacacgaccgaatacgtctgcgaaatttggctaatgaaataagcaaaattaaagtttacaaatcatcttataattagccttgatatattgtttacaattcacaaaaattatgctaaaataaatgtatgcttttaagctcttagctttatcagtaaataatataacaaggaaaaaacatctatgaagttcaatatcaaaaaggtcacagccgcatttttaagtgcggcaatgctcaccacaggctcggctcagctttctgtttttgcacagcagacgcttaaatacgaagccgaaaacggcactttgggcggttctgcctatatccaaacagacagctccgcatcaggctctaggtcagttcgtttttcagactcaagctgcacatggtcacagactgttacagtcagcgaaagcggatactacaaaataaagctttacagccgcggagaaggctcgaataagataaacaacctttctgtaaacggctcaaatgcaggcactttcagcagtgcaaacggctctgcctataaagcgtccacagtaaatggtatttatctcaaaaagggtcagaacactgtcaaaataacaatgtcgtggggatattttactctcgactacataaccattgaaaaaatgagcgtttcaaatgcctacaccgccgctgaaaatctcgttgacccatacgcttcacaaagcacacagcgcctttacagctatatgaaggacgtttacggcaaaaaggtcataacaggacagtattgtgacggtggtcttaacggcactgagttcaaagctataaagtccgccacaggtcagacccctgctatgttgggtcttgactttatgcgctatactccatgccgtgtccagaacggtgacacctccgacgctgtcgaaaaggctatcgagttttcacgggcaggaggaatagtaacattctgctggcattggaacgtccctgacaaatatcttctctcaggtacagacggcggaaatccacgttggtggggtggtttttacaccaaaaacgttgaccgctcaaagttctcgcttaccaaaataatgaacggctcagaccctaagggctacaacactcttatgagcgacgttgacgagatcgccaaacaactcaaacgtctttctgacgcagacgttccggtactgttcagaccgctccacgaggcaagcggcggttggttctggtggggtgcagacggctcggaagcctacaaaaagctttggcaggcaatatatgataagctcacgaatgaatacaagcttgacaatatcatatgggtatggaatggtcaggcggcaaattggtatcctggcgacgaatatgttgacataatcggagaggatatctacccaggcacaagagattattcagcacaaagttcaaaatatcttgaagccacagactgttcaccaaacggaaaaatagttgcccttacagaaaacggctgtcttttcgaccttgacaaagcctttgatgcaaacaccgcatggtcatatttcggcacatggagcggtgagttttgcatatcaagctctgagaaatataccgagaaaagtatgtggcaaaaggtctataacagcgactatgccgtgacactttcaagtctgcccgacctgaaaagctatcctatcagcagtgacaatacacaaataactcttgactccacgtcaaaagaaatcacatacggcgacagcattaccctaaaagccagcgtgacctcagacactcctcagacagtaacatggaaaagctccaacacagccgttgccacagtaaaagacggtgttgtgaccgccacgggcaaaggcacagcaaagataacagcctccctgcctaacggaaggtctgccgtatgcactgtaaaggtcaccacaaaaaagcttccaacatcaggctgttcctatgcaagcactgcacagtacacaggcagtgcaattattccgacagtcactgttaaggacggaagcaaagttctccgtcagaacatcgactatcgtgtgatagtcacgaacaatgttaaaatcggtcacgctaacatcactatctcaggcatgggcaactactacggcagttattccgcaggctttgacattatccctgcaaagcagaccatacaaaagcttgaaacaagatacaaaggcttctttgtggattgggcgcagaaaggctctgccacaggctatgacattcagtattccaccagtgcaaacatgagcggtacggcttccaaacacctcactgccaacaagccagataacctgacaataagtggtctgacagccgacaagacatactacgtccgtgtgcgttcctacacaaacgttggaagcaagacttattatggtccatggtctgacataaaaaacataaagaccgcaaaatatgatatcacaaaagcttccgtttctggcatttccaccaaggcatacacaggcaaggctataacacagaacattactgtgaaatacaacggcactgccctgaaaaacggaactgattacacaacttcctactcaaacaacaaaaaaatcggcaaggcaattgtcaagataacaggcaaaggcaaatatggtggcattatcacaaagaactttaccataaaccctgccaagcaggagatacagaagcttacgtctaaatccaaagcatttttcgtggattgggcgcagaaaggctctgcaacgggctatgagatacagtatgcaactaactccaagtttacaaacgcaaagaaagtcaccataacaaacaacaagaccgacaagaccacaatttccaaacttagcggcaacaagaaatattacgttcgtgttcgttcgtacacgacagtgaacggcacaaaatattacggtgcatggtcggtttcaaagagcgtgactaccaaaaaataaacacaaaagcactcctagcgaaatttgaaatgctccccttttgttagacaatgtggtataatagaaatataccaataaaagatctaacaaaaggggcatttttatgccaaaaggaaagccgaacaaaagatacacaccggaattcaaaatcaaagtagtggaaacaatgcacagagaaaagctaataaaatatgtttgtctgacgtttcgtacttcactgcctgcgatattaaggaagactgatgataaggcagataaaatagcagaaaaacaaagccccctgagccacaatgctcagaaggctttgttttatatttggccgaaacagctatcaagaacattttcagacaaattcaaacaagtgcctgaaattcaatgattgtctctttcggatcgtcagtaacagttacatctattttaaattgctgtatcattattcctttcaattttatgtcgttaaacttgacgtattccaaaaacatttttatgaataaatccctatcagcggtataatccttaaaatacgcacatagatattttcccgcagggagcacacagaaatgtcttgaattcttcatttcttcactgcacattatcatggtgtgccaattatccatattttccatctcggaaatatcatcaaaatccatataaaagcctattcggtctgaagccaagatcggcgcagtttcgtgaagatgactttcaaggtgcataaattcaagtgcaacggattcaccacttttatcagatttattgagctgtgatatgataaatcgctctggaaaatcctcaaaagaaaacttctccagctcgatattattgtcgataaccttatcaacgaaatctattttttctttgatagtctccgccagcctttgtttgctacgtatctcctcttcaagaagcttatagtgttctttcagcatatccacagattttttcatatttctctccgtgaaatatccttttatctcattcagcgaaaaatttaggctgcgcagttcaagtatcgtgccaagcttctcatattgctgtggatcatagtatctgtaccctgtatcagggtcaacataatcagccttgaagatcccaatactatcgtaataccgcagtgtttttgaagaaacacctcgcttttgacccatttcttttatggaaagatatttctttttttgttcctggttcataatgaataccccttttcgtcagcaaactgctattcaagcgccattttgccctcttcatcagttctgatcttaattacattttcgacctcatatacaaagatctttccgtctccgatattgccgctgtacagcacacgctttaccgtgtctaccaaaagtccaagtggaactgtactgataacgatctcgacctttatcttcgggagcagatgtgactttgcttccgagccacgataataatcggtgctgcccttttgtattccgcagccattgacatttgttacggtcataccggttatatctatctcgtcaagtgcgtctttcagcgactcaaatttcgagctgttcataagtataactaccttgcgtatctttccgtcagctttatacgctgaacgatctataggctttgagagatctatctgtgtaacactcttggcatttccgtccgacagatctgaaataagatcatctgtcacattgctctgccaaccatgctctgagcggtcaagacccattatctcagccttttcagaaactctgatacctaccgtatgcttaagtataacgaaaagtagcgtcattgcagctaatccgtataccgcaacagacaaaacgccaattagctgcacgccaagaaagttaaatctacctgtatagataacgcccttttctactgaaaatactcctgtcattattgtgccaaaagctccgcaaaggccatgaactgatattgcgccaacagggtcgtccaccttgcagatatggtcaataaactcaatgccatagatcataacaaaagctgcacctacgcccacgagaagcgctgcatagtgcggaagctgatctgctccggctgtgacggcaacaagacctgccacaatgccgtttaaggtcatcgttatgtctgattttccgtatcttacccatgtaattatcattgcagatacggcacatgctgatgaagaaagtatagtgttcataaacacactgccgatagctacaaggtcaaatccgctttcggaagtcactaccgagccgccgttaaagccaaaccagcttacccacaggataaacgctccaagagccgccaaaggtatgttctgacccagtatagcccttgactttttctttttgtcatatttgccgattcgtgcgcctagcacggctgcgcctgcaaaagcagcagaacctcccaagagatgtacggcagttccgcccgcaaaatcatggaaaccaagctgagcaagccagccattggcgttccatatccaacagccgcttataggataaacaactgcactcataactgcggaataaataagatatgacttgaatgcagttctttcggccatagcacctgaaactatagtagcagacgttgcacagaaaactaactgccacgccataaatacaggctgcggaatagtttgtgaagcagccgaacaatcgccattagagaaaagatctatcacgcccacaacgcctgttgttgcaccaaacattatgccaaatcccaagatccaataaaagatcgagccgaccgcaaaatccataatgtttttcatgataacattacaggaatttttctttcttgtaaagcctgtttcaagcattgcaaatcccgtctgcataaaaaacacaagcacggtgcatatggcaatccagatcgtatccgctgacataatcataagatcaatcctttcagataacatcactgcggcatagtattataaatgccgcagcgtgtattattttaattgttcagatcatttgtttacctgaaaatcagtataagagaagttccagaatgactgaggacttggagtaaatgtaaacttatcgctgacagcgtaaaccgactcgggcacataaagtgggatataagcacaatcatcagcagctatctttgaagcttcaataaagtattctactctcttactatcgtcagttgtttcgtaagatttatcaataagtgcgtcaaagtctgcattcttccacattgcctgatttgcacatcccggtactgtatttgagctgtggaacattgttttcagattgcccacagggtcgagatagtcagatacccagctagagccaaacgcctgatatggtctgttgccgttttcatcttcattaaagccgtacaaatagctgaacatatctgctgaaagtatctccttgatattcattttgataccgatctcaccaaccatagattgaataagctcagcttccggaacattggcagataaagtgtaaaaatcgaactcaaatccgtcaggatactttgacttagcaagatactcctttgccttatcataatcctgaactgtgtaatcctccatttctcccactgcagtgtgccacttgtcaggatccatataatacatattatcggataaacaagtaacatcaagctttgccgaatactctccgccaatggattgctgaacaagggaagagtctatacagtaagcaagcgcctttcttgcgttaacatcatcaaacggcgcaacctgtgtgtttaaggcgacaaaaaccgtagaagtctcaaaatcgtgaatgatattataattgctcagcgactcataagtcggaagaacatcatttgtaattccaggtgcaaaatcgatagttcctgactttactgccaatgcgatagtgctggcgtctttcataacatagaagttgatcttgtcgatagcaagattatctgcaccgccccaccaatattcattcttttcaagaactatctgtgagtcagcagcccatgatacaaacttatatggacctgtacccactactgagccttcatttgttccataagcgtcaccttcagcttccacaacagacttcttcaagatctgacatggcgttgttgcaggaacatacttccatgtgctgtcaggctgagtaaggtgaacagtgagcgttcttgttttctcatctacctcaaagctgtcgacgtgctcaaaaagatagctcattccataagcgtcctcacgcacacgatttagagaatacaacacatcgtccattgtaagatcggagccatcggagaactttacaccctcacggatcttataagtatatgtaagatcgtccacctgttcccagctttctgcaagtgcaggtacaacatctgtgccgtcctgattaaaatcaaggagcgtatcgtagcaatcatactctgtgtattcatttacaacaaggtttgcgtcagcaggatcaaaggatacaggctgatttgttgacgcaacattcaaaacaacaagtccgtcttcatttgcaacacctgttccgcctcctgaagtattgctacagcctgtgatacctacagcgagaaacaacgccaacgaacctgctaaaagtttcctgtagtttttcatgataaattctccttttcatataaacttctatatcaatcctcttcatcagagttatgaccttttggataatggcaggcaacaaagtgtccgttgcccatatccttgagttttggtgttctgtggtcgcacaaaccatgcttgtaacggctgcaccttgaagcaaaccgacaaccctcaggcacgtctatggcagtagggatgtcacctttaaggattatctgctccttttgctgaagcggatgttcctttggctttgccgaaataagcgcctgcgtatatgggtgcataacgtttgaatacacctcatctataggacccatttcaacgataacgccaagatacacaacagccactctgtcgcaaagatgacggacaacattcaagtcatgtgaaataaaaagcatagtctgaccaagattttctttaaggtctatcatcagattaagtatctgagcttgaacagaaacatcaagtgccgaaacaggctcgtcagccaacacaaactttggctctgacatcagcgcccttgcaatggcaagacgctgaagctgacctccagagagttcctttggcagtcttgaaagcacatcatcagaaagcttgatatactttaaaaaccccttcatcctattctgatactgttcatcggtcatgcccagaaactttccatattccgcaaacgtctttccaagccgcttctttgggttgaaagatgcaagcggattttgaaagaccatttgcatatcctttctcaggggcttcattttcttctgcgaatatccgaaaatatcctgtccgtcgaaaattatctcaccagaatcgctgctctgcagattaagaacgcattttcctatcgttgattttcctgatccgctctctccgataatgccaaatatctcgccttttcttatttcaaagctgacatcatcgcaggcatggaggtagcttacaccgacctttttgatcgcaggatttccgatcttgaaccatttcttcaagtgtcttacctcaagaatattttcagccattcttttcacctccgtccgacaggaagcacgatgctttgtgacctgccctgatagttttcagcgttggaaattctttgcggcatttatccatacatttatcacatctctccgcaaacggacaatgagtgaacttgttatacaaaagcggcggcgctccagggatagttgccatatactttcctgtatcagcctctttaggattgctgttcagaagcgcccttgtgtatgggtgagccgcattatcaaaaatatcaagcacagaacccgtttcgcatatccttccagcatacattactgaaacgctgtcacatatttcagccacaactccaaggttatgagtgataaatattaccgaggtgttattttctgccgcaagttccttgataagtttgagtatctgtgcttgtatcgtaacatcaagagctgttgtcggctcatccgctataagaagtctaggtttacaggagagcgccattgctatcattactctttggagcattcctccactcatttcaaatggatactgttcataccgctgttcagcaggaagtattcctactttttcaaacaaagtaagcacatattcctttgcctccgcctttttcattttcaactttttgcgcacaagctcagcgatctgctcgcctgctttcattattgggtcaagagatgtcatagggtcctgaaatatcattgcaatatcttttccctgaatagtctgcatctgcttctccgacagcgaaagcacatcaacttctttgccctcgccgttcttgaaaaggatctggcccgaatatctcgtatgcttttcatcatggagccgcataatagatttagtggaaacgctctttccgcagccgctttcacccacaacgccatggatctcgccctcctttacgctaaggtctactccctgaacagcgtaaactatacctctgaccgtcataaaatctacagacagatcttttatttcaattacattatgctcgttcataagaacacctacttactttttatattgctgccttttgacggcgctggatatggataagtctcttttcatactgtttgaatgtcggaagctttctctgtgacggatcgatatactcttgaatacagtcgctgaaaatattaaccgctacggtcacaagcattataattattgcaggggcagcaagaagcacataattgttatagaaattctgcataccattttcaagaagagttccccaatctgcgtcaggtggctgaatgccaagacctaaatagctgagcgttgccatcgctactatagccgcaccgatatccattgtgaactgagcgatcattgtggtgataacatttggaagaatgtgaaaaaagattatcttcatatccgaatatcccattgacttgcaggcttcaacataaaccgctttcttttccgttatgataagcgaacgcgccatttttgctgtcagcggtataaatgcgataccaatggacataacgcctgtgaaatttcctctgccgaaaattgcgataagtatgaatgaaagaagcaaagacgggattgaacagacaacatcccagattctcattataactgcgtcgatctttcctccgtaatatccgcatataagaccgataggtacgccgatgaccacctcaaaggcaactatgaggaaagcattgagcatagagctttttgcacccattataagccttgataaaaggtcacgtccaagcttgtccgtgcctaaaatatgtccttttgagaaagcaggaagaaaacaggatcgtggatcaacttcatttggatcataaggaacaatgacatttgcaccaatagcagcagctattgctataagtatcactatgcctgaaataaccgtttttggagtaaaaaactttcccacctttgaacgtttagccattatccattcctccctacttcatctcaacacgagggtcaaccactgcatagagaatatctacaacaaaactcattataagatatgaaacaagcattacaagcacaagcacctgtactatcggatagttgttttgctggatacctgttaccagcataccaccgataccaggaagcgaaaatatctgttcaataagaacagttgaacctatagctcccgcaaacatatatcctgctactgtaaggacaggtatcacagcgttatgaaaagcatgtttgaatgttttattgaacttgccgagaccctttgcctttgcggttatcatatatggtgcttgaagttgggatatcatgctgcttcgtgtaactcttcccagtgttgcaacaagtccaaccgccattatgatacccggaacagatattcttgatataaactctgctgtattagaatatgttcctatgaaactgtatccaggtacatattttgaaagaaacagaatagcaagaatgcttagcacaaacgtcggtatactcgagaccaccagcataagagtcgacaacgctgaatctatccatgttcctcgcttcatcgccgccagaacacctatcagaatagctatcactgttcctaatatcgttgagaaaagcacaagacctattgttatcggtatcctgtctattatctggttgagtatcggctgcttttgaacgtaatcaattccaagatcaccatgtgcaatgcctttgagccaaataatatactgcttcagcagcggctcatcaaggtcgaactgctctgtatactgttgctgaagttcaggtgttgactgcttgttacctatgataacagtcagcggagatgttggattaagtcttaacgaaaaaaacaccaacaacgaaaccagaaaagttataacaactatctgtatcaattttttcagaatgtattttacataagccataataacacccttttctataaaatgaatttttggattttaaatccttcaaatttatcttgattatattatatactttacagctactgtaatgtcaatatgctagctgcaattttgtttaaaatagcaaaattcgctgtgatacaagcatattatcgttgattttgtatattatttcatcttaaaaatatggtattcgtggcaagcaatacatacgcaaaagaatgcgaccatttctaaaatgcaattttgttaatatgatattgcaaatagcaataataagaaaggacgtctgatttatcaaacgtccttgtatgaccctattttcatcatcgatattctttcaggcatctttgcccaaaagaatatatgacagcttttatcagttgttttcaacgctgcttacagcttccgtaacattgtgataccatttgcgtgatctcagtcgtctttgaccgagaggaagcttaaacagctctatagctatgtgagcagcataaacataccaaatatcgaccttaaagataagcccgagaattagcgtaagcggcattcctatcatccatatgctgcctgcgtccatgagcgtaagataccttacatctccgccgcttctaaaaatgccctctaccttaatacagttcaccgcattaggtatgcagtatatagcaagtacgcacatacagtttctcacacattcgccctcaagggtaccctttattccataaatatgctgaacaggcaacataagagcaacaatgatactgcatgatacaagaccagctatgatagaaatcctattgaatcgatcagcatagcgataaacttttggcatatcggcagaacccatctcaatgcccagcataatagtacatgcccccgcaaagcccattattgcaagcttcgcaaacatctccatggtgttcagtatactcattcctgcatatacttccgtgcctcttgttccatataccatatagtaaaacgaaagacccagagaccaaagcatatcattcgcacacaacggaagcgaagttttaagatactccttgtataatccaacatttaatgttttcaatgccttaaaaaggtttttccttatcggattatctgaaagaaagaaatatagcaaaagtcctatcaactcaacaattcttgcagcaagcgttccaagcgcagctcctgtcactccaagcttcggcgaaccaagctttccaaagataaacatatagttaaaaaacatattgaacatcatacttcctatgccctgtatcatcggtatcttgacattgcctatatttctaaaacaaaagctcacagcatagcatatggcgtcaagcaaatatgataccgccacgatacgcatatatggctttgccttctctataacaagaggatctctgttaaaaagccttattatgatatcaggaaatatcattgccgccaaacacatcacaagaccaacagtaaacgtgaccgttacggctgtccaaattatgcgctgaaaatctttgatatttttttgaccccaataacgtgtcagatatattcctgcgccagtattacagccatataggaaagtaaaataaacgctgaaaaaatttgtagatactcctaccgccgcaatagctgtgctacctaaggtgctgaccatccactgatctatgaaagtgagacattggctgaatattgaagaaacaagcagcggcattatgatactgagaaatttcctgttaaactccttcttctcagctttaaggtcaacgctttccgacagcatatgaatcacccctctcatcatttacaaagccgttacagttccctttcagatgctatgttgtatgccgcaactgcatatagcttgcccgcacattccgcaagattattgagcgaagtctctccagggtcattataatcaagcataccgcatactgaaatgccctttatgtcaagaccaacaagccccgtttccattatctcaacgacctcatgagaagcaaatcctccagcataaggtcttgccgcagatgtcacaaaagcaggatcataaaagttcatatcaaagatcacaaaaacaggttttcctgatacattcttttttattgcagaacccacgtctgaaaacttcatataatccatgtcagaagctgtcagcacatctatacccagcttttctagcctgccaccgtattgtgacattccgtttcttattccaacttcaagagaagaagcattgtcgcacatatcctcttctggcactctaacaagcgcagaacttaccgaaccgccgaagtggataacagccattttgccatacttttcatagcaagcttttatctgcccataagatgtcttatcatctccgccgatcataaagctgcaagctcccgtggaagctatcgctttttcagccgtatatatacattcctcagcggctgcctttgaagaatcgtcgatgataaggtcaccgcaatctccgctctttacgctatgcgccatatcaatgtcaagtccctgatcgcaaaaaccgaagccaaaaatatcacgtctgaaatatgcagaaccatttcttgaaccaggctttgcagtttcatcacactcatatggtaatgctgcaaaaagaatatcataaccatttatatcatagaccataggcgtttccaaaaaacctgttggccccagatctttcagatcatcaaagtttagtttaaatggacattttaccatatctaacaccgacctttcctattattccggctccgcttttttctttgaaagcaaaataacaaactgctttagtatcgccactgcatttatcgcagttatgcctgcgggatcgtaattttccattacctccaccagatcaaaacctacgatatccagccccgcaagaccatttctgattatctcacaggcttcatatgtagaaaaacctcctggcattggagttcctgtaccaggtgcataaacagggtcaagaaagtcaatatcgaaagtgatgaaaaccttagcgtctcccacctgttcctttattctgcggcaagtttcctttattccgatcttatgaagctctctcgccgtgatgaccttcattccgtgatcttgagcatacttgatgcgataagtatctccgccgcttcttataccgacctgaatagaatgttcagtatcaagaatatcatcctctatagcatttctaaaaggtgtgccatgattatattttatcctgtcgccataatcccaagtatcttcgtgggtatcgaaatgcaccattgcgaccttgccatacttttcgctgtaagctttaagttcagcatatgcaataaggtgatcgccgcccagaacgataggcactgcacctgcgtcgagtacctttctgaccgatttcctgataagctccattgtctcctcaacataaccaagcacaacgccgatatcgcccatatccatgccttttaagttagcgaccttatatgagttatcctgttcatatgacaatctgcctgcaccataagcatttcttatcgctctagggccaaaacgacagcctgtcctgtttgtcacgctggtatcatagggcacgcccaaaacaacaaaatcttcaccatcgatatcctgcttatatggaagcccgaaaagcgtcttgatattattttctctgcgctttgcaatgttgtttcgtgtctcttctgaaataattttatcaaacattttcgatcattcctttcttagcatattctttgatgcccgcctttttgcaagccacacaggtaataaattcttttacgatacggctggcaagaattgaagttattccccctgcgtcatagttcggtgcgacttcaacaaggtcaaagccaacaatatcaagaccgataagcgcacgacgaataagctcaagagcttgtcttgaagtaaatccacaggaaacgggagtgcctgtaccgggggcaaaagcaggatcaacaaaatctatatcaaatgtgaccatgaccttattgtttccgaccttttcacggataagctccgccgttttctcaatgcccatatgatgtatatcaacagcatagatatgctcaaggcctgcattattcgcaaaatcaaaatcactctcttcaaaaagtccgcctctcatacctacctgtatagatgttttcgggtcaatgcagtcatattcgatcgctcttctgaaaggggtagagtggtcgtgatgttctttatcagtatcgctgccccatgtatctgtatgcgaatcaaagtgtattatcgaaacaggcccgtaaacatccttataagccagcagttcaggaaaagtaatagaatgatcaccgcccagaacgattggaattgtacctgtttccaaaatagctttcatttcctgtggtatcgaaccaagataagctttctcagcgttccatatatcaagatctccataatcaacgccctttacatatttactcgtatcaatgccgacagcctcgttcatgctgtctgtggaaaaggctctgcgaatcccatcaggaccaaacctcgttcccggacgatatgttgttcggatatcaaatggaatacctataatagtgtaatccgccccagatgtgtcagttgaacttttcaaaccgccatatgtaagctgcacctttttatcagtatttattgcgttcatagaatcactttcctttcttaatttgttgatttcattttacgctatacagttacagtaaagtcaatgctcatttgtaaagaaaaaattaattctatgacaacagattatcctaaagcgttctttattttctgcaaactaaacgtctaaagcacatatcatattattaatggcaaaaaaacaccccgtatcataagacacggggtgaaatttttgttatctattcagatatcctaaactttgcaagaattacttcttctgtgcaatagcagcctgagcagcagcaagtctagcaattggaactctgaatggtgagcaagatacatagtcaagaccgatcttgttgcagaactcaacagatgttgggtcgccgccgtgctcaccgcagataccgcagtggagctttggattaactggcttaccaagttcaagagccatttccataagcttgcctacgccgttctggtcgagcttagcaaatggatcgttctcgtagatctttgcatcatagtaagcattgaggaacttaccagcgtcatctcttgagaaaccgaatgtcatctgtgtaaggtcgtttgtaccgaagcagaagaagtcagcttccttagcgatctcgtcagctgtaagagcagctcttgggatctcgatcattgtaccaacctcgtactcaaggtcagaaccagcagccttgatctcagcgtcagcagtctcaacaacgaacttcttaacatacttaagctccttgatatcatttaccagtgggatcatgatctcaggcttaactgtccagtctgggtgattcttcttaacgttgattgcagccttgataacagcctttgtctgcatcttagcgatctcaggatatgttactgcaagacggcagccacggtgacccatcattgggttgaactcgtggagtgaagcgatgatagccttgatagtctcaacaggcttgttctgtgccttagcaagagcctcgatatcagcctcttctgttggtacgaactcgtgaagtggtgggtcaaggaatctgatagtaacagggttaccctcaagtgcctcataaagagcctcgaagtcagcctgctgcattggctcgatcttagcaagagcagcctctctctcctcaactgtgtctgagcagatcatctctctgaatgcagcgattctctcaggatcaaagaacatgtgctctgtacggcaaagaccgataccctcagcacccagctctcttgccttcttagcgtcagcaggagtatctgcgtttgttctaaccttcattgttctgaacttgtcagcccagcccatgatcctgccgaactcgccagcgatcgtagcgtcaacagttgggataataccatcgtagatattacctgttgaaccgtcgattgaaatatagtcaccctcgtggaactccttgcctgcgagtgtgaacttcttgttagcctcgtccataacgatatctgagcagccagatacgcagcatgtacccataccacgagcaacaacggcagcgtgtgatgtcataccgcctctaactgtaaggataccctgtgaagccttcatacctgtgatgtcctcaggtgatgtctcaagtcttacgagaacgaccttctcgcctctctcgttccaagcctcagcgtcatcagctgtgaatacgatcttaccacaagcagctcctggagaagcgccaagacccttgcccataggagtagcagccttgagtgcctttgcgtcgaactgtgggtgaagaagtgtatcgaggtttcttgggtcgatcattgcaacagcctcttcctcagttctcatgccctcatcaacgaggtcacaagcgatcttaagagcagcctgtgcagttctcttaccatttcttgtctgaagcatataaagcttaccgtgctcaacagtgaactccatatcctgcatatctctgtagtgatcttcaagtgtcttacaaaccttgttgaactcagcgaatgcctctgggaacttctgctccatttcagagatgtgcattggtgtacgaacaccagcaacaacgtcctcgccctgtgcgtttgtaaggaactcaccgaacagacccttagcacctgtagctgggtctcttgtgaatgcaacacctgtaccgcagtcgtcacccatgttaccgaatgccatggactgaacgtttactgctgtaccccatgaataagggatatcgttatctcttctgtatacgttagctcttgggttatcccatgaacggaatacagccttgatagcgcccatgagctgctccttaggatcagttgggaagtcagaaccgatcttagacttgtactcagccttgaactggttagccagttccttaagatcctcagcgttcagctcaacgtcctgcttaacgcccttcttagccttcatctcgtcgataagctcttcaaaatacttcttaccaacttccataactacgtcagaatacatctgaatgaatcttctgtagcagtcccaagcccatcttgggttaccagactgagcagcgatagtctcaacaacttcttcgttaagaccgaggttaaggattgtatccatcataccaggcattgatgctctagcacctgaacgtacagaaacgaggagtgggttctccttgtcaccgaacttcttgcctgtgatctcttccatctttacaatgtactcgttgatctctgccatgatctcaggattgatctcacggttgtcctcataatactgagtacaagcttccgttgtgatcgtaaagccctgaggaacagggagaccgatatttgtcatctcagcaaggttagcacccttaccgccgagaagctctctcatgttggcattaccctcagagaaaagataacaatacttctttgccattggttttttacctccaaaaattttttgaattccgaagcgtgcggacacaattatcccgtcgcccacggttacatatatattataacagatttaaagccaaattaccataggtttttctcacttttatacataaaatcttatacaatatttgctcactttttatgtgcaatatgacagtttttaaatatcaacacataaaaaagccctgctgaaaaacaacagggctgaaacgtctattttgtcggtgaaagcagctgcctctgcagaaaatacctacttatgtccgataccgcagacaaacggcaatatatgacatgccgtacatttataatgcgctgaacggggtgcgccacgcttatttctaagccacctatatcataccatatccgcaagcatttgtcaatagcaaaaatgcaaaataaaaagccctgctgaaatcaacagggctgaaaagtctatttcgtcggctggaagccaagatacccaaaatacctgtgacttatgtccgaacacagcagacaaactgtgatatatgcggtctttcgacacttttattgtagcacatctgcctgcatttgtcaacagcaaaatgtaaaataaaaagccccgctgaaaacagcagggctaaaatgtctattctgtcggctggaagcagccgcattactgcggaaaaataagctacttatgtccgaactcagcagactcgctgaaatatatctggtttattaaacaactatattatagcatatccgcaagcatttgtcaacacctataccacctggaaaagataaaatttcagataatccgtttcaggcacattgagaagtatcgggtggtcaggggcttgctgtcttgcttcaataagcttgagctgaacgcctgcgtcctttgcagcactcattaccattttcacaaacagcctgttctccataaaatgcgaacatgagcaggtggcaagatatccgccccttggcagaagtctcattgccctgtagtttatctccttatatcccctttcagcgcttccaactgtctttctgctctttgtgaaagcaggcgggtcgaggattatcatgtcataatcagccttttcttcaagaagtttcgggagcaggtcgaaaacgtctgcgcaaagaaaatccattctgtcagtcaaaccgtttctctcagcattctccctagccgtatcaacagcgaactgtgaaacgtccaccgccgtaacgtgccttgcaccgcccattgccgcattgagcgcgaacgaacctgtgtgggtaaagcagtcaaggaccttcttgccctttgctatcttcgacaccgcaaggcggttatatttctggtcaaggaaaaatccagttttctgaccgttctcaacatcgacctcatagcgtatgccattctccgttatctcagtgatatttgacggtggttcagggagaaattcagccctataccagcctttgtactgttccaagccctccagctttctgatagcgacatcgttacgctccattatgccagaagctttaactccgtccttttcaagctcttcaacaagaagcctgaatatcatatcctttatcatatccatgccgtaggaaagcacctgcgaaacaagtatatctccatacttgtcgatagtaagccccggcatgccgtcagcctcaccaaaaataagcctgcaagccgaaaaatcgtcccccataacagtttttctgtaatctatagcatagcggatacgtctgcggaaaaagttttccgagaaattttcatttgcgttgtcagataagatccttatccttatcttgctgttaaggctgagaaaacccgttccaagataagagcctttttcagagaaaacatcacaaagctcgccattttccaagccctcaggctcgtttctcagttcgtcacaatacacccatgggtgaccgtttttcagggacatttccccttttttcgatatagtgaatgcaggatagattcttttgcttttcattattatacctcacaatcaagatttgtcgatttgtcagatataattataccacagcatacccatttttgcaagacgatacacaacaataaaaatgtagaggacggcgtcccgatagccatgtcccacagcaataaaaatatgtatcgccgcacccgaaaaatttcagatgcggcgttatatgggggattataacatcagcactttgtattacaaagcgccaaaatgaagaaagtttatttgtccgcagggtcaataaactcgatagggtctatccactgaccgttcttcttcaagccaaagtgcagatgagaaagctctgccacttccgcctgagcagtgtcgcccacagcacctatgacctcccctgcattcacctcgtcgccctccttgacggacatttcctttgacagattgtagtaatgtcctacaatgccgtttccatggtcgatagtcatgcagttgccccacagagggtcgtcccatatctttgtgacagtgcccttgttcatcgccttgacaggctcgccaaggtctgccttgatatcaacgccgtcatgggttttccagtagccgagggtttccgacttcacaagctcgccattagaaaacggctctaatatctcaccgttcacaggcataacatttggctgcgtctgaatgtccacatccggcttggagctttcgtcctttttaacgtccgttttcttgttatcagcctgctttggcgcagtgctgtcaacgctcgaaatagtcagattgtcggtgatatcctccatagccttgttatatgcagctatacccgcaccgccaagagccagcagacacgccgcaagtgtaatgtaaacacccttcgctcccagagccttgcctgcgtgtgaatttctgatactgaattttttcatacacacaaaacctttctccgatatgatttccgcagccactgttgcgcccacggcagtcttatgctatcggcggcataagtcctctggcattatttttgacatatacgggtaaaatattcacagcaaaataaaaataccgcacccaagctttcacccaagtgcagtatttcctatttccgatcacatttatgtaggggacggcgccctcgacgtcccacaaagtccaaattgtccctatccgttttgtatctttcttttgtcctctcagccttacctatcctgcggttttttcctcacaaacttatacacagcccctgcaatagcaagcaccgccgcaactcctgccagacaaaggcagactataacatcatagcggctgttgtcagcacctttcaccgaaaatatctcagacagtttcatgccgttccacgcattgctcagcacagtcattgccactacccataccgcagatgccacaaagcaaagtgcacccttgaaaaagccgttcgcctttagataccttataataaggaacacagcccacaccaatgccacacaagtcaccgttgcaagcatgccgtcacgaaggtctaccacgtcaccgtatttcagcgtaccataaataacgcaggcaaaagtcagtactgaatccgccgccatgcacacaagacccttgctgtttctcacatacttttcaagctgttcacttctcagcacaaaaggcaaaaatacgatagactccccaaggagcgttccaagtaccgccattacaaaccaatccccgtgagaataaatgcaccctgtggcataaaggagcacaagcgagaccgtcgcagaacctaacgtccataacgccctgtttttcttcacaagcacaggcacattgatgaaagaaaacgtcagcatcagcgacgtgataagcaccatgaaccaacctataccgccatgagccacattataaataaagctcggtattatcgccgcaagatagccaattccggttatgatagtgtacccccgaacaaagcgtttatagctccgcaccataaactcagcctctctctgctggcggtcctcgcttgcagtgcaaagctcatgctcagaaatgtgcaagacctcgcatatgcctgatatcatggttatgtcaggataagatatcccacgttcccactttgacaccgccgattccgtcacataaagcgcctttgcaagctctttctgtgataagccaagttcttttctttttgtctgaataaatttccccagtgtagatttatcttccattttcatcgtcgcctttcagcaaaattcagagtgcgctctctatggtcaacattatagcccaaggctttgaaaatgtcaataaaattgggctggactgtcaatcaagccgcctatctacgcactttttcgcatctttttcatcttatcatcactgccctatccacgcccacaaaacagcacaaaaaatcgccctgctaaaaagcaaggcgttgctggagcgggtcagagggatcgcacctccatctcctttcaggaagaaaagtattctggtaattgaaataaacccgcaaaaaatatgaagtccttactcatcgtaaggactttttgtggagcggattacgaggctcgaactcgctacctccaccttggcaaggtggcgctctaccagatgagctaaatccgcatttggtgcttccggacggaatcgaaccatcgacacgaggattttcagtcctctgctctaccgactgagctacagaagcaaaacaatggcgaccggaatggggctcgaacccacgacctctagcgtgacaggctagcgttctaaccagctgaactacccggccattgaaaaaaataacttcaaacttttcgagttcagctctccgagaatgaagaataattattatcgttgacaggcaaatctctttacctgtcacgaaataattggtgggaacaacagggctcgaacctgtgaccctctgcttgtaaggcagatgctctcccagctgagctatgctcccttttagctggcttgttgttttcaggactttgttttgttgtgtccctcacaacagtatctattatacactatcccaccctgtttgtcaacactttttttgatattttttatgttttgtatcattttacaatgctagtccgatatttttaaaaacttatgtgcatttgcaacatcaaagccgcactttttcccttgaaatgggcttttttcatcaggctttcccccaaaaaaaatccgccgagccacacgcccgacggataaatttttttcaagaattattttttatcaagctgttttttgagcttttcctgctcctgctccataagcttcataagttcctccaaggaagctgacgctgtctttgtctgctgtgcaggctttgccgcaggttttgcctttggcacaggctttttctcaggctcaggggctacagtatcctcagttgaagccgcctcgtcaagaagctgtgaagctctctcgtagtaagaacggtctatctcagcacgctcttccttttccgcaggtctttcaaatatagtttcctcgacctcttctacttcctcgataacttcctccgtttcagccttctcttcaccctcaggctcagccttgtggtgagaagctatctcgtcgtcaacgtgcttgcgatgttttgcgatctgctcgccctcgttctcgccgccgaacaggaaatcgtcaagagtaacgctctctgcaggttcttcctcgtcatcgtcctcttcctcatcatctgaagaatgagtagcgatagcaattataagctcgataacaacgagcaggaatataggaacaacagcgcacactatcatgccgaatgttgacgacataaacgtaagcaccttgcctgctgtcatgtaatatgtagaagctacgcccacaacgttctttgagcttatctcataaagctttgcagggtctttttcctgataaacagtgtaaacaacgccgttgttatcgtcagttgaagtgatgtcataaagccagaacacgcttgttccaatatcaggcacgttctcgcacacaactgcctcgcctatcttgtctgtgctaggggtcatgttcgatgtgataacaagtgagccgtcaggaactctgtcacccatgccgtcaccattcattatgtacaggctgtagcctgcaatgctcggtgtaacgttcttgttcttgaaaacacgtcccactcccacaactataagcatttccagaataataaaaacaataaagaatatcagcacgttcttgcctgctgatgacttctgcttagtagcactgctcatactaaaaataacattcctttccaagatatatccaaaatatcatattttatcgcactaatacatttattatatcacaaagcgccgcaaatttcaacacatttgagcatattttttgcttttgagaaaattattcatttttgtaaagtattatcgtgacagtacacagttcgtcattttttatgaccgcatatttcgaggtagaccaatctcccccagcctgactgtatgcacgcctcagcacgtcaaagataacaccgctattctcatcaaagagagtatccacagccttgtcatacatttcactgtcagcacattttagccttgcatatccactgtcagccattgcttccgccacagaacggcacatcatctgaacgacatcatcaccgctttgagcatacagacagtttcttctgtaataatttgcccccgaggaaaatgcctcaggatagttcaaaaacttgttatcgtccgctgtatggtcttttgcacactcggcgtcagtgatgccaaaatagtcatagcggatatagtcctcccctgcatctgttacaggatcgtcccaagtgaggtcaacgttcgtccattcaccgtctatcatgaccttattccacaaatgtggctgaacagctccgccgtcataggctttgcctgccacaggtatgcactttatacctgccttggtacaaagtatctgcatagcctttgcatacccctcgcacacagccttgccctctacaagacagccatatgcagaatagcaattttttgctgtatcgtcatagttacactcaagaattatgctgtcatggaaatacagcaccttgtcataatccgaccagccctgctcaatgcctgcaagtatctccccgacctttttatccagcttttctttctcagcctgcgcttcctcagcggtcttgtcatatgtgacctccacagatgtcacatatccatctccgtcaatgcagatagtatactgtgaacccatatagtcgatataaggacaagccgaagtaagcatggatataaacgcaccgatatcgtccttgcttataactccctcagccagctccacagagctttcaaatccgctcagccctttgtaaagctgtgaaaacacacgtttttcgtcagcacaaagaaaatcggcgatatactctgccgtgtcaggtatctcaagtgccgtaaagctctcgtttctgctgtcaagccctgtttcagtatgtctttccgaactggcttcaacatacgcatgagtgttcacaaaagtattttttgaacggtttttatttttctctcccgttccgcctaaactgcaccccgatgtgcagataagcactgccgctgtgagcgcggcgaccattttcttttttttcaatttttgtcctcgatttttacacaaaattctgtctgtatctttcagcccttagtccgtgacctcttcattatctctttttatcacagccctgagccgttctattttcttttcatgtattgacagcaccttgaactcaacgttttcccaatgcaccgtcaccttttcgttatcctcaggcacatgacccagcaggtccataacgaatccgcctatagtgtcataatccacctcgccgtgatactccttgccaagagcctccataacgtcgtcaaacgctgctgtgcctaccatatcatagcaatcagaagatactttctgtatctcctccgtttcatcatcatattcgtcctgaatactacccacaatagtttcaagcagatcctccatagtaatgataccggctgttccgccgtaatcgtccaccacaactgctatctgtgtcttatcttcagtgaactctttgaaaagctcaccacacttgttgctttcaggcacaaaggttatatctctcatgaactcctttacaggacgttcttttttatcctcttcaaacaccagcctgagcaagtcctttgcgaatataacaccgcttatgttgtcggcattgtcgcagtaaacaggtattctcgaaaagccctcgcctataacaagcttcacagcctccgaaagcgtggaattttcttctatggcaaccatttctgtgcggtgtgtcataacttcacgaacttcgatatcgtcaaaatcaaaaatgttgcttatcatttccgcctgactttcctcgataccgccagtttcgtttacagcgtccaccatcatgaggatctcttcctcagtgacagcgtccgccttgtttgttgacttaacaccaaacagccttaatattcctgcggataccgccccgctcactatcgccaatgggctgaacaccgccaaaagcgccttgtaagccacacagctatttagaataaatctctcgcccaccttgcctgaaatgcaaagtttttttggtattcctacaccaaaagtgcatataacaagggcaagcagacagcttattataacaaatgaacatatgccgataatataatacgaagcctgagtatatacatcaaaaagcttgtgaagcttatttgaaagcggtgcataaaagtagatcgctcccaccaccgaaactgcgattatcataatagaacgtgcaatgaggtttgtcgcaactaccctgcccgttctgccaagcaaagccgcaagccttattgccttcgggtctttgtcctcctcagccattttctttagctttgcgtcattgaactccacagccgcattttcgcacaaggtaagaaaagccataagcaatattaccgccgcacaaacacctattcccgtccacagtcgcccgacatcgtccataaaaaaaataccgtccctttcacataggcgaaaaagctcgccttttaatcatatactatttattataggcaacatatgcttctttgtcaatagatattgtcacaatttttcacattctgcctgaatttcatatgggcaattttagttataaaaaaagcagacgagccgcaaagcccatctgcttacatcaaacaatattatttctctgccgcacctatcttggaaactgcgtccctagtagtgtttacgtccttaaggctctttgtaagcacctcagccgcctcagaaagcgacttgttcagattttcagaaagtgcctcacggatagccttgtccttagccttagcctgctcaacgatatcagccgcctgcttgttagcctctgcggctatctgctttgcatagtcagccgcctgcttgatgatctcctcctgagccacaagcttcttagcctcgtccttagccttctttacgatctcttcagcttccttgttggcctcagtaaggatatttttcttatctcttgtcatatcctttgcacgctttatctcacccggaaggttaagtcttatgctgtcgatgtattcacgcatctgctcaacatcgatcatttttttctgtgaaaacggtacgcttgaagacttgtcaagcagttcgtccataagttcaagtatttcctctaccgtcattttaaacaccctttcattactgatctatattattggcaggcttatagagcctgtcagtgatcttgctctgtatctgtttcggcacaaagcctgtgatatctccgccgaagcttgcgatctcctttacaacgcttgacgaaaggaacatattctctcccgtagtggtgagaaacaccgtttcagcgtcattgtaaagctttttatttgcaagagccatctggaactcatactcaaagtcagacacagccctaagtccctttacgatagcattagcgcccgtcttttgcagataatccgccagcagaccgttataacaatccaccaccacattatcaagatgctttgtgacctcgattatcatttccattctttctgtaggtgtgaaagcagcccttgatttattagcattaaaggacaccagtactatcaccttatcgaaaagctttgaagctctgtcgattatatccagatgacccagcgttacagggtcaaagcttcccgggcaaacagcgatacgcatcaatagtccacttctttcattggtatcttatagaccgtcaaagcggtcttaccgtatttatatctcttatgaagcttaagtctgccgtagctttctcccagctcaagctccttttcatgttcgcacacaatgatagcaccatcattgagcttgctctccacaagctccaaagccttttcaactatgcccattctgtaaggcgggtcgataaaaactatatcaagcccggctttggcaactttaagatattccagactatccatgcaaagcacacgggattccttattgaaaccgcatgaatccacattatccttgacgatagccacagcctcaggattgctgtccacgaaaacgcagtgactagccccacggctgagagcctctatacccatttgaccgctgcctgcaaaaaggtcaagcaccgagcttgctggtacatcaaactgaataatggaaaaaacagcctcttttaccatatctgtagttggtcttgtatccaacgactccaaagttttaagcttttttcctctgcatgaacctgtaataactctcataaaaaataactccaaaataaaagtatacaatcattatactatattaattaccatttgtctagactattcgccgatatttttttattttttataccacacacaaaaagggacttcacagtggaagtccctttagttattttaattacgtactctaagaaacaagtcctcagttaagattactttctcttagaaactacgatagctgcacctgcgagagcgatacctgcaagagcgatacctgctgttgcgcctgtagctgctgttttgtcagaagctgcatttgaagatgtagcagttgttgtgcctgttgtaccagtctttgaagaagttgttgcggctgtgctgttagcctttgaatcagtcttgctgtcagacttagaatctgtcttggaatcatcctttttgctgtttgaatctgtgccagaagtagcaggagcaacaggaacagcgttagcagcccatatccagccctcgtttgttgagccgtcatcgaacttctgagcctcagcgtttacagtacctgactgagcgatagaaattgtgtaagagccgtcgccgttgatagcagtatcctggcagtcaacgtttgtgtcgaatccacctgcgccacctgcgatacctacgcacttgttagggaagtaagctggctgtgcaaccttatccttttctttgtcatctggatttctgaaatcccaagtgccgtcagcttggaaagatacaccagcattgcctgttgtgtcaccaagaccttcaattgtgaagtcaatagtgatgtactcaccagcgcctgctacagtgtagtcagtgatctctgatgtgaacttgctgttccacttgttgatgatctggaagcagagcttgtctgaatcagacttgccaggagcagcacttacgttaaactcctgtgaaccgatctttaccttaagatccttacaagtaacgacctgaccatttacaagagcctcatcgttatcgttgtactcacatgggatatctgtagcgatgaacagatagttgtaagctgttgaatcagcagcgaaagctgttactgccatagctgttgtagctatagctgctgcagccatgcctgcaaaaatctttgtaagtttcatttctaaaacttcctttcttaaataactttacttacattgtactttattttccgaaaaaattcaatcggccgattcaccaaatatgataacgttttcttatgcaatcacaacaatttgtactattgatttttagaagtatagcccaatttccgcactttacaaaacttttttatcttatgtaaaaatactaaaccgtcatttatcaagctttttcttctgcacctttccagtcactttcagcacgatacctctaggagcaaatttagaccctgcataaagtgcctttatagacttctcagggataatgatgagttttctgccgaacattccctcaagagccttttttgcacaaaactgtggtgttatggagcttacgccgaacttgcagtttgcaacgtcattgaactccgtatccacaggacccgggcataccgcacaaacgtgtaccctgctgtttctcgccctcaactcctcatatattgcgctggtaaggctcacaacataagcctttgaagcatagtacgttgccatcatcgggccaccgtacataagccctgccgaggaagctatattcattatataacccctgtcagcggcaacaaagtctttcaaaaacagctttgtgagcatatgcaccgccgtaacgttggtgtctatcattttaagctcagtgtccagaggaagcttgtcaaagctgcccactgcaccaaagcctgcacagttcacaagcactgatatcttctcgctctttgtttcctcataaagccgcagacattcttccctgtcagaaacgtcgcaaactaccacccttgtgttgtcaccaagctcctccgcaagctctctgagcctttcctcacgtcttgcgctgagtatcacacgaaagccccttgcagatagatctctcgctatctctctgccaattcccgagcttgcgcctgttaccaaagccgtcttagccatttatatcatcctccacccttttcagggatattatttgatttttgtcatatcagtatatcacattagtatcaccctgtcaagtgtgagaaagatgtaaaatacgcagaaaagcatcgcaaaaaactgaataaaaatgtcaaaatctcttgacatttactttaaagtatggcataatgttaatataattttaagaaatagaataaaattaaacttgaaagttgtagggagaatttatgaataactatcaaacgggcaatataaagctcgaaaagctcgcaaaagaaaattcagcttttcaaacctgtcagcctgatatgtctgacgtaaactttgagataggcaaaagcagcagcacagttaaaatatttgccgccatagcagctttcgcactgatatatggcataagatttttcttacgccgctatgtcggaaacccgaatgggtcgatgtctgccggagatatcgttttttggtgctttataggcttgataatcgtccttgtagttgtgacaacggtcaaggaaaagaatagtcccactatttcagttatgggcaaaaaactgttctataacggaaactgttggtcaagcgatgagatatctcatgttaaatgcacaaaatggttagagagagtcgaagtgtattcatcaggcaaaaaagtcctgactttcccatgggaaaaggataactccgagctttttatagcttgggtgaaaaagtgcgggataaaatttgaagataaccgtatacacttattctgataaaaatcaaataaaaaaatataaaacagagaacaaggagataaaaaattatgagttgtaccctttgcatacttgccgcaggtcttggaagtcgcttcaaaggcggcataaaacagcttgaacctttcggaccaaacggcgagataataatggattattctatctatgacgccgttgaggcaggctttgacaaggtcgtattcattataagaaaggatatccgtgatgcctttgataaaatgataggcgaccgtatctcaaagtacgtcaagatagattacgtttatcaggagcttgactgtcttccggagggctattccgttcctgaggggcgtgttaagccgtggggtcacggtcacgcagtctgctgttgcaagggcgttataaatgagcctttcgcagtaataaacgctgatgatttttacggcaaggaagcttttgtgaagctccacgattttctctgcaatgaaaactcagatcgcaaaaagcttcatctcggcatggcaggcttcatactgaaaaacactctaagcgacttcggtgcagtgaacagaggtgtctgtgaagtgaaagactctatgctcacagacgttgttgaaacctacaatatccgccgtgaaaatgacggcaaggtctattccggcaaggaagaaacagccgagcttgacgagaactgctatgtgtcaatgaatatgtgggcttgccctgacggctttatagataagctcaatggtatgttcacagactttatgaaagaaaataaagacagcctgacagcggagtttctcctccctgcgggtatcgatataatgataaaaacaggtattgcagactgcaagcttctggaaactcacgataagtggttcggcgttacatataaagaagataagccaaccgttaaagccgatatcgcaaagcttatagaggctggcgtttatcctgaaaagctttggaaataaaactttttcaaacaaataaaacagaataatttgtcaacaataagtcgggcagaacaaattctcccgacttttttgcgtcagtttgtaaaaagtgaagaaaatccttaattcgactaaaaagcacttgaaaaaggctgtaaaatgtgttatgataatctttgaaacggatctgcatttttgcaggtcaggagagataatataagaggtagtataatggagagccaacacggtagcaatttgaaaaatataagaaaaaaaagagccacagcacagcaaagcatagtgtcattgagttgtcttgtgtgcatagcatttgcggcaatatggggcttccatgcaggaagcggcaacagcagggctgtggaagcaaagaagatgtcagcttcaagctctgtggcagagaacgaaagctccgagagcaatgcagacaactcttctcaggcagaaagcatggtcgatgagagtagcatagatgaaagccttactgacagctcagttacccatgatgacgccgacgacctttccgacgcagttttcataggcgactcacgaacagttggtctgcaaaacaactgcgataaaccaaaagcaacgttcctttgctctgtgggaatgcacatcgacaccgttatgacagaccagaacatcaccctttcaaacggcaatgcaggaactgttatcgacgctcttggagaaagacaatatggcagagtgtatataaacctcggcactaacgagcttggctggccttatatcgacaccttcaaggattattatacacagcttatcacaaaaattcaggagatacagcctgacgctgttatctatgctgaatctatcctccctgtaacagcttcaagaagcttgcagggcgacgccataaataacacaaatgtagccacattcaatcaggctatctcagaggtggcacagcagacaggtataaattatcttgactgcacctccgctgtagcaggcgcagacggcactcttccggaggaagcctcctcagacggaatacaccttatgagcgaatactgcgacaagtggctcaactatataatcgacaacacataagaaaggaaagaaaaattatgaaaacaaagaagatactctgcactcttatggcagttatgtgcattggcacagcagcacttacaggctgcggttcagactctgacagcagcacagcaaactccgcaaattcagcggcagccgcccagacaaacgaaagcgttgacgtaacagccgttgcggacaagctcaaggacggcatagagttcaaggacgagctcgcagagcttgacgaagcaaagatagaaaagataatcggcatatcagcagacagctatacaaaggctaaggtctatgtaagctcatcaggaggaacagccgaagagatagactgctttgaagccaaggacgcagacagtgcaaaggctatcgcagatacacttactgcaagagtcgaaagtcagaaaaaggtttttgaaaactatgttccggaggaaatgacaaagcttaatgaccctgttcttgtaaccaacggcaattatgtttacctctgtctttcaaacgataacgataaagcaaaagagataataggctaggagtaataaatatatgcttttttcaagtacaacatttctgttcgcattcctgcctattgtactgataacgtattatatcgtcccacgcataacacgcaatctggtgctgtttattttcagccttgtgttttacgcatggggcgaacctgtttatatcgtcctcatgatagcttccactatcgttgcgtatataacaggactattggcagacaaacagcgtaaaaacgcaaaaaaatacactccgctcatcgcaatgataggagcggtggtgtggaacatcgggcttcttctgttttttaaatataccgactttttcatcggtgcggcaaacagcattttcggcacgcagataaagaccttgggtcttgccctccctatcggtatctcattctacagctttcagaccctttcctacgttatcgacgtttataagggcgaagtaagaagtcagaagaacttccttgaccttgccacctatgttgcccttttcccacagcttatcgcaggtcctatcgtaagatacatcgacgttgcggaacaactcaaaaagcgtaacgagagcatagagcattttgcacagggcgtgtggagattttccataggtcttggcaaaaaagtcattctcgcaaatactatcggcgagcttttcgacactatctcaaactcagcacaatccgaactgagcgttgccgcaagctggctgggcataatagcctatacattccaaatatactttgacttctcaggctattccgatatggcgataggtcttggcaaaatgttcggcttcgactttctcgagaacttcaactacccttacatctccacctctatcacagacttctggagacgctggcatatgtcactttcaagctggttcagagattatgtctatatcccacttggcggcaaccgcaagggcaaagcaagacagtgccttaacatcatgatagtatggtttctcacaggcttctggcacggtgcaaactggaactttatgctatggggtgtgtacttcggtgtaatactcctatgtgaaaagcttttccttggcaaagccctgaaaaagatacctgcatttttccagcacctctatgcacttctttttatagtcataggctggggaatattctcctatgaagatttcggcaagctcacacagaacttcaaaaatatgttcggcgcagggggactacctctcataaatcaccaaacagtgttctggctcgcacagtatgcagtaacaatagtgatacttgtgatagcttcaacacagcttccaaaaaagctctgccttaagcttcagatcaagtgtcctgagatatgcggctgtatactccaaccgctgttcgcattaacacttttggcagtttccaccgcctaccttgcaggtaattcattcaatccgttcctgtatttcagattttaaaggaggacggcagatatgaaaaaacaacttaaaaactatattatgatagtgtgctttctgctgttcatattcggctttgcagtggcaagctttatttctgaggatcgtgaattctccgaaaatgagaaccgctatctccagcaagcccctgaattttcatggaaaaaactcgaaaaaggcgagttcacatcggatatcgaaagctatatgtccgatcagatatttatgaaagaccagcttgtgagtcttaaaacagtcaccgaccgcacgcttctgaaaaactatcagaacggtgtatatttcggcaaggacggctattatctccaagactatcaggaaaacagacctcttatcgagaaaaatataagctgtcttaacgattttgctgacaaccttgataaatccgtcgacgtaagctttcttcttgtgccgaatgcagtttccgttatgtcagacaagctccctgcggtcacacagaccgacgatcagcttgaaagcgaaaagtatataagctctatcctcagcgacaggataaacctctgcttcccatatgagcagctcaaagacgccgcaaagtccacgcaggttttttataagaccgaccaccactggacagccgagggcgcaaaagtgggatttgacgcacttatgacagccatgaatgaagatatcccacaggtatcctacaatatagaaactgtaaaggactttcatggcacactttattcaaaagccccaacagacttctccgctgctgacgaaatgcacttctacacaaaccctgacaacagcgtaaaggtaaattatgttcaagaaaacaaacaaacaaacaccctttttgacgattcattcaagaccaaaaaggataaatactccacattcatgggaggaaactttgccctcacggaaatagaaacaaacggtgaaagcgatgaacacgtccttattataaaggacagctacgcaaacacagttatgccatactttgccgacaagtataagcacatcacaatgatagatatgcgttattaccacatcatggataagacagtcagcgagtatgtaaaagacaacggcataacaaaggtcattttcctttataatatggactttgtgaacaccgataacaacttcatatggcttgaataattcagcaacaattaggggcggccattggtcgcccgctatttttatcacacccatatataacgtcaacgtcaaacccacagaaagaaggacataaaatgacacttaccccctacaaaagaaaagccttttattatgaaacagaccgcatggatataatccaccattcaaattacgtccgttggcttgaggaagcccgtgttgaccttatggaacagcttggctgtccattccacgagatagaggcaagagggatagtttcccctgtcctctctgttgaaacacactataaatatcccgttcgtttcggtgacgagtttgaagtgcgctgtaagctgtcaaagttcaacggctgtgcctacgagcttgactacgagatctttgaccttaccactcagaaaacagcctgccttgcccacacctcccactgcttcaccacctccgaccttaagcctgtaagactaaaaaaacattatcccgatatctacgagaaattcctatccgcatatcaggcaagtgaagaataagcaaaaaaatgtacagctcccgagtttcttctcaggagctgtacttttgtgtaaaaaatgacagacgtgacctgtcacgaagaaagcaatccgtcaacgccctcacgccacttttcaaagctgcacaaaccaagctttgcccagcggcattccgagcatagtatatcaaatgcctttttatccattttgcttctcagccttgtcagcgcactgcgataattctccactgagtgacattctatctctgaaagtctgcaaacttcgctgtctttctgtgccaccgttccgccacagccgtcaagcaaacaaccgtcctccgtcctgtttgggcagtgctgacatatcatatctccgctgcacacaaaccgcaccgcagtgtcctcgctctccaatctgtctttcacagactgcatattcaccgaaaaaccgtcactgtagccttttccctgaaaaagcggcaggcacagcagatgatgaaatctaagctcaggctctcttgtaagcatagcaacctgtctttgcaagtctgcttacaagctcgatgctgataaggtaagcagcaacaacagagataatgtcctttacaagataaggaacagaaacaagaaggatagacttgccaatagagatattagcaacgatagcgtactggatagcaccgagcaggtggtcgcaagcaagacctgcgataccaagcacgatagcgatgaccttaccgcttatcttgtcagagcagaactttgcaccaagaccgcaaagaagagccataacgataaatccgtaaatgaatccacctgtataccctacgataacggaaaaaccgcctgaccagcctgcaaacacaggcacaccgatagcgcccagcagaccgtataccagtgcagaaaccgcaccgcccttccagccgagaaaatatcctgcaagagccacagcaaaagtctggagcgtaacaggaacgtgagtaggaagcggaatagttatctgcgaaagcacagcgattatagcagtcataactccgataccgactatttgttttgttttgtttttagcattgttattcattgtaaacctatcctttactttttatttgacaattaatattgtatcacataccaagtctattgtcaaccaaaaatatttatttcggtatacaattataaggcgtcggtaaacgatagttttatacaaatttaataacaaacagcgaaaacacggcattgcccttccgaatgggctgtcgcatttcggtgaaacagaaattgagccaagcccctacagtttattcgggcaacttcataccaccgcaaaatcgctacgctctttgcggatttacattttgctaagggatagggaaaacggtgcagattttgtgttccgatactacatctatataaagcacaacttctgcgtgctttttctcattaaatctgcacctagtcggctgtcgccgattgaggctttgcctcaaactccacaagggactctgtcccttgaccctgcaagccctctaacgccgggcttgagcctgcgttttatctctcgctccgctcggtgctgtcttttacttcatatttgagcacaactctgttcagctttgccaattcctcattcctcactcctcattcctcacttccccttgtgcattttgctcttaaatcctactaaattgatagaattaatatcagttttcacaaaaatgcgaaaaatcatcttaaacctattgacattcctctatgggtgtggtatagtatagatacgctaaaacatactaaacgactaggattaatatgaatttgaaatgaggcgttgaaaatgagtgtaaaaatactgaaactgaaaacagcgtacgattcacgaatgtgtatatgctgtatgtgttgctgttaaaatcagcataaagttcagtaacaaaaatttttatcggatttaaaaaacatcaatttaatgaaagaggtaatttaaaatgagcgcaataaacgaaagaaatcttaaatttgaaacactccagctccacgttggtcaggaaacagcagactctgtaacagacgcaagagccgttcctatttatcagacatcatcatacgttttccataactcacagcatgccgctgacagatttgctcttaaggacgcaggcaacatctacggcagacttacaaacccaactgaggacgtttttgaaagacgtatcgcagctcttgagggcggcacagcagctcttgcagttgcatcaggcgcagcagcagtaacatacgctattgagaacgtagcccttgcaggcgatcatatcgtagccgcaaagaacatctatggcggcacatataacctgcttgcacacactcttgttgattacggcatcacaacaacatttgtcgatccgcttgacccagctaactttgaaaaggctatcaaggagaacacaaaggctctctatatcgaaactcttggcaaccctaactcagacgtagttgatatcgaagctatcgcaaatattgcacacgcacacaatatcccacttctcgttgacagcacattcgctactccatatctcgtaagacctatcgagtacggcgcagatatcgttatccattctgcaacaaagtttatcggcggtcacggcacaacaatcggcggagttatcgttgaaagcggcaagtttgactggaagaagtcaggcaagttcccacagctcacagaaccaaacccaagctaccacggtgtaagctttgcagacgcagcccctggcgcagcatttgtaactcgtatccgtgcgatccttctccgtgatacaggtgcaacactttcacctatccacgcattcatcttcctgcagggtcttgaaacactgtctctgagagttgagcgtcatgttgagaacgcacttaaggtagttgacttccttaacaagcacccaaaggtagaaaaggtaaatcacccttcagtatcagacgatccaagccagcaggcactttacaagaagtatttccctaacggcggcggttctatcttcacattcgagataaaaggcgacgcaaagacagctcagaacttcatcgaccacctgaaactcttctcactccttgcaaacgtagcagacgttaagtcactggttatccacccagcatcaacaacacacgcagagcttaacgaagcagagcttgcagatcagggtatcaagccaaatactatcagactttctatcggcacagagcatatcgacgatatcatctacgatctcagcgaagcattcgacgctatctaataaaaaccttgccattacggtttttacctaaaaatacaaacctcaatatagaaacggctgacaggcgaaaagcttgtcagccgtttttgtacccataaaaaaagcagggcaacaacaagccgccctgctccataaagcaaaaagtcagaaaaaaatccttcgccacaaggcgataccttaattcctcactcctaactcctcactacttctccagctcagagatcttatccactctcctctgatgtctgccaccctcaaactccgtttcaaggaaaacgtccaccagctcgatagccaagcctgcacccagcactctcgcaccaatgcaaagcacgtttgcgtcattatgcgctcttgtatacttagcagagaaataatccgaacagcaagccgctcttattccctttatcttgtttgcgctcattgacattccaataccagttccgcatatgagtattcccatttcgtattcgcccgaagccactttctcgcaaacttcctttgccttgtcaggatagtctactttctctcctgcctgaataccaaaatcagtgtattccacacccttttcgtccaaatgtgccaatatctccgccttaagctcaggacctgcatggtcacagccaatagcaattttcatattaatttcctcctatttatccctatgtgccttatccttttccgcctttgtagcctgcaaatatgatacctccagcctgtccgccgaaaccattatctcaggctgagcctccaccgcaagacacagcgacgaagccctctgcagcctgttcacatagcttgcaagctgaacattttcgttgtcagcgaaatatttcgcctttatctctgtcgcacagtcacccacaagcattgtcttttcagtgaactctcccgaaaaaacttcctcctcagggcaaactctgtcagcggatatcctcgtgacaacgccgtttttgcactgaaattcgcctgcgtaaactatcttaggccttgccctcataacagaaattatcctgccctcaaaacctatgcagttgtaagccagcgaaagcagagtagaaactcctgcgctttttaaactctcacagccaaagcacattccctttacagccgccacgcctatcctaagtcccgtgtaagaccccgggccctttgcaatagccgcacaatcaaggtcagcgtaagtaagccctgtttcctctagtgcctgcttcaccataggcaatatcacctgcgagtgagtgagctttgtgtaaacagacttctcccaaagaagcttctctccgtccgtcaccgccactgaagcgacctttccgcttgtgtcaatagctaatatcttcaaatctatcatctccctcaggtgcagttatgcttatctccctgctgtcctcgtcaatgcgctgaatatctatcctcaaagcgtcctcaggaagctcctcagcaatattctccgaccattccaccgcaagcacagtgtcttcgtccatgtagtcaaaaaatcccgtggtctccagatcgtccgcagaatttatgcggtacatatcaaagtgtacaaggctgagcctgtccccacggtattcgttcaccagtgcgaacgtgggcgaagtcacctcgtcaccaagtcccatgccaatggagatacccctggtaatagtagtctttcctgcaccaagaccgccgctgtaagcgataagatcgccgcctttcagccgtctgcctatctcctcacccaaagtgatagtttccgccgcagatgatgttttgtatacctttgtcaacctatcacctcatttgaccgtcatcttccgtgtagcccacaataaaaaggctgtttttattcataagctgataaatgctctccacctctgtcttgtccgccgctgaattatagcagttgtaaacatacagcctgccctcctctttaacagcgaaaaccgtatggataccgctgaaaatattcaacccgatatggtaagaaactatcacaggcttgccctcgtcaacagccgcctgagcctcctcagccttataaaatcttttgtatcccactcccattgccttaaaaagaccgcttatttttctaggattagaccccagcgagccgtctgccgcaataagagcattcttttcaaaatcataagcaagcttagccatgtcaggctcaaagccctcgtatgtgagataattataagcggcaatgacctcacagcctacccctgcgaacctggtttcgccaagtattagatcgcacacagggggattttcctgcccgtatttcacaaagccatctatctttatgcccttgttgtgagcataattttccgcagccctgccgctgtcagtttccttgtaagtgtcctcaaaaagccgccacttcatatcgtcctccgagctgtcgccctgaatatcgctctcatcaccgacctgcgagctttcgtcaacgtccatgctgtcactatccaccacagagctttccgcagtagtggtaaaagccgaatcattgagcctttcactgtccgccttgtttccgcatgaactgagcattatcccgagaaacagaatgaccgcaagaattttcatcacagctcacccttgtccttgaagtagtttagcataagatccaccattctgccataggactgcttgccgtcctcaacgccgttgagcttcagagatttttccattgccttgtcagatatctcccccactgcctcgctgtcgaaaacagtgtccttagcctcgtcaacgctccgccagtagtcccagtttgcttccatatcagcccacacctcgtcgcagatagagctgtcaaattctatcttcttatcgtcagaagcgtagtcaaaaatcttgtttctaacctcgccaagcgccgccagatagcccgaatagcggtaatccgcattattcgatctgtcgcacgccataaaggcgataaagttcgcctcgtcctcctgaatgtagcctttcgtatgagcaagctcatggcagatagtgtcaggaagcttcgccttatacatatcctgattgtagttcgcctccatagagaacgggaaatagatgcccataaggtccatttggctcataaagaacgagcattttatagctttcggagtgacataaaatccctcgaggtttttaaattcgcttccaagcccacgcatggcctcctgagccgtcttgtcaaggtcagcggtcagcacgaattttcccttgctgtcacgctccacctctttgctaagcgcatttatctccgtaacaagcttgttgccaagagcttcaagctccgtcctagtgtgctgttcagtgggtatgccattaagctctgcaaagcttgaacaatgataaagaacaaagcagttaaaggtctgcaccgtcaccacaaaagtgactatccacatataaacaagcccgaaaattttcgcagttttctttctcttgccttttctgactatcacaagcaccagcatagccaccagcgaaagcggaataccgaaaactgctaccgcaataagcagttcgccaaaagagaacggcaacagcgaagtgagcctgccatatgtattttcccaaattggaaaaacgtgagccgtataccagtcgcagaacgccgtacttttccaggcgatcacgttcagcacaacgctgactgccacaaggcaaacgcaggcaatgacctgccaggagagatgttttttcttgccgttctcaggcattttcacactttccgcactctttttcaccgctgtatctgtcactgccgctcacctcggttcatgttttttcactctgctatctcaacacgcctgtttacccgacttattatctgcttacctacaaattatcttatcgcacaaatcgtgtaggggcgaacagcgttcgctcgtcttgatcgcctacatggtttgtataaattcaaacctcgtcgctcccaaaaacgggacgtcgagagcgccgtcccctacatttgccacgccgcaaaatcgctccgctcggtatttactctatcaaagtgacttgttcggtcggctatgccaattcctcactcctcacttaaacggcttagaacaatccgtagatattgccctcattatcgcaatcgatattataagccgcgggcttcttaggcagaccaggcattgtcataatatcgcccgtataagctaccacaaatcctgcaccggctgaaagccttacatctcttactgttatctcataattctcaggcttgccaagctttgtcgggtcgtcagacagtgaatactgcgtcttagccacgcaaacagggatatccccgaatccaaggtcagtgatctcctttatagccttttcagcctgctttgtatagatcacgccgtttgcacggtatatctctttcgcaagtatatcaagcttatccttgatagggagcttctcgtcataaagtggcttgaactcagacggctttgtttcgatagtcttgcaaaccttttccgcaaggtcgataccgccctcagagccttttgcaaaaatctcagccagtgagaactcaacacccatttcaccgcaaactctctcgataacagccagctcagcctcagtatcagtatggaatctatttatagccacaactacaggcacaccgaacttgtgcatattctcaatatgagttttcaggtttacgatacccttttcaagagcctcaacattttcgttagtaagctcagttttcggaacaccgccattgtatttcaatgcccttacagtagccaccagaactacgcaacttggtttaagaccagcgtatctgcacttaatatcaaagaatttctcagcgccaaggtcagagccgaagccagcctcagtgatagtgtagtcagcaagcttcaaagcaagctttgtggctcttactgagttacagccgtgagcgatattagcgaatggaccgccatggataagcgcaggattgttctcaagcgtctgaacaaggttaggcttcaaagcgtctttcagcaaagcagtcatagcaccgcaaccgcctatatccttagcataaacaggctttccgtcagttgtgtaagcaacgagtatcttctcaattctagccttaaggtcagccagatcggaagcgaggcaaagaatagccattatctcagaagcgacagttatctggaaagaatcctctctaggaataccattcacctttgagccaagaccgataacgatatctctcagcgctctgtcattcatgtcaaggcagcgcttgaaaagtatccttctctgatcaatgtgaagctcatttccctgctgcatatggttgtcgataagggcgcagagcaggttgttagccgcagttatagcgtgcatatctcctgtgaagtgcaaattgatgtcttccataggaacgacctgagcgtatccaccgccagccgcaccgcccttgataccaaaaacaggaccaagtgaaggctctctcagagcgagcatagctttcttgcctatcttgttcatagactcagccaatccaacggaaatagtagtcttgccctctcctgcaggcgtagggtttatagcggtaacaagaataagcttaccatctggatcatttttagttttagcataaagcgactcagaaagcttagccttgtagtgaccataaggctcatattcatcttctgagatgccgagcttagcagcgacctccccaattttgagcattttcgcctgctttgcgatttcgatatctgacagcatttagatcaagtcctttcggaaaaatttttagtatatcggtaaagacccatataaaatatcatacgctatatattatatcacatatccgtgatgatttcaatatttcatatgtaaacaaactatataaaccgacacatttccgaacatcgccccacaaaaaaagagccgccccgcattccgcaggacggctcaaaataactataagaattatttctgaatatcgttatcgttaaatggatctccacattccggacagaacttaggaggatttttcggatcttcaggctcccagccgcacttgtcacacttgtaaagcggctctgatgcaggctttggctttccgcactcagcgcagaacttgcccttgttcactgctccgcatgagcaagtccagcctaccggctgctctggctttggtgaaccgcagtttgcacagaactttcctgtgttctctgtgccgcatgaacacttccagctgtctgctgccggctttggctcaggcttaggctgtccgcagttagcacagaattttcctgtgttttttgttccgcaagcacaagtccagccgttctcaggtgcagcctgtgttggtgcagcctgtgttggtgcagccgctggtgctgcctgctgtggagctgcctgtgcagcctgctgattcatcatgttctgctgcatctgctgctgatacattgttgcgtccattggctgacccatcatgccgcctgccatgcccatgcccataaagcctgccataacaccgtttgagttgcttgccgctgcctctcttgccttgttgatagacattctgtccatagcatagagcattgaaggatcacttccaacagtttttgcctcctggaattttgcgatcctctgctttgactcttcgtccacgttcagctcaatagcaaggcttgttatcttaacaccctttgtagcccacttttcttcaagctctgcattcattgcttcagcaagctcatcaggataaagaccaagctgatcgtatggtattttctgagcagatatccttgtaagagccttctggaacttaggtgtcatgtcagccttaagctggccgagaactgccacgccgtcagggctgtcaacagtaagtaccttatttacgttctgaacaacgttctcatagaagttcatagggtttacgatctgaagttcatactgaccatgaccctgtgcgttaagagtgaggttcatttcgccgtctctgaatggtatcttgccgaagcctatcttgtttccaggcagaggtctgaggtttatgtagataagacgcatggtgttcatagcctgaccacctgctgtaaatcttctgcctatctccttgatagaagcgccaaggtcaccccagccgccgccaagaagtgacggagatacagttgaatcatacttatactgacctgctgtttcctgtgtaccgataacaaaatcgtgtactctgccgttctcgataagcaaagccgcctgatttaccgcaacgtcaaagcgtgaaccgtttgagataacgccctctgtgccgttgttcacagtctttcctctcttaacaagagtagccggctggcagagtatcttagttgacatatcctcacatctgaagtactctactacctgatcggcaaatgttgagccgactgctgatgtaaacatcttaataagtcccatagttaaattcctttcgttgtctgtattatttcaccccaaggggttttaaacttgtctatctcagcatggatatcctgctgactttccatgtgcgctctacagagctgtgtatctcagaaccgcagtaaggacaaactgagcctgcggtgtccacaggtgctccgcagaactgacatataaggctggcgttttcgccctctatccccattgaaagatagtatgaataatccgcctcataaatgtgctgtgcctttatcccgttgagcttgtattcaagagatacctgaaactttgccgttgcagcgtcatgatctctatgataagacgccacctgcgacttgtggatatgtatatcgtcataatgctttggcgtaaccgttgacaagttgtcttttgccatcgtggctgctctctgcttgaacgcttcggtacagtattcaagctgattctcgcttgcttctccgtttataacaagaaaatatttcatcacagtgttttccactatgctctttgctatattttcatcatagtcaggaaaatctctctttatgttgttcaccacattagggtcaacataagtaaactgcatggcgttgttctgtctttcctcagttgcgtcatttatggtccttagcaggtcgttggcacggctcagttgtctgccaatggcgttcgataccgcttttttcacagaatatatcactgctataccaccgcctatagcgaccgctataactattatttttattataagcgccgttgatatttcaggcatttagctgataccccctactagaatattcccattatctgaagtatagctccgataatatatccgcccacgcctccaagaagcgagtaagccacaagctttcccttgcttataggcaggtttccgataaatttacctgtctgaccattcattgcaaagaaataaggcttatcctgataggtagtatacaaaagccatgttggaagcatagcgtatttaacgtcctttatctcggtgtgcttttcatatgactgaacgtttacgctgttgtagttacaagtatttctaagttcgtcacgagttgtgttctcgatacgttctttagccctaggcaggcacttatccttatcctcgtcatatctctctgcaagatatcctgaaagataacctgggttgaacgctgtcatttccgagtaatcaaaaggctcaatagagtccatagcgtcatcgtcagtctttgaagaagcgtccacaggaacagctttgaaatcgagggttccgtttctgtaaactgaataatactttttctcagtgtatctgtagtttccggaagtccatgttcttgtgtttataccctccgcagtaatagagccttcgcagtttcctgaatagagccaaaacgggatataaacgccctgcatcttgtccactaccttgtcgcagctgaaatctttcggtgtaagaggcttcttgctgaattttttgaaagcgtccattacctgatttttcggcactttaaaaggtataacatagtctggggaaaagttgtcgattatctgctctcccattattaccgcatttccgcagtaaacgcaaactgttgctgcagttgagcggtcggtgattatctccgctccgcagtgtgagcaggtatactttacaaggtcatttcctacagttccgtcatttgacatactgtattcgtccttatcgacctcttcatgcttttcaacgttatccttgttcagttcttcagcctttttagcgtcaccgcctgcttcttcaaggtcttttaaagtaaactgtccgtcgcagtattcacatgcccagcagtttttgtcagcactccagaaaagctctgctccgcagttagggcatttataagaaatattaacagccattttccgtaccccctatcaatcgtcttttatcttagtcttatcagtggtggtacgcagataggtgtcgttacgcccagtgagtttaagattactctttatgtatttatctgccttggtagctttctgttttgtgcggctcattgaaacaagcacaaagcctgttataagtcctcccggtatagcaaagcacatatttgttcccacgctcacactgctgtcggcatatgccatgacaggggtgaaaaacaaattgcaggaaataagtgcaaagcctaatgtgcggtatagctttttcaacattttttctcctcccaactccatattttacataaaactaaaatatgttcacatatattcatgataacagaaaacgctttttatgtcaagaaatatgtcatacaacgttcaaaaaaaattcttttttgtccatttaaacatatttttatacctttcattggtgtttttaacgattaacagccgttctgtcaggaatcagcgttattcagcggttttctgctcgtcaaggtcaagagatatcagagggtttgcgtcattagccaccttaggcagaacgccgtcccacttatcgatggtctgatactttataagctcgtttgaaagagattcagagatagttttgttggcttctgcctgagcttcagccttggtctttatggaagttgcctcagcgtctgcggcaataacctttttcttagcctccgcctcagctacaactatagcctgctcctgctcggtctttgttttcaaaagattctgctctgctacctgctttgcctctatggcttcattaaattcagatgagaaatcaaaattcacaatgttgaatttctctatctcgataccatattcatccacctttgaaacgagctgtgcctttatttcctcgcccacctgcgctctgtcagtgataagctgttcagccgtatattttgcacataccgacttcatacattcctgcaccgttggcataaggataacgttctcgtaatctgagccgatattcttgaaaatgcttgcagaagaagccgactttattcggaagttcaccgctatggtagagttcacagtctgcaagtcctttgaaactgcgtcagcgtcagcctgataaacttgtatcttgtttgacactgttgttacacgctgtgcaaaaggcactttcagatgcaatccttcgttgagtgcagtgtctgataccttgccgaaggtcgtcacaacgcccgtacagcctgccggaactatggatacagaggaaacgaccactattatagccgcaactgccgccgcacaaatgccaacgatctttcctgtttttcttgttgaaatgtcaatgaccttttctttgctcatgattttttcctttcgtataaaacaaagtctttcgacttgcagtctaaccaaaggctttctgtcctttggtttaatatgattatatcataagccttacaaattagcaaagtccgacaaagttcggggaagtcagcggaagtcagcagtgaacagattttttgatttagctcgctgtatctcttgcaatctcacctattctcgttcgttcaaatccgctcgttatttatgggcgaaaaaattcggcacaggtctatagccatatttcaatatatgtaaaagctaatatgtttatatcattgcctgcaaaaaaggcataaaaaaatcggactcattttactgcgtccgaattgtttatcaatgtattgatgaacaagcgggaggcccaaggtcgcccctacagataggtttgttagctctttttctttgcactggattttaccgctgtgaaactccacacaagtccagccgcgatccagaagtatggtgatgaggtaacagaacttatgttgaaaaacgcctgtatcagatagcaaagaaccgccgctgacactgcacagcctgtccagccgtttttgtctttcataaagcctgctacgagcttgcacatttttactatagtcataataaggaatactattgtaagtgcgaaaatgatgagtcctcttgactgcaaaaggtcgatatactcattataagagcggtctattatagcacccgactcgaatatcgttccccagttgtctggaccggttccccagataaggttttgctcggcagtatacattccgtcgtcccacagataaggatatatccactgttcggtatcatcgcctctgcctgtgcctgtgatagaaagtctgtcgaagctgtcatggaagattattttctcgtccataagtctgaactcgtttgaggcgaaaagtccagcaaagatccctcctgcgactataaaagccacaaggcaggctataaaaggcttcttatcctttgcaaagcccgactttaccgcggcaataataagagatataacataaaccgcaccaagtcccaagatagcagggacaacgcaggcgaggatatcagccgctgtcataagggcaagggagatagcatagaatatctttcttgcctttttatcatcatatagcataccattaagcgcaaaagcagatatcactgtaagcactgccgccaatgcaaaaggcgtacacaaaaagcctgttgcgatatattcctttgtataggtcataccgcctgatgagaagcccgagaatatctctttgaaatagtttggaactatttttgcggtagcaggtatagcctgcaaaattcccacgatagcttcaaatgcgcctattcctacgataaagtctgaaagctttatcctgcagtcgtcagccgtaactgtcattcctgcggcaaaaagtccccaatagccaagtatggtgagcataccctctgagcggtcgagatagccgtagaaagatgtgaagatatccgctgaaagcaagcaagataccaccgacagaagcaccaccgcaagtggtacgataaggctcttgttgtctttaagctccacctgctttttcatgttggcaataaggaaaatgataaatcccacaaagccgaccgcaagcacagcggcagatataaagaatataaatttttcgtttagataaagagtacggttgacgctttcgtccataccgtatttgatattctgtgtgaaataatacggtattgtgataacacacagaacaagcacagcaataatgctgtaaactccgcacagcttttgtgcagactcggcagacatattcagaataaaatccgacttttccgaactgccgaaaaggtgctttttaccttgattggtagtgacctcttttttctcttttgcttttgacataaaaaatcccccaaaaagcatagatattttattattttatgattgaaaattaaaaatcatcgccgcaggcgataccttaattcctcactcctcactcctcattcctcattaaaaacagagcggggaaataaaaaagcaggcaaaccctaaagtctgcccgctgtttacacaatttactttgcgtattcgatagctctgctctcacggataagattgaccttgatctgtcccggataatccatttcagtttcgatcctcttagcgatctcacgagcaacgagcaccattttttcatcgttgatcttctcaggctgtaccatgatacgaacctcacggcctgcctgtatagcaaaggatttctcaacgccctcataggacgtgcagatctcctcaagcttctggagcctcttgatatagttctcatagttctcgcttcttgctcccggtctagcggcgcttattgcgtctgccgcctgaacaagtgccgcaacaacagttcttgtttcaacgtcgccatggtgagcctcgatagcatgaataacttcagggctttccttgtacttcttacatacgtcaacacctatctgaacgtgcgagccttctatctcatagctgagagcctttcctatatcgtggagcagtcctgctcttcttgccagatttgcgtcaacgccaagctctgacgccatcattcctgcaaggtgagcgacttcaatagagtggttaagcacgttctgtctatagctcgttctatagcgcagacggccaagaagcttaacaagctcgtggttcacgccgtgaacattggtttcgagaatagctctctcgccctcctgcttgatcttcagctcgacttcacgcttagccttttctaccatttcctcaatgcgtgtagggtgtatacgtccgtcctggataagcttttcaagtgcgatccttgcgacctctcttcttacctgatcaaagcacgagatggtgatagcctcaggggtatcgtcaatgataagatcaacgcctgtgagagtttcgatagttctgatatttcttccctcacgtccgattatcctgcccttcatctcatcattaggcaatgcaacgactgacactgctgattcagacacctgatcggcggcacaccttgagatagcaagcgagatatactgtctggccttagcctcacagtcatccttcacctgattttcaaagtttgtgaccctcacagccttttcatgcaccagatcctcgtccagctttgaaagcagataatccttagcctgatcaacagtgaactgagatatcttttcaagcatatcgagctgtgacttcttgatcctgtcagcctcagctaccttttcgtcagcatttttcagcttgttctggagagtttcttcctttttctccaaattatcgagctttctgtcgatagactcctctttctgctgaacacgtctttcctgtctggaaacttcgatccttctctctttaagctctttttccgtttcctggcgtgacttgtggatctcgtctttcgcctcgatcaatgcctcttttttcagagtttcagcgtttttctttgcgtcgtcaacgatacgctctgcttccttttccgcagagcctacagcagcttcggctgtctttttgcgatagcttataccctgtttgaagcagataaatccgctcacaccggcaccaagaacaagagcaactacacatagtagaatagcaatacctggttccatgtatagctttcctccttcttagaaagtatggatatccatattttgtgcgtaaaaaaacgcatgaaaaaagatatccacctgatattaaattgtaaagatacaaaattgcaaaatttattttataaaaaacatcagaataatacaaaaaactatacttcatctttcagttatataaaaattataatgcataatattattgtataataaaacttctctgttgtcaagaatttttttagttaaatccacaaaattatatattttctaacaaaccccttgacaagcgggtgaagaggtgttaaaatgttagtcgaagcaaaagataaagtcttttgcagttatacttgaaagctttgacggggaagcccctcggcgaaaggtcttttcagagagcgccgcacgtttttatacgagctgtgagcggtgtaggactatgcagagtgaggataccgcccctgagtgcgtttaatacacgccgcaggctcagcgttaaaggagcaactaatgagttgtgcaggaaactgcgcatgaagttgggtggaaccacgatatcatcgtcccatagggtatttgtatcctatgggacttttttgttatgtaagagggtgatgatactatgaaagacaggaaagccatgaaaacaaggcgtatccttgcgatcatttgctataccattgggttttgcgcttatggtgcagcgggatatgtttgctggttatcatggaacgggactatatccgacaagcaagggtttctcacctttctgcccatatggatagtatcatactggttcaacacatttttctctcagcttgtttgcagggtgaaaaaagacggctccaggcaatgggctatcaaaaaaagggcaaggcacgttttgagcgacatttcaacggtgctgagcgtagtgcttctttgcttctggatatatgtgtatgtttcgcagtatactgaactgctgaacttcaaataatatgactgtaggggtgacctgaggtcgcccgcaaaaaacttgtgatatgtgacgcattacaaaaagaaacaacgtgtttatacacgttataataaagaattacaatattatataaatcggaggaatcaaaaatgatcaagctgaaattaaaagacggctctgtccgtgagatcgaaaaggcaatgcctgcaagcgagataatcaaggatatcggcatgggactttacaaggctgcctgctgcgtaaagctggacggcgaagttttcgacatgagaactgtcgttgaccatgactgccattttgaggtcatgacttttgactcaaaggctggtaaggaaactttctggcacacagcttctcaccttatggcacaggctgtaaaaaatctttatcctgaggcaaagcttgcaagaggccctgctacagacacaggcttctactatgattttgaggtagaaaagccttttacgcctgctgaccttgaaaagatacaggctgaaatgaagaagcttgcaaaagagggctatgctttggagcgttttgagctttctgctgacgaggctataaagctcatggaggaaagacacgaagattacaaggtagagcttatccacaagcatgacgataagggcgaaaagctttcattctacaagcagggtgatttcgttgacctttgcgcaggtccacacataatgagcgttgcgcctatcaaggctgttaagcttctttcatgcacaggtgcatactggggcaaggcagaggacggcaagcagctttcaagaatttacggaactgcattccctaaggcttcaatgctcgatgagttccttaaacagcaggaggaagctaagcttcgtgaccacaacaagataggcagagagcttgaatatttcacaactgttgattgtatcggtcagggacttcctgttatgcttccaaagggcgcaagagttatccagcttcttcagcgttgggtagaagatgtcgagcaggcaaagggctgtctgcttacaaagactccgcttttcgcaaagagagatctttataagatatcaggtcactgggatcactatcttgacggaatgttcattcttggcgacccttatgatgaggaaaaagagtgcttcgcacttcgtcctatgacttgcccattccagtatcaggtatttcttaacagacagcgttcatacagagagcttccaatgagattgacagagacttctacgctgtttagaaacgaggacagcggtgagatgcacggtcttatcagagtaagacagttcactatctctgagggtcactacattctcagacctgaccaacttgaagaggagttcaagggctgtttggagcttgccaagtatttccttgacactgttggtctgcttgatgactgcacattcagattctcacagtgggatcctgctaaccctaagaacaagtacgagggcacggctgagcagtgggagcacgcacaggctgcaatgaagactattcttgacgaccttggcgttgattacgatatcggtatcgacgaggctgcgttctatggtccaaagctcgacattcagtacaagaacgtttacggcaaggaagacacgcttgttactatccagatagatatgcttttggctgaaagatttggtatgtactatgttgacaaggacggtcagaagaagcttccttacatcattcacagaacttcacttggctgctttgaaagaacacttgcttatatgcttgagcatttcaacggcgttcttcctctgtggctcgctcctgagcaggtaagacttcttcctatcaaggagggtcatgctgaatacgctcagaagatagccgacagaatgacggctatgggcatgagagttactgttgacaacagagatgagaacattggtactaagatcaaggccgcaagacttgagaggataccttatatgctcatcattggcgacaacgaggtaaacagcaacactgttactgttcgttcaagaaaagagggcgagcttcctgcaatgcctgttgacgagcttatcgctaagcttgatgaggagataaagactaaggctaagtaatcggtagcaaaacatcgaaaggtgcgtaaaaacggcgtttgtggcaacagacgggacgtcgagggcgccgtcccctacaaattaatgtatgggcgaaaactgttgtgagccttgccaaacaacaattttcgttcgcccgttggcttttgctgtcaatgtgttttatacagacgttttatgcgataccgcacagggggagtttctcttgtgcggcattgccgtttataaaatatggggcggacaggataagatccgcttcgggaaagaggtaatagatgaaatcagatatgatctggacgcttgtggcatttgcattctatttggcaggaatgcttctcataggtgctgcatatatgaagaaaacaaaaagctccgaggactttttccttggcggcagaggacttaacggctgggtagcggcactttctgctcaggcttctgatatgtcaggctggatgctcatgggtctgcctggcgctgtttacgcattcggaacagggcagatatggatagctgtaggtctgcttatcggcactatacttaactgggcgatagtttcgggcaggctgaggagatacactatcagggcgaacaactccatgacgcttcctaagtatcttgaaaacagatttgaggacaagcacaagataatgcttttggtatcgtcggtggcaatcgtcatattcttccttgtttacacagcgtctgctctttcggcaggcggaaagcttttcaactctatattcggtatcgactacaagatatgtcttactatcggtgcggtagtaatacttggctacactttcatgggcggattcatggcagtatgtgtaacggactttgttcagggtctgctcatgctggcaggagttgtgactatacctatcatcgcatttttccttgttggagcaggaaacgttatggacaacatcactgcaagcggtgttgaggcacatcactatcttaacatattcaatgatgaaaagggtcagaccctttcagccatcgacataatctctcagctcggctgggcgcttggttatttcggtatgccgcacattctggtaagattcatggctataagctctgaaaaagaggtaaaaaagtcaagagttataggctgtgtatggtgtgctatatcactttgcttcgcttgctttatagctatcgtgggcagggcttatcttgtgcctgcacttgcaaacaacaagtctgagaatgttttcatcgagatgatacagaaggtattcaactccgatatcggtctgccattcgtcggcggaattttcctttgcggaatactggctgccataatgtcaacagctgattcgcagctgcttgtaactgcctcatcggtatcggaggatatttaccactcatgtattgcacctaaggcagagagcaagaaggtactgcttgtgagcaggataacagttcttgctgtagcggtagtggcatacataatagcacttgaccctaaaagcagtataatgggtcttgtttcaaacgcatgggcaggtcttggagcttcgtttggtccgataatacttatgtccctttattggaggagaacaaacctcgcaggtgcggcggcaggcgttgccagcggtgcgttatcggtaataatatgggattacatacctcttgcaggtggacagactttaggtgacaagacggggctttactcattggtagtaggttttgcggtaagtcttatacttattattatagtgagcctttgcacaaagaagccgtccgaggaaatgctgaaggcatttgatgatgtcaagaacggtgtgaactgcggttgtgatgaaaaagcataacaaagtaaaaggtccatgggtacgcccacggaccttttgtattttatcttttagctatcatacttttccttattttcgcatctgaattccgtaaacaccgctttattgcctttatcctcatatttctgagcgtaaagaccaataacaactcccgtgaaattacctgcaagctcagtagacaaaaacttcgtttgtgctccgcccaagtctatatctcccgaaagcgttttcgccgagaaattgtatgtaaagttggaagcattacagcaaagcacagccgagttttctccctgtggcaatgctatgacatgatcctcatggcgaatatcgcctatgcaaagtctccggaacagctcgacgcctttatctgtgcgtcttaacgctatctcataatgctgatctggggtcatatagaacaccaatcctgcttcgccctctgttatctcgactttgcactccacgtataaattcatttctttctgtcttatgcagataaaagcaggcgagccgtctgcctcaaagatcgtatgctcgtttggcgtaagctcaaagcgttttttatcgagcttataaaggttcatatcggggttttgcataaagcaccactcacgtccgactttggtattctcgaaagtgtattctttccaaaactcctgcctgatatccccgagtctgtcggtttcaacttccttgcgagttgtgccattatctcccattgtgaaccagccgttctcgtcgaaagtcactggtacgagatagacttctctgcctgtaatgtggtgcatcacccacatatttatcattctgaacgcaaggtggacgcaccagaagttgccgttttcgtcctccacaaggtcaccatgaccgcacccttgtatctcgtatccaccaagatttctgtttgttagaactgggttgtgaggataattctcaaaaggaccataaggggtcttacctttggcatagactatcatatgaccgtattccgtgccgccctcagccgccataaggtagtattcgccctttattttgtagaggtgtgggctttcaaggaaacgtccgcctgcacctgtccatatggtcttgcttggcgtgagctttttgcctgtttcgatatctatttcgcactgtgtaacgccatggttgccctcatcgtcttcaccattggacataaagtaggctttgccattctcaaaatacagtgacgggtcgataccgccctgctgaacataaacaggctcagaccattcaccgtggatatcgtcagtatagacatagaagtttccgccatttgtgacgttagtcgttaccatgtaaaatctgccgttattgtatctgatagttggggcatagatgccgccccaagagcctgcgccctccaatgggagctgactttttcttgtgagaacatgacctatctgcttccagttcacaaggtcgtcgctttcatatagaggaacgcccggaaaaaactgaaaagagctgcaaacaagataatatttgccctcagccttacagatgctagggtcgggataaaagcctgatatgaccggatttatgtacttcatattgtgacctccgtttatattttacagatattataatctatttcagatggcttttcaatagcttctcgtgcagtatgagtgaatttttgtgcaaatgaaaaaaacaatttccgtttacgattttggaagtgggtagtggcgatcaattggtacggatatctaggcggaatagtagcttcgatgggcaaatgctgttctctcctatagattttttgcggggatatatgttaagttaaacgtttttgatagcgtgttcagtataaaagttacaaattgtaatttttgctccgacatttgttcgtatggcatataacagtctatatttgggggatatatttgaatatagaacttgtgtttcttgtgaaaacaaacaaatattttagtcatttcggcaaaaagcgataaaatctgttgtcaaattgtaacctttatgatattatgaagttgatatacgaaaacgtataagataattctgtcagttagggggcgtttggaatggaaaaggggctgaaaaaagttttttcggctatgggcgcagtattttgtgctgttatgatgatcatgctttgtcaggtgacaaatgcggtgagctacagcgaacagaccgtcactgtggactatgattatcaggtcatagactcttttgagggcgttgacgctaaatacgttctcggctattccgacaccggttattattgctgtgcaggatatgtttcacgtttttatgaagaaaagttcggcgttacagtatacaacataaacatggtggacgacaagcctagcgtgtactgctacggcaaaagggcggagcttcgtgaagtgaaaactccgcaggcaggggatataatgcaggacaaggattactctcatgttgccattgtaaaggactgtcagggaacgacggctactcttatcgagcagaactacaaatggacttggaacgacactgtttacactgtgaaaaacagaaaggtacttactaacaatcactatttctacagactttacataaacggcattgcgcaaagccttgacatcgacacaacaagacctgttatcgcaaacgcaggctgtgagaacatcacgggaaaaggctacactgttaaagcggatatttctgacaacagggctgtggcttcggtaaaggtatccacttattttgagggcaacaagacaaagactataagccgtgtttacacatcggcggtgaactcgctttcacactcagtaaaggtagctgaccttgggggcaaggacggatattatattacaactataacggctactgacgaggctgggaacagctctgagcaggtcataaagacttatgttgacacaactgcgccgaccatatcgggggcaaaggtggagaacatcacagcaaagggctttgatgtttcttgcaatgtgagcgacaagagcggagtttcaaaggtagtcttccctgcttaccctacaaaaaatggtgaaagtgcaaagaaatacgcaagcggaaagctttcgggtggcaaggcttcggcttatgtttctgctgaggactattcagtaaaaagcggtgaatttaccgttaagataacggcttatgacaaatacggaaacagctcagcaaaaactataaaggctagcataaagcctgcggcttcggtaacattggataaggattcactgactcttgacaagggcaaaagcagtgttatttctgcaaaaatgggtggtggaagcggtctgacggactttgtttcctggaagtcttctaacagcaaaattgcttctgtgtcagacggaaaggtcactgcaaaaggggttggcagagcaactatcacggcatacacaacaggaggaaaaaatgttaaatgtaccgtcactgtaaagggtaaaatcagtgacagcagtatttcggctataaagacgcaaagctacacagggaaggcggtttctcctgtgcctgcagtgacatatggtggcaaaaagcttgtaaagaatactgactacactgtgagctactcaaagaacacagccataggtcaggcaagcgtaaaaataacaggcaagggtttatacaaaggcacaaaaactgtgaacttcaacattcgtcctgccacagtgacgaagctaaaagtttcttccaccggtgaaaagagcgttaagctttcttggaaaaagattacaggtgctgacagctacgctatatacagatatgacaacacaagcaagaaatggcatagaataaaaactgtaaaggctgtgagcttcactgacagcggacttgctcgtgcaaaggggtacagctacaaggtaaaggctgtgaaaaaatctggcggaaaagaatacatttcggctagctactcaaaggctgtagaggctgtcacaaagcctgctaaggcttcatgcacggctaaatcatcaggcagcggcagcattgaggtatcatggaaagctgttgggggtgcaagcggatatgagatatactcctcttcaaatggcagtgattatgtgaagtcggcaaaggtgggtggctctcaaaagagtgctatcgtatcaggatttgagccttactcacttagaatggtaaaggtaagggcttacaaaactgtgaacggaaagacttcttacggggctttttcgcaggcggttatggttattgtcaagtaggctggatacagaaacatatgatataaaataagcaggcgataggtgatatgcgggcgaccaaaggtcgtccctacgatagttcaagcattgtaggggacggcgccctcgacgtcccgacttcggaacgttaccatttgtaagattgcaaaaaacttgtgtaatttcgccatatatcagtcgccactacgatacatgactggtacgctacacaattgaggtaaaccaaacgagcgaatgatgttcgcccctacattttttattgctacacaaagggcgctgtaaaaaaaagcgcaacaaagcccgtggattccctcgatatggaagctcacgggctttaatatatcacacagcaaaaaagaactatctaatcttgaaaaaagggtacagcaaacacagcggcacaaaaactgcgtttttgccgtgttgaaaatgtggaaaatattttaaatttatgccgctttttttattgcaggctttttcaagtggaatttatgcagattaaaaccacagcaaatcatcgcaatttctaaattcatggcatttaagccacgtcttctggctctctcctgtttctttcttttattataccactgtcacgatgttttggcaattttgtgttcagtttctagggtacattatagctgttccgaaagatgcgaaattttatctgggtgatttgcatgacaaggcgtttcttgataatatttttgaaaacgaacagatagatgcagtgattcactttgcagcatattctcttgttggagaaagcgttgtcaatccactcaagtattacgacaataatctctgcggaacaaaaattcttttggattccatggtcgaacaccatattgataaaattgtattttcctcaaccgctgccacctatggtgaaccggaaaatattccgattcttgaaacagacagaacacagccaaccaatccatatggtgaaaccaaacttgctatggagaagatgttctattggacttcaaaaactcatggcctaagatacgtttctctccgctatttcaatgcttgcggagcagacaaatcaggtaaaatcggcgaagctcataatccggaaagtcatttgattcctttgattcttcaagtcccaaatggaaagagagaaagtatctccatctatggaacagattatgatactcctgacggaacttgtatcagagactacatccatgttaccgatttggctcaggcacatattctcgctgtaaagtacttaaaaaacggaaacgaaagcaatattttcaatcttggaaatggtgtcggctattccgtaaaagaagtaattgataaagcaagaaaagtgacagggcacccgattccggcaattgaaacgccaaagcgtgccggagatcctgcacgactggtggcttccagtgaaaaggcaagaaaaattcttggctggaatcctgtacacgatagccttgaagaaattatatctgacgcatggaattggcataagaatcatccagatggtttttgaaaagaggtgttatcatgatatacagggcaataaacggattaatccgtcatgcaatagaagctgatttgattacaaatgacgatattttcgttgttagaaatcagctcatggatatactaaaactgactgactgggatgataaagaaccactcacgggaaatattgaagaacttcttgaacccctgatcgactatgcagtaaaagcaggaatcattgaagacacttctgtacaacgtgatctattcgatacaagagttatgggtgttttcacacctatgccgagagaagttaatgccacatttcaaagaaaatattctgtttcgccatcagcagctacagaatggtactatgcttttagtaaaagcctgaactatgttcgtgctgaaagaattgcgaaagatttaaagtggacatatgaatcagaatatggaacacttgacattactataaaccgttctaagccagagaaagatcctcgtgatattgctgctgctaaattgcaaaaaaaattagcctatcctcaatgtcagctttgtgttgaaaatatgggattcgcaggtcatcagacacaccctgcaagacaaaatcttcgtccggtaaagttgaatatcaacagccaagattggttcatgcagtattctccttatggatattataatgaacactgcatcgtctttaataaacagcatattcctatgacaatcaatgcacaggtattcaataaactgtttgattttgttgagcaatttccacactattttatcggttcaaatgcagaccttcctattgtaggcggctccattctaacgcatgaacactttcaaggcggcaattataattttgcaatggcaaaagcaccgattgaaagaacatttcttttgaaaaattatatgaatgttagtgccggcattgtaaaatggccgatgtctgtgatacgtctttcttcaaaaaacaggacggctttggcagctgcatgtgctgatattttatcaaaatggagaacatatacggatgaagtggttggaatttttgcagaaacagacggaattctgcataatacaattactccaattgcaagagcaacttcttctggatttgaatgcgacttggtattgagaaacaatattacaacgaaagaaagaccgttaggtgtgttccatccgaatcctaccttacatcatatcaaaaaagaaaacatcggattgattgaagtgatgggacttgctgttcttccggcgcgtttagcagatgaactgacacttttaaaagatgcaatgctgtccggcaaagagattgctacagatgataaaattgcatctcatgcaatttgggcaagtgaaattctaaaaaaatattctgattttaacgctgataatgcaatggatattattcgttatgaagtcggcagagtttttgaacaggtacttgaagatgccggagtatttaagagagataaacaaggaaaagaagcatttgcaagatttgtagaacaattaggttgatttggaatatacgaaaatgagctattgcattatgtgcagtagctcattttttaatttaattcaattattcaaggctgaaaatttatttcagcacatcatccagtggaatccgattatctcctgacatatcttcagtgtagattgtattattaatgtacaattcctcatcaatgtcacgcacaaagccccaatgaaggttgtacttcttggcgtattccttaaatgcattaaacttattttcgacctgacggtcaatgtttttggtgtgaccagcctgcataccacctttagtttcgataatccaaatatttctgtcagtagtcttaatgatgtaatcaggataaaagagccactgctttctgataccattcacatagacgatagaaagatactgttgacctgagttaccatttttgtaaacctattctacactatcaaaggatatgtgcgttatctgaattttgttgactttttatatttgtatgctataatataattactgcctaatttaaaatgcactgatgagtagtgttattatcttaaatttgaggtttgagagtagtgtaattttatatggtagtagaacttccaggacaggatattgttcttgcaccaaaaaccgaaaatagattatttttttgtggatgaaagatatgagcagtgatttccgttggatgagaatgaatcgttctacattggaaagtcgatagccggattgaaattgaatcagtcggcacagaatccgattatatatctgtatccactggagaaagataaaattcatatttaatgaaattgacaaatcggaatttgagaaggtaagtgaatgggataccacgatacaagataccaaagataccatggaggaatacgataatgtcgaaagatgagtatttgataaccgatacgcccttcaaagcgttgacggtttttgcaatgccaatgattattggaagtttctttcagcaaatatacaatatggccgactctgttattgtcggccagtttgttggttcttccgcacttgcagctgtcggtgcatgtgcagcattgaccaatgtgttcatttgtgtggcactgggagccggtgtcggagccggtgtgcttgtaagccgttatttcggagccagggagtatggcaaaatgaaaacaatcgtgtcaacctccttgattagctttttgcttctaagtatagtccttggtgtttttggctttttcttcgccaactcgttgatgagtggactgcaaacccctgccgatatactggatgatgcagtactgtatctgcgggtctattttgtgggctttccgtttctgtttatgtataacattctttctaccatgttcacctcaatcggcgaatccaaaattccgctaggactgctgattttttcgtccatcctaaatattttaatggatctttggatggtagctgggctaggtcttggcgtgttcggtgcggctattgcaaccctgattgcacagggaatttctgccgtgttttcgtttttgatctttctgtctcggatgcggcaatacaagagctcctttagcaggttcgaccggcaggagctgtattccatgcttcgcattgctgtaccatcggttttgcagcagtccacagtgtctatcggtatgatgatcgtgcaggcagtggtaaatcctttcggtacacaggcactcgccggatatgcagcaacgatgagggtggaaaatgttttttcattgatctttgtatccatcggcaatgcggtttcgccgtatgtttcccaaaatcttggtgcaaagaaaattgatcgtatcaaaaaaggctaccatgttgcactggtgctggatctgtgctttgcggtcattgcgtttgtgaccattgaagcgctgcatacgcagatctcctctctgttcttaggaaaagacggaacggcattggcctatcaggtgtctggtgattatatgaggtggcttggttactttttcatcttcatgggtatcaagatggcaaccgatggagttcttcgcggtatcggaattatgcgtccgttcctcgttgcaaatatagtgaatcttgcgattcgtctgtccgttgccctgatctgtgcaccacgtttcggcattgcctttgtctggattgcgataccagttggctggcttgcaaactttttaatctcctatgtggctcttaggagatcatggccgactgataaaatggcatccattagttaaattccagtttgtagggatgacattaaaaatgaagtttaaggaacagaactttaccttgtttgcctatacaaattatagggcaattcaaggttatcacaggctcgaaccactagattttaagggaaaaggtgcgttccaccatttcctcgtacaataggggttgagtatgtttttcgttgaacaaccgagccacgtggagtgtgtggtattgataacaaggaaagcgcagtaaatcaggacagttagcttagcggtgtggtttacacacattggttaaacatgccgctttttatagggcatggcagtttagcgtataggataatatgtttgtggtgacaacagttccacagcgatacaagtaacgttggagatattatggatagaactgtaagaaatgcagcaaaagcattaattattaaagatgataagatgttggcaatcaaaataagtgacggaaaagaagaatggtatattattcccggcggcggacaagatgtggaggaacttcttcctgaagcagtttgtagagaagtggcagaagaaatgggattgcgggtagttgtgaaagatttagcgtttgttatagagggtttacatggagaaaaatttcatcgtgtagatttggtgtttttatgtgagtatattggaaaacttgaaaatgccgtcttgcaaagtgatacaaatcaagttggatatgattggttagatattaaaacattaaatacaacaccattatatccttcaaaattacgccgacagatcatgaatttgtatgaaggaaaagcgtataaagtttatttaggaaatgaagaaattggagacccggaagtaacagactaaataatgaaggaacttgtttatgagaagagtgataccagcaaataaagtaaatcatgattatgagaaagtattgagtgaatttgtgtcagccttaaaaaatagattaggtgaatacttattaatggtttatttgattggaagttatgcgagaggagatgcaaatgataattctgatttagacgtgttttgtatctttagtacaataaatcaatatgtcttagaaaatgttgggcattgtgcaagaaacacatctatcccttatgatttgttggagataaatactcaatgcttatccgtagacgaatataaaagcaaaatatttgaagattggtcagaatatgcaattgctgaactaaatagtgttttattgtatggtgagcaattggtgaaaatcgaaaatataaatgaaaagatacagttatcctataagaaaaatttagcaaatattttaatgagtgttcgccattatatatgtgtagatgagccaaaagaattacttacgcaccaaaaaatttcgacatatattttgaagccgctcatgtttgcattaagacaagaacgcttttgtgcaacaggagtttatcccttgtcgatagaaagtttattagaatcgtatcaggatgataatagaattatggttgaatactttctaaataaggaaagatttgaaacggacattttgtctgatcataaggatgttctgatgtttcttaatgataaaatacaaaactttcttgaaaatgatttataattagatagcatgaagaaagcatatatacgaaccctttatatcgcagaaatgggcatgtctttatatgaaaagtttggatttgtgcaaatgaagaatgaaatggagtacattgaaatttagcaaataggaagaaaatatgaaaaaaacagtaataggcataattgcccacgtcgactcaggcaagacaacgctttcggaagcaatgctttatttgtctggcaaaataagaaaggtcggacgtgtagaccacggtgacgcttttcttgacacggatatgattgaaaaatacagaggtataactgttttctcaaaacccgcagaatttgaatataaaaacacatctttcaccttgcttgacacacctggtcatgtcgatttctcagcggaaactgagcgtgcattacaggtgcttgatcttgctgtgcttgttataagtggcacagacggtgtgcagagccatacccaaactctttggaggctgttaaagcgttataacgtcccagcctttgtttttgtgaacaaaatggacttggacggtgctgataagacttttgttatgaacagcctagagggtcgtctcggcagtggatttgtggatttctgccgtatgaagtccgaagtcgcagaggattgcgccctttttgatgaaaatattatgaatgagtttcttgaaacgggatcaatgtctgacaagatactgtcagattccgtggctcatagaaaagtatttccatgctttttcggctcagctttaaaatcacagggcatagaaaaatttatgaacgcccttgcagagcttgcaccgtgtgtatatgacagcggtacttttggtgcaaaagtgtataaaatttcagaggacggtggctcacgcctgacttttatgaagataacagatggctgtcttaaggttagagatctagtagattacacatcggctgacggtgaaagcttctcagaaaaggtcagcaggataagaatatattcaggggcaaaatatcgtaatgcggataacgctgtaactggcgttgtttgcgctgttgaagggttgactaaaacttatgcagggcagggatttggttttgagcaggattctgcaaaaccactgctggagcctgttcttacctatcgtgtcgagcctgtgtgtgatttggatatgcacactctgctgtcgtatttccgtgtgcttgaaaatgaagatccacagcttcacgtcgattggaatgaacagcttggcgagattcatgtcagtataatgggcgaggtgcagcttgaaatactgaaaagcctcttcaaacggcgctttgatatcgacattgattttggcgagggaagcattgcatacaaagaaactattgagaaaacggtctacggctatggtcactatgagccgctcaggcattatgctgaggtgcatttgaagcttgagccgctggagcgtggcaagggtctgcgttttgcaaccgaatgcagtgaagatacgctggacaaaaactggcaaagacttattcttacccatttgcaggagaaaaagtatcttggcgttctcacaggctctcctattacagatatgaaaataacgcttgtttcgggaagagcgcaccttaaacacactgagggcggcgacttccgtcaagcaacatatcgtgccgtcagacagggacttagaaacgcaaagtccgttcttcttgagccttattacagcttcacacttgaagttccacagcagaacgtgggacgtgctataacagatatacagaacatgggcggagttttctcacagccggaggtatcgggcgaattttccgttataaagggaagtgcaccggtggcggaaatgcgaggctatcagtcgcaggtcataagctacaccaagggcgttggaaagctgatatgcacttctgacggttaccgtgaatgtcataatacagaagttgtgcttgaagaatatggctatgatcctgatagagatcttgaaaatacggcagattctgtattttgctctcatggcgcaggttacaatgtcaaatggaacgaagttcctgataagcttcacatacctccagaggacaaacgccggcaggtctctcagccacagacatatgctcgtgctgaagattttgtaagacgtgcagcaagtgataaggagcttatggagatatttgagcgcacttacggaaagatagaacgtgataagtactatgcgatgcgcagacctgaaaagtctgtaaagtcagcgtcaaagccgaagcagatatactcaggcgtggaatatttgctggttgacggctataacataattttctcttgggacgagctgaaaaaggctgccaacgagagccttgatcttgcacgaagtatgcttgtgaacaggctttgcaactatcagggatacaagcaatgtgagctgatactcgtctttgacgcatacaaggtcaaagagcaggagcgtgtagtggaaaattaccacaatatcagtatagtttacaccaaagaagccgaaacggctgatacttatatcgaacgcactgctcacaagctcagccgagagcataaggtaagggtcgccacatctgacggcatggagcaggtcataatcatgggcagcggcgctttcagaatgtcagctcaggagcttcacgaggacgttatccgtgtggaaaaagagataagagaatatatctccaatatgaaataacaaaaaacgattttctgaaaataaacagaaaatcgttttttgttatctcttccttttcttgggctttatttttatctcaggtattgctaagttgtcgaatattacgcctgattcgctattattttcgttttcatcattctcagtttttacatcttcaacgtgaacttctggaaaagcaaggttatctgtataacagtcaagatgtttgttcttttttttcatattcttttcctccgttaattaataaagttgataaatcctgttataacaaggctgtttataaaatcggcaaacatacttccaacaataggaacaagcatataagcctttattgaaggggcaaattttgctgttaaagcctgcatattagccatagcgtttggcgttgcacccattccgaagccgcaagttcctgccgcaagcactgccgcatcatagtttctgcccattatattatatacgataaagtatgagaacattgccatgagaagcacctgtgcaacaagcatgattatcataggcaatgcaagctcggcaagctgccagagtttcaatgttatcatggctattccgagaaaaagtgaaagacaaataccaccgatatcatttatttcacccatgtgtatgtgtattttaccgctgtattcaccgatatttctcataaatgctgcaacgatcattgatccgatatacacaggaaaagtcatgcctgaatatgaaagcacccatgatacaaacgtgcctattcccattgctatcgcaagctgataagctgcaggtgcatacatgcttacagaacggtgatgtttttgttcgtcttcgacaagtatagagtcgtcctcaggaataacagttttcagcagatcgtgtttgagtataagctttctgccgataggtccgcccattacagaacctataatcaatccaaaagtagccgctgctgtgcagaggcttgttgctccttgttgaccaaggtcctcaagcactgtgccaaaagcacctgacgttccgtgaccgcctaccatagggatagatcctgtacacatacctaccagcgagcttactcccaatagctttgaaagtcctacggcaaccgcattctgcgcaaatatcagcactatcaggcataataaaaatacaataagacttttacctccagctttcaaaactttaatgtttgcctgaaagccaacagaagtgaagaacatgaccatgcaaactgtttttagcgtttcatcaaactgaaattcgactattcctgcgacgtgaagaatacatgatatgatagcaaaaataattccgccgatgacaggagagggaatacagaaggtttcaagaaatctgactttctttttgagaaatccccctaaatacaagactcctactgccaccgcaagagtttgatacatatccacatttattgttttcaaatttgatcctcctctgttatagcagttccaatgctgttataatattccactgcccctttatgaaaagcacacgggatattatctgtcgcaaattttgtgtcattattcgcaaatgagatccttttctttatctggtcattttcctcaaaaagcattttcgtgatatctgctacagtgtcgctgtccatcttttggcttgccacaagaacagcctttacgccaacagtcttgacgtcctcgtcaatgcctttataagttcctgcctttattacagtttcatagtatccgtcataaagattcgtcatatatgatattgttctgtcatcaagaggcaatattcttatattcatttcctcagaaagctgtgttataacatcacatggagcaccaagtaccacgaaaaatgcatcgatagagccgtttttaagtgcctcagcagacttctgatagttcatgttgcacacatctatcatattatagtcaagacttacagagtttaaaatgtattcagcattttttgctacgccagaatcttcttcgcccacagagacctttttgcctttaagatcagcaggagtttgaatatctgagtcagccggaacgattatctgaaaagactccatgtaaagagccgcaactgcacggacgttgtttattttgttaccattaaaatctcctgtgccattcactgcttcagacaggacatcgctctggactattcccatgttgataaagccgtcctttaaaagcctcatgttagcctgagaaccagccgttcttatatttgtgatgttttcatcaatatcactgagagtgtcagcaaatttataatatataccaccttcgttgccggatcccagttttatctcagagcgtttacagcaagagcagaacattgtaagtatagcaactgtaacaataaatattattgtattttttatttttcgcaatccgatcattcctttctaaaatattcaaaaagttatcctactgatattatcatatccatatttgcattaaacatatatttcatatgaaaaaatcacctatcagcttttttgtaatatcattgaagttaaaaaagccacaccgagcgtggctttcttcctctaatatagacagtaaacaaattttgcattaagaagcttagcacccgaaagctttggcaggacgatcttgtcctttacgatttcaaaataagaaagtgcagtttcgagttcctcatcagatattactgagttgctcatttccgctttgactgcaagttctccgatatattttatcatatgagagaaatcattgatttgcatttcctggcatttttctgttaacctgtcacaaagctgtaagtctgtaatatttctgctgtcggcaatgcctataagctttaaatatttgagcatatagcgatataccgccacagtgcgtgatctattgtccccattacttagttccgaacgcattttctttacttttacatctctatggactacaacgccgaaggctataagcagaagtccgcccagtgtgatgaaaattcctacaaatgagccatggtcgctgttgttttctgttactcttgatgaaacagaagttttcccagcgcctgacatcactccggcaccatgtccgttgcttgcagaatttgttttctttgttgttgaagcttttgaactgtttgcaggctttttagtaaccactgaagtagtgccaccctgaccgccattttgtgtggtagtcgtaggcttgctttctgtgcttttagtcgttgtaacttccttagggtctttctcttgttgtgtaagattaggattatcattatcataacctggtgtgaattctgcaggataccaacctgcattgtctataaatacctcagcccatgcgtgcgcacatttgtcctttacacttacctcgtatgttgaatcatcttcaggctcatcgagctgtgaattaagcaccacatatccctctacatatcttgacggatagccaaacattcttaaaagctctgcacctgctgttgcgaaatatgaacaatagccctccttttgtgtacctaaaaaataatctatgaaatcttcaccttttggagtaacacccggttcaagggtataagtgaagttatcagagaaatagttttttattgcagtgcttatttcttcataagtccaatcacccttgtggtaaatatccacgccaagatattcactaagtatctctttatatgccttatcaagctcgtcagactttgaaacgtccatatatttttggtgaacaaactctgagtaagcgtcaacacctctgtccttattaacagacaatgcaggcacttctgtggctatagcctcagggagagcttcaagcctttcttctataagagaggggtcaaaatagtaaagagaatactttgttgaacttaatttgacatatgactcagtggtaggacgcatttttttatcgtctgtgtttccatcacttgaatataaagaagcgtatggcgcatacacaaatttcttgcttgcgccgagaacagatacagaaatctgagcaggggtcagatccgcatatttgcgttggataaggtcataatccagatcctgcacccatatcttgccttgctcaaaatcatcagagaaggtgtcttcattgccattcacgtcaacaggagtccagctattgtcgttataaacgcctgctacatatccacggagatatagtgtattagagaattttggagtgaccacttttagtgctgttgagccgttgaagctaatgcctgctgtctttccaagaacgcctccgtttgtgccaccaactgtttttataccaaatagatcaaatccgccgtcataatctgaaaaagcatttctcaggtcagagagagagaaatttgacactgctgtagaaatatcatgtctgtattttgcaaatgactcaggacgtgtaaagcctgttattgctgagaaaagcattataactacaagtaccaacgagcttaaaatagccgtgaatttcatgaatacgttatagaaacaagctttttgcttttcagatgtaaaataaaacgtgcgttttcgctcatgcaccgcaaaggtgttttttcttcctgccttgttagttgtgtggtttattatgtgcagtgcaagcactgtcacccagcatacaaacagaccaataacagtccacattgatggctcccagccccaatacattccaagctcgaaaacaggaaatgtaatgatgaacagcagtggaaaatctatcctataaaggcaggctgctgccgttccaaggcaaacaagagttataaaaaatacgaaaaaatttgacgcaagatatgggtagtcgatagtagaaattccactaagctgaacgccaagagttgagttaggttgatttgcccttgaaagatatctgtctataacaacgaacaagccgtattttattgtagttatcctgctcacaaggtaaattacatgaagtatcataacaccaagtgcagaaaacttaattatcttgtgtgacgatttcatcagaccaaacacaagtgaaagcatggcggagtaatatatgattgtggtcttgtatatttccatatcaaggaatgatactgccataaacgctgtgcatatggtcgccacaaaggtcagaagtatctgaaaccatagaaatgagcctgaattatgctcacgctcacaattcataaggatatctccgtcaatgcagataccattgctgctgataaatcctatatctttgtttttgctttttattcttttctttttcatgttgtcacctttatagacatatttcctgtatgctttcggcaacgtgttttgcagtaacgttcacgacctctgcaaactcatcgtttataacgtcgtctttctttttatttgtgataagcatataggaatagcggaatgccagatcgttatcgttcataacgccgctgagattgctgttatatgcgggagaaaaatacatcaagtgaccgcatttatatctctcaggctcattgatgtaatttatcatagacaagtcaggctcatcataaacagaagcctgcaacagcagacttataagcagccttgcactttcttcgtctgtaacgttcactacttcgctcaaatctttctttttatcataccacactaccttatgaggtgtgtcattttctatgagataataggatatagacgctatagcctctacaagagtatcatatacgagcatataatcgtctgtatttgtatcaaggtggagatccgccataagcacgatagagtttgatattggcagagagtaatccttgaccatggtcttatcctgctttgcagtaagcttccagtgtatcctgtttattttgtcaccatcatgatattcgtgtatatcaaaaatctccgagggatcatcgccctttgaggtcttggaataatcatcggtttcaagacccatttcagcataattcgcaatgttgttttcaataggtatatagtcaggaactatagtgaacgtactttcgccaaaaagtctggaagcagcatcggtgcttactcttatcttgaaaagcttcagcatatccacaatgcgacagcgttttatgttcatgcgcactgtgccataatgttttgcagaaacgtgcaaagtaagatactgaacatcatcaggataaaggggagtatttatcttcattgtatttttgtcgccgtcaagagtgttgtaatattctatctctataatcatattggcaacaggcaactttgagcggttttgcagtctcagcacaacaggtatctttgacgatctgcctgcggttttctgagtgttcacaaaaccaacgcttattttctttgacatttttttgagcataacgaataagattataggcataacaagtaaaaatgcaaagagataaaaagagaagctacccacatataatatatagaaaaagatagaggcgataaataatattatatataaaaccagcatttgctcctccgttacttgctaactcttggaacctgaactgaggaaataactcctttgagtatctgttctcctgtgaagccatttatctttgcctttgagctgaacacaagtctgtgaagaacaacgtccttgaagctgtatataacgtcatcggggatgacataatctctgcccttaagaagcgctgtcgcctttgtcattcttagtagtgcgatagttcctctaggtgaaagacctaactttatatattcattgtttctggttgcatttgcaagcataacgatatactggaaaacctgatctgaaacataaatattttccacaactttccttgcctgaaggatatcctccgcagacaccacaggccttacattatccacagggacgagattttgcttggattttagcattgcgacttcgctttcaagattaggataacccattgtgagccttacgataaatctgtccatttgcgattcagggagcatttgcgtgcctatagagccaaccgggttttgcgttgcgataacgatataagggtcaggcattttatgtgtgataccatctacagttaccttgccctcctccattacttcaagaagcgcagactgcgtcttacttgaggttctgtttatctcgtctgcaagaaaaagatttgtgagcgctgcaccctgtttatattcaaacttgtgtgtttctttatttagtatggtaaaacctgtcacgtctgttggcaaaacatcaggggtgaattgtagtcttttatagtcaagtgaaagcgcctttgaaagagccacggcaagagtggtctttcctactcctggaatatcctcaataaggatatgaccgcctgcaagtatggacagcaagacttttatgattatctcgtccttgccgataatgacctttcttacctcatttatcacgctttgtgacatattcagtacttttacctgttcttcagttaagctgttgttcataattttctcctttgttttgtatgtttcttttatcttcacaatatttgtgcatattgcattaacattatatcacaaatacaacagtatttcaagcattttgcgtgataattaaatacaataatggatatctgcgtatgtaggagaatacaaatatcttgtactaaaatgcaggctcacagcatagttatttcataggacaagtcaaaaggagcgtgaaaaaatgataagagaagtcagcaagataaaatacgtttacgaactgctcacccctcgcataaggggagcgattatgtcagtgccagaaatagagcgtgacaggatacaggaaataaggcttcgcagaggtagacggctgtctgttaccatattctcgaaagagtatttcgttaatgataacggcagactaatgaacaatatcggggatagcgttcaagttaccacagaggatattgaaactatctatcagcgagcatttcagaattctcttcacagctttcaccgtgagatagcaagaggctacataacggtttcaggagggtgcagagtaggcttctgcggaactgccgttcttgatcctgcaaggagttatgccgtggagtcggtaaaaaatatatcttctcttaatataaggatagctcgtgaaatgataggcagctcagacgagatatatgcaaaatgcttttctgacaaaccaatgagcctgcttattgcttcaccgccctcgggaggaaaaactacagtgcttcgtgatcttgcaagaaagcttggagaacgctggcgtgttgcgcttatagacgagcgaaacgagtttgccgcaacagtggcaggtgagccgcaaaatcttataggtgcaatgacggacgtgtttaattcctacaacaaatatgagggtataatgacggctgtcaaggttatgtcaccgcaaatactcatatgcgacgagataggttcttctgaggacaacgaagctttgcagtatgcgctcaactcaggagtgaagcttattgcttcatgccatgcttcaagccttgatgagcttaaaaagcggcgttatatctcaaaactcataaaagacaaggctttcgacgcacttgcggtactaggcacaggaacaatgtgtggcaggctggtatcatttacaaaaacaggagcatgaaatgataaagctaataggctgtgtgctgatcatatccgcctgcacacaaatgggctgtgcaatggcgacggacaagatacggcaaatgaaatatctcaagcttctcagacggttgatatttgaaacaagggcaatggttgagggtggaatgactttcggggaaattatcttaaagcttagcttgcagaaggattattctgactttacatttttgtcgcaagatacctcttcgcctgatgttcgcagaagaataaccgaggatatatataagtcaaagctttttgacaatgaaatcaggcagaccgccatagatttttttgaaaaactcggtacaacagacacaaatggacagcttgcatacatttccatgagccttgccgcacttgacgagcagataagcagactttcagagaatttcacctcacaggtgcggctatgcagggctttgggcgttctcagcggggcttttatcgctattctgctaatatagccatagcaaaggataaccataatgaagggaacaaaattttatggacatagatcttattttcaaaatcgctgccataggaattatcgttgccgtgttaaatctcttgctgaaacgagcggagcgtgacgagcaggcaatgatgacaactcttgcagggcttattgtcgttctgcttatgatagtaaggcagatcggaaatctatttgaaacgataaaagaagtgtttggattgtattaatgaaaatatttacaatagcgtgcttttgtattttctcaaccatagtgtgcaaagccattgagaaagacagtcgtgaaataaaatatgcggctgtgcttgcggcggcggcactggtgctttttcattcggtggcatttgtgaaagatcttatctctgtatttgaggaccttttcattctgtcaggaattgacgatatgtatcttaccatactgttcaagtcacttggtatatgctatatcgtacagcttgcatctgattattgtaaggactgcggagaaaacgcacttgcgtcacaggtcactttggcaggaaagcttgcaatgctttcggtatcgctgccgcttttcaaagcgtttgtagaaatagtaaaagcattgcttatataggattaacatatgaaaaaaataattgccactgtcatcatagtccttgcggtcatgtttacaccacagggagtatatgcagacagtgaggaacagaacaatgaatattatgacaggctcataagcgaaataaacgagggactttcttttgagggtgatgaagatgtaaaaactgtacttgaagataataacatcactttggaagatccgtcctctgccgcaaatataagtgtctctgatgtgataaagcatatatttgaaagctttaccgctgctttgcgaagccctcttataatgctcgggaaaataacagccgccactatgctttgcgtgttggtaaggtcaatgtcagccgagggtacagtggacaaggtattcacgctcatatgtgttcttaccacagtgcttgttataagcgatactgtcaccgacagcctttattctgtaaagacctccatgggacaaatgaacagctttatgatgtcctacatacccatattttcaagcgtggcgacagcaggcggtagtgcggcggcaggagcaggctattacagcgttatgctgataatatgtgaaagcgcaggtatattggcagatacgatacttgtgccgtttttgtcggcagtgcttgcagtgacccttgtttctgcaataaacccatctcttgaccttggaagccttgcagagtcggtgaaaaagctggtcatatgggtgcttggcattgtgatgaccctttttactgggctgttatctattcaaagctttgcaggagcggcggctgataatctctccgcaagagccgttaaatttgcggcttcaagctttatacctgtcataggcggctcggtctctgaagcttattcagcggtaaagggaagtataggcgtaataagaacaagcgtcggcgtgataggcgttataataatgtctgtgatagttgcgaaacctttgcttacgcttcttgcagtaaaacttgcagtgtggataggtgcgatcataaacgatatttttggcataagcaacagtggtggacttcttaaaagcataaactcggttttatcaattggtgtgagcattcttgcggcttattctataatgttcgttatttccacatcagttgtaataatgacagccatgaacacaggagcttaaagtgaatatagttaaatcagtgatatttattgcctgcattataggcgtgataacttctatgacggatattgtcacacctgagggaactttgaaaaaacagcttagatcagtgcttgctgtgatacttttacttgcagtcataacgcctgtaatgggacatggcttcaaagtcaccctaagcgactatacagagcttgcagatctgcctgagtttgacagcgtttcaacagcgacgaaactttattatctgtccgaatccgaaagcaggcttgaagaatattttttggataagctgaataagaatggcatagaaaacgtcaaagtggacataaccacagatataaatgaatataatgaaatagagataacagcggtaagggtatatctgactaaaacaagcgacagagggcttgttgaaaaacttattgcagaagatctgcctgatactcaagttatcgtgcaggaggaataaacgttgctgaaaagtaaagttgaggggaaaataaaggctcttaaaaagcttcctatgaaaacgaagatagtgatagccgtaggtcttgcagggatattgcttatatttgtttctgagatgtttcctgctaaaaatacggcagagagcaagagcattcccacggaaagcgttgccactgatgatacggacagctacaaaaagcagatagaaaaagagcttaaagatgttctttctaaagtcaggggagttggcgagtgcgaggtaatggtgacagttgagggaactaccgaatatgtttatgccgaaaatcttaccaaaagcacagataataatggtgacagaacaagcgacagatatgaaaacgagatagtaataactgataatgacggcaaaaaggaggcattggtcagaaaaataataaaaccgcagatatgcggcgttgtcattgtttgcgaaggaggtggagatataaaagtaaacgaacgtgtgcttaaagcggtttcgacagttctaggtatatcaagcagtaagatctgcgttgagggcagaaaataacagaaagaggtaataaagatgaaaaaaccgaccatgataataggcaaaaagcagataatccttgcaggaatgacgctgatactcggtcttgcagtatacataaattatgcagtatcgacctcagacggcaagataaaggcgacggacgttgtgaaaagtcaaagcgtgaattacggcgacgcacagctcgtaagcactgacagtacttcagattattttgcacaggcaagaatagacagaatgaattcaagggacgaggcggtagaaacattaaagaatataatgaacggcggcgattccacagaggaagaaaagaaagtcgctgaagaagaagcttcagccatgacaggactcatggagtcggagagcaaggtagagacacttgtgaaagcagcaggctttgaggactgtgttgtttatcttgacggtgacaacgcaaatatcgttgtaaagaccgacagcgacgggcttgttgcaagcgaagcggcacagataaaagatatcctccttagcgaagtttcagttgcaaatgaaaacatcagaatttatgatgtagaataaaatttgtcagcaaataaaaaaagtccttcaaaatacttgtaacctattgatttttatgatataatggttataagtatagattgaaggatttcttttttatatctaaaaagggaggcttggataaatatgaatgatgtttcaaagaaagtagaaaaaagcctgcacataagtcaggacgttatagcacagatcgttacaaactctgttaatgagatagagggcgtttatggtatcgctcatgttatgaagactccacgtcagctctggtttaggcaggaaaatttcggcaatatcaggataggccttgttgacgatgtgctgtcagtgtctataggtataatactttgccgtggagctaaggcggtttccgttgccgaggagatacaggataaagtaaaaagtgcagttcagaatatgcttggacttacagttgcaaaggtaaatgtgaccatatgcggagttgacctttcggaaaaggaataggattcagacaaatataagatgaaggaagtgtttttgtgccaattaaaaggcgtgaaataagagaatcagcatttttgctgatatttgagaaaatgtttagacaggacgaggagcttgacgatatattcatgtctgccatggaagtgaacgagatcatcgtaaatgatgaagttaaaaagctcgtggaaaatgtttgcgaaaagcaggacgagatcgacagcataatcagcaagttcagcaacaagagaactgttgaaagaatacctaagataaatcttgcaatactcagacttgctatttacgaggcaatatatgaggagaacgttcctgtgaacgttgccataagcgaggctgtggctcttgcaggaaaatatgccctcgagcctgacgtttcatttgtaaacggtgtgcttggctcatttgcaaaggaacaagaggaaaagcattgagttttgtactcggaatagacacaagcaattataccacttcatgtgcactgcttgatactgcggatttgagcgtcaggtcatgcaaaaagcttcttcctgtcaagcagggagagcgaggactaagacaatccgacgctgtgtttcaccatacgaaacagcttccagaacttatgaaacagctttttgataaaaggtatgacttaagtgcagttgggtattcttatgcaccaaggtgtacagaggggtcgtatatgccttgcttccttgtcggagaaaatgttgcacaagctgtgtcacttgcctgtggagctgaccttgaaaagacttcgcatcaggtgggacatatacttgcggcactttattcctgcggaaagctggatatgctcagttctgataagccttttgcggcttttcacgtcagcggtggcactacagatcttcttttgtgcgagcctgacaaggctaagctgataaatataactcagatcggcggaagccgtgatcttaaaggcggacaagccatagacagaacaggcgtaaggcttgggctgtcttttccatgtggtaaagagcttgaaaggcttgcgtctgaaagcgaacataaaataaagccaaaagcatcagttgacgggctttattgttcactttctggaatagaaaatcagtgcatgaagcttatagacgagagctgttcggtggctgatgttgcggcatactgtattgattgtgtgtgccttgcggtggagaaaatgacagttaatcttcgccatgagtataaggatatacctattatatatgcaggcggtgtgatgtctaatcgctttataaaaagcaagcttgaaaagtacggcagctttgctgagcctgagttttcaagcgataacgcagttggcgttgctgtctatgctgcgatcaggaaagggaagatcaaaatatgagttcagttatcactgtttctcagctaaacagatatcttgcttcaaaactgcggtctgaccttaagctgaaaggcattgctgtcaagggcgagatatccaattttaatatacattacaaatcaggtcatgcctattttacagtaaaggacagcagttctgcacttaaagctgttatgttttcaagcagtgtttcaaggcttaaattcgtgcctgaggacggcatgagcgtgcttgttatgggcaatatagaggtctatgagcgtgacggcgtttatcagataattgctacggagatagcacctcttggtgtgggcgttatgcacgttcagctcgaacagacaaagaaaaagcttgaaaaaatgggcgtatttgatgtgaatataaaaaagaaaataccccttgttccaaagaagatagctgttgttacgtcgcttactgcggcggctttgcaggatataatccatatagctgaaaggcgttatcctgtgtgcaatatcgaagtttatcctgcgcaggtgcagggtacggcggcagcacaaactatatgcaaagcactttcatcggctgataaaagcggtgcggataccataattttagctcgtggcggtggctctagcgaggatcttatggtgttcaatgacgaggcggtggcgctgtctgtttacgcctgcaacacacctgtgatatcggctgtaggtcacgaaactgacaccacccttgccgactatgccgcagatatgcgtgcgccaactccgtcagcggcggctgagattgctacccctgacaaggcggatatacttaatgctgtgaggcttttaagacaaaagcttgacaaggctatggagcttaaacttgataaggctgtgtcacagatagaaagctgtgataagcttttgaaattatattctcctgaaaagagattagagcagagcgaaaaagcagtgtgcgaccttgaaaaaaggctgtcacaaatcatggaacgcaggcttgaaaagctgtcagttaagcttgacggctatgtttcttctctgaatattcttagtccgttcaatattctgggcaggggatatgctatcgttcagaaagacgaaagcgttgtggacagtgtatcaatgctgaacgttggcgacgaggtagacataaagctgtcagacggcagtgtatctgctaatataacatttgtcaaatgaaaggctgtttaaaatgacttttgaagaaaatcttacaagacttaatgatatagttggtcagcttgaaaatgacaagcttcctcttgagaaagctttggaactttataaagaggggatagatctgtcggtcgactgcaaaaaaagccttgaaagtgcaaagctttccgtaaaggctatgaacggagataatagcgatgaatgatatgaacaaagccacacttgattattatgtggaacttatagataataaactgctggagcttacccgctcaaagcctgagcttcagggtcaggtagttgaggctatggagtattctttgcaggcagggggcaaaaggctcagacctgtgcttatgcttgaattttgccgtatgtgcggtgagcgtcagcctgagaagtatgcagagatagcttgttctattgaacttatacacactttttctcttatacatgacgatctgccctgtatggacgatgatgattacagacgtggaaagccctcatgtcataaagcttttcctgagaatattgctctccttgcaggcgatgcactgaatactcttgcttttgaagtaattgccaacagtgccatgaacggcgttatatctgccgacaaggctgttatgcttatctctgttctggcaagggcagttggcactgacggcatgataggcggtcaggtgatagaccttaaatatgaaaataaagaaatagacgttgatacactgaatattttgcagacctgcaaaacaggcgcacttattgaagccgcttgtgtaatgggcgttatacttggagataagcttgaggctatcccctttgcggcagactatgctcaggcaatgggcagagcatttcagatagttgacgatattcttgacgtaacaggcacttttgaggagcttggcaagcctatcggcagtgacagcgaacagcataaaaacacatatgtatccctccttggacttgacaagtcagaacagatagcaaaacaactgacagttcaagcactgggtcatcttaaatattttgaggacagcgttttcctcacagagcttacatctgatatgcttacaagaagaagttgataaaaagattggagatctagatataatgtcggaaataaaaaagcctgatatttataaaatgaatttgcctgccgacctgaaaaagctttccactgcgcagtgtgaggagctttgcggtgatataaggaaaattcttatagatacggtttcaaaaaacggcggtcatcttgcgtcaaatcttggtactgtggagcttacaatggctatccacagagtttttgaatcacctaaagataaaatcgtctgggacgttggtcatcaggcatatacacataaaatacttacgggtagactcaaagagtttaaaactctcagacaggaaaacggtatttcgggtttttgcagacctgatgagtcggtgcatgacgcttttataagcggtcacagctctacgtctgtttctgcggcgcttgggatcgccacagcaatgaagctgagtggtgataaaactcaccatgctatagctgtagtcggtgacggtgcttcaacaggtggcgagctttacgagggacttaacaatgcaggcaaaagtgatacaaatatcatcgttatcctcaactacaatgaaatgtctatctcaaaaaatgttggcggaatggcaaaatatctttcctccatgcgtacaaaagagagctatcagcgcacaaagggcagagtagagagaatgcttgataagacgcctgttataggtaaacctgtgaaaaatgccgttcgtaactccaaaaatgcggtcaagaacatgatacttcacagcaccatgtttgaagatcttggctttcactatattggacctatcgacggacacaatcttgaagaacttgaacagggacttatggctgcaaaggcagtaaacaagcctgtttttgttcatgtgaatactataaaaggcaagggctatgctcctgcagaagctaacccaggagagtttcacggggtcggctcctttgagataaaaacgggcaatcccgacgtcgtactttctgacagcttttcttctataatgggaaaagagctttgtgaaatgggcgaaaagaataagcgtctttgtgcagtcactgcggcaatgaaatacggcacggggcttcagtattttgcgaagcgttttcctgaacgcttctttgatgtaggcattgccgaagaacacgcagttactttctgtgctgggcttgcttctatgaactatgtacctgtttttgcggtgtactcatcgtttttgcaaaggtcatacgaccaacttatccatgatatggcaataggaggttgtcatgcagttatatgcgttgaccgcgcaggtatagtcggtgatgatggtgaaacacatcagggaatttttgatgtttcttttcttacctctgtgccaaatatgaggatatattctccgtctaattatgacgaactcagactgtgcctgcataaggctgttgaggacgacagtggcatttgtgctgtgagatatccaaggggcagggatcaatcgctgtatgatacatctgatcctgtttcaacttacgtttatcgtcatatagagggcgcaaaggttctgcttgttacatacggcaggcttgcaaatgatctttttacagctatagaaatactcagaaatcgtgatataaagtgcgatgttattaagctcgtgaatattttccctatagacaatgaggtggttgatataatgtcagcctacgatgctgtgctgttctttgaggaagcttattactgtggaagtatttcagagaagtatgcttctatctgcccaaatgtggctcagtttgctattgacggtttcgtgaagcacggaaaatgtgatgtgctacttgacgagcttggtttttcagcagagaaaatggctgatacagttgagggctttttgaaagatgagtgaaagacttgatgtgtatatagttacgaactgcggcgtaaaaagccgagaacgtgccaagcagcttataaaaaatggatttgtgtcggtaaacggcaaggtctgcgtcaagccttctatattggttgatgagaacgacgtggtgaaatgtaggcctgacgatatgaagtttgtcggtaggggcgggcttaagcttgaacacgcctgtgatgttttcgggcttgacttgacaggtaaagtttgtgcagatatcggtgcttcaactgggggatttactcagtgtatgcttgaacatggcgcagaatttgtctatgcggtggacgtgggtcacggacagcttgatgaaagtttgtgcaatgacagcagggtgaaaaactgtgagggcgtgaatgcacgatatctgacagcgaatttttttgacagacctgtgcagttcataagtggtgatctttcgtttatttctctaaaacttgttataaaatccctttgcgattgtctttgcgatggcggcgaaatggttcttcttataaaacctcagtttgaggctggcaagcaggctctcaataaaaagggtatcgtcaaagatcgtaaagaccatgtgagagtgataaccgagcttcttggctgttttcgagcagaagggcttgcggctgaaaagataacaatttcacctgttaagggcggcgacggcaatcttgaatatcttattctacttaaaaacgctgacatgacggctgacaagcttggtcagctcaatataaaagaatttgtgaacgaagcttttgacagcttcaaagactaaacgcaagagtggtaatattatgaaaatctatctttatccaaatcttgataaaactcattgctttgagtatacgaccgcaacatatgaaaggctgcacaaaaatggtgcaaaactttttatggatacatgctataagcacgttttcggaaaactcgatatcactttctgtagcgaagacgagtgtgtaaagcagtgtgatatgattgttgcgatcggtggtgacggaacgatactcaaatgctctcttaagggctgtgagtttgagaagcctatacttggcataaactgtggcagactcggttttatggcctctcttgaacattcacagcttgaattgctggacaagcttttttctggagaatataccctcagccgccgaatgatgttaaacgtaaatgtcgaatgtggcagtgaaaataagtcatatactgcgcttaatgatgttgcagtaacaaaagctgacgattgtaagatagccgattttgaggtgtcaaaaaacggcagacttatttcttcacttcgtgcagacggcgttatactttctacagccacaggctcaacagcctattcaatgtcagcaggcggaccgataatcgaacctgaaatgaagtgtatagagttcacacagatatgtgctcactcgctttttgcaagatctatgatactttcagaggacagcgttatgaaagtcaagtgtcacactaacagtggctctcacgcaatcgtcagcgttgacggtaataatgttttcagactttcggcagaggacactgtgatagtatcaaagtcaaggtattttgttgaaatcatagatataagcggcggcagctttttctcgtcaataaacaaaaagcttatgcagccgttgaaggaatcagcggaggacggcatatgaaaaatcagcgtcagaatttgataatgcagattgtcaaagacgaaaatatcggcactcaggaggaacttcgtgaagcgcttaaaaggcatggtctgaaagtcactcaggcaacagtttcaagggatataaaagagctttcccttgtaaagaccattggttcagacggcaattataaatacagcctgcctgcacttaaaaaagatattgcagagcaaaacaacggcattttcggcataatttcagacgccgttgtgtcggtggatcatgcgcttaacactgttgtggtgaaatgtcatacgggcatggcacaggcggtgtgtgcaaagcttgacaagcttgggcttgacaatgttgtgggaacgcttgcaggtgacgacacgatattcatacttatgcggacagaaaaagatgcgtcccatatggcagaggaactgagatcctttattatttcttaaacagcagaggaatgatctaaaatgttaagtgaactttatattgaaaatcttgccgtgatagaaaaggcaactatagatttttctgataagcttaatgttttcacaggcgaaacgggagcaggtaagtccatacttataaatggaataaatgctatcctcggtcagcgtgtcactaaggatattgtgagaacaggcacggacaaggctgttatttcagcgttgtttactgacattggggacaatgttttgcaggtactagacgagcttggcataagtgcagaagacggacagctttttcttacccgtgagatacgttcagatggtggaagcgttgcaagagtcaactcgagagcggtgaacgtttccgtacttaaagctatcggagaaacgcttgtaactatccatggacagcacgataatcagatactcatggctcctgaacgtcatatagagatacttgacagctatgccgaatcggaagctcttatagaagattatcacagctctttcagagagcttcaaagcattgcaaagaagataaacaagataaaaactgagcaaagcaaaaaagagtttcgcatggctgagcttgctgatattgtcgaggagataaatgcgctcaacattcatgaaggcgaggataaagagatagaagcagagcttaacatctctaaaaatgctgttgcaatctctgaggctctttatatggcaaaacaactcctttcgggtgatgatgacacagatggtgcagtggagatgacgcagagagcttcaaaatcggttgagggatatactgatataatgactgagatatcacctatatatgacagacttagttctgcggctattgaaatggaggatatttctgaggagataggctcacttcttgacagcctcgatatcgacccgaaacgttatgattaccttaatcagcgttctgatgaactcaggcgtatcatgaagaaatacggacctgagcttgatgatgtactgactactcttgaaaattcacagaatgagcttgatgaattgagcggagcggagcagagcttagacgagcttaataaagaaaaggaaagacttcttgctgaggtatcaaagaaagccaaagcactttcagaccatagaaaaaaagcaggagaacggtttgtttctcaggtaacagaggagcttgaatttctcaatatgccaaaggtcaagctggtggttcagcagaaaacgggcaagctcaccataaatggcatggatagcatagagtttcttatttctgcaaatctgggcgaagagccaaagcctattgcgaagattgcttcaggcggtgagctttcaagaataatgcttgcactgaaaaacgtaattgcagaaaaggacagtatcggcacgctgatatttgacgagatagacacaggagtaagcggcagagcggctcagaagataggtataaagctgaaacagatatctcgccttaggcaagttctttgcgtgacccaccttgcccaaatggctgttatggcggataatcatttgcttattgagaaaaatatacagggcgacaggacagttacaactgttagaactctcgatcatgagcagagaaagtatgagatagcaaggataatgggcggtgaaaatatcacagagcttatgcttgaaaatgctgaacagtatcttaaagacgctgacaatatgtaacacaaagtccctgatgattgcggggacttttttgtgaacgtacatttattatttattgttgtaaaattcatagtaatgtggtataataacaatcggtaggtgattatttgaaacttgaacatataaacgtcaaagaagctgtgagatatatgggaatgggcaataacaagccagacgaacgcacggctttgttgatagatgaatgtgaaaaagagcttttgaaggtcattgagcctaaatttgtgtacagagtgtttgatgtcgctcataaagagaacggtgttgaggtcatcggtactccgttgtttcttggcggcaatgatatatgcagacaccttgaggggtgcagtaaatgcgtgctttttgcagcgactatttcttcgggcgttgatagaaagcttcgtgcttatgaagcagaggatatggctaaagctatgatagcggattgccttgcaagtgcggctgtggagcaggtatgcgatatagttgacaacactgtgaaagaaaagctcagcggatataatcagacatggaggttttctcctggttatggcgatctgcctatcagcgtgcagagagtttttcttgacgtactcaatgcgcagaaatttatcgggcttaatgcaactgaaaataatatactgacgccgagaaagtctgttacggcgataatcggattgtcaaaaaatgaaatatcaaagggcagacgtggttgtgcctgctgtaatatgagggaagtctgtcaattcagaaaaagaggagatcattgtggattttagaacattacttaaaacaaaagaatttgtcatacttgacggagcaatgggtactatgcttcaggcaaagggacttgaaatgggtggcactcctgaagctcttaatatagacaagcctgattggctggtggacatacaccgccagtatataaacgcaggctcagacattgtttacgccaacactttcggtgcaaacagacacaagcttgaaaagtgcggatatactgtccagcaggctatccctgcggctataaaaaatgcaagaaaagcttgtgagggtactgatacccttgttgctcttgatatcggacctatcggacagcttctagagccaacaggaacgctcacttttgaagaagcttacgatatttataaggagcagatacttgcaggagctgacgcagaccttatcgtttttgaaacaatgacagatctctatgaacttaaagcggctgttcttgcggcaaaggaaaacagcgatcttcctatagtctgcacaatgacatttgaggaaaatatgcgtacatttactggcgttgccataagctccatggctttgactttggagggtctgggcgttgacgcaatcggtgtgaactgctcattaggaccaaaggagctttatcctgttgtggaggagctttgcaagtggacaaatctccctgttgtagtaaagcctaatgcaggacttcctgaccctgttacaaatgaatataactgttcacctgaagattttgcggagtttgcagaaaagcttatcccattgggagttaaggtgcttggaggttgctgcggaactaaccctgagtatatcaaaaagcttgctgaaatgctcaaaggcaagaaacacgtcagcgtgcataatgatatccctgccgcttgctgttcaccgacacatactgtagttatagaccagccaagaataatcggtgagcgtatcaatcctactggcaagaagcgttttaaagaagcgctgcttgcaaacgatattgactatatccttggtcaggctatcgagcagatacacgcaggtgcggatattcttgatgtaaatgttggtctgccgggaatcgacgaaaagagtatgatggtcaaggctgtaaagtctttgcagggcgttgtcgatgtgcctttgcaggtggattcaactatacctgaggtgcttgaagcggctctgagggcttataatggcaagcctatcgtcaattctgtaaacgctgaggacagctccattgaaaatgttcttcctcttgtaaagaaatatggtgcggctgtggtaggtcttactcttgatgaaaacggcataccaaagagtgctgacaagagatttgagcttgctaaaaagatacttgacaaggcgattgaatacggcattagaaaagaagatgtgtatatagattgtcttactcttaccgcttctgcggagcaggaaaatgttatgcagacagtaaatgcagtggagcgagtaaagaatgagcttggacttaaaacagttcttggtgtatcgaatatcagctttggtctgcctagcagagagatagttaatcacaattttcttatgatggcgctcacaaagggtcttgacctgccgataatgaatcctaatattgattctatgacggcaactgttcgtgcctacaagcttctgacaaacattgataaaaactctgttgactttatttctcactacggtggcgagaaaaaaactgctcctgccgcaacgggcgcaaaagctgagatagacttgccgtatgctatcgaaaacggtctgaagaaagaagcagctgaccttactgcaaagcttttgcaggaaacagaagccatgaacattgtcaacgatatgcttatcccagcacttgataaggctggtgcagaatttgaaaagggcaagcttttcctgccacagcttatccagacagcaggcactgcacaggcttgctttgaggtaataaaaaattacattctgtcaacgggtgaaaaaagcgtttctaagggcaagataatccttgcaacagtaaagggcgatatccacgatatcggcaagaacattgtaaaggtacttcttgaaaactatggttatgacgttattgaccttggcaaggacgttgactatcagacagtagttgattgtgcaatagaaaatgacgtacatcttatcggtctttctgcgcttatgacaacaactcttgtgagcatggaaaatacagttaagcttcttcgtgaaaacaatgttgactgcaagataatagtaggcggtgcggtggtaacggctgactatgcagagcagataggcgctgactattatgcaaaagacgcaaaagagtcggtagatatcgcaagaaaatttttcggaaactgaataaaataactatgacctcccataatctgaacaacagatatttatgggaggccatttttaatgaaaaagtttgtaacagctatcatcatttcatttgtcgttacggtaagctctgcaggcatcaaagtcgctgctttttcctcatcaaaccttggggcagcattcgttttgagcaatgttatgtcagatgaaaaaaacgataaaaatggcagttgtataactgtcatagacggcaatagggaagatataaagttttcttttaaaatagccgagataattaaaagcctttttagctaagtgtacatttatttgtacttgtatcaaaagtgcgattgacttttgagccttgccgtgttattatataaatatcaatcataacggaggctcattcaatggtaacagttataagcggtggctctcacagtggacgtgacaaagttttcatagataagatcaagtctgctgtaaaaaacggcgagcaggtcatggtcataataccagatcagttttcttttgaatatgataaaaaactgtatgaacaccttggtgcggcagatttcaacgtcatacagactgcaggctttaaccgtatcgctgagttcacagagaagctttatggcggtagggcaaaagaaaatgccgatgataacgtccgcactatccttatgtataaggctgtcagacgtcttaagcagaccaaggatatccgcttttataaaaagagtcttgaaaagggcagtttcttagccgaacttaacgaacttgtgagccagtttcgtgaaagcggaataacaccacaggatctagctcttgctgctgagaagcagagcggctctcttgccatgaaactttttgatatctcaaggctttatgatttttacatggatgagcttgaaaaggcaggaatgcaggatactctgtcagcaatggcaagaagtgtggatcaggtgaagaaaaacggatatttccgtggaatgacagtttttgttgacgctttcaacgatttctcttttgatgaacttaaaatgcttgacgcttgtatcgcgcagtgcaagaatataacgttctctctatgtatcgacaatgaaagcattagaagatatgcaaatcacccttttgctgatactcttaaaacgttgcagcagataacagatatttccgctgatcataattacaaggtcaacacggtagagtgtcgtaacagctcatttagagtccctgaacttgaatatgtgagcaaagagatttacaacacctgcaaaaagccatacatcggaaagtgcgaaaatgtttctgttatatcagcaacggatatttacgaagaaagtgaatttgtcagtggaaagatatgggagcttgtcagagaaaaaggctataaattcagtgacatagctttgcttgcaagaaaccttaaagattgtgcttccgtttttgagggtacgtttgacagatatgagataccatatttttcagactgcagtgatagtgtttcttcatcatctctggtgaggtatatgaactcgcttttcaagtgcttgctttcaagaaagtattccacggacaatattttgaaatacataaaatcgccgcttttcccaatgctgaatatcgagatatcaaatctggaagactattgcatacgctggagcgttgatggtgatatgtggctcagtgattttactgttgcaggtgatctcagcgaaaaacagcttgaaaaaataaactgctcaagacgaaagataatcgagccttttgaagcatttaaaagcaaactttttaaagacattacagcaggggaactgtgccgtggactttatgatcttcttggcagcattgagctttctcagcagaccttttctgtagtaaaaaaggcaggaacttcggataacgaaactcagcttgaaatggcaagaggattgaaacaactttggaactctgttctttcggctatcaaatccgtctatgactgcatgaatgacgaagttatctccctcagacagttttatgagcttttcaagctcatgatttcgcaaatgagtgtttcacgtcctccgcagaaacttgactgcgtaaggatatgcgacccgagccattcaaggcttgagggcgtaaaggctgtctttcttgttgaggtgaacgacggcatatttcctgcttctttaagctctggtggactcatcacagaaaatgaaaaaatgatattagagggaagcgatattcatatctcacacagcgcaagaaaatcttttcagacagagaagcttgtgtgctacaacgcttttacccttgcagacgaaaagctctatgtgctttattcagaatctgaccttgtaggagaagttcaccgcccctctgcacttgtttccgagcttaacggaatgttcggcaaaatcaataccaaagctcaggatatggggcttgatttttactgcacttctttcaggacagcttaccataaatatatggaacattcccgtgataaaaacgctacaatttctgcgattaggtctgtgttggggttatcgcaggaatatgccgagaaacttatgagaacaaagaatcttcatgaaaacggtgactataagcttgaagaaaagacagcagaaaagcttttcatgtcagaacagcctgcaaaggtctcgcctactcagcttgatacatattataaatgcccgttcaattatttctgcaagtatggtcttggtcttaaaactgtcagaaaggcagatatcgacggacttaacaggggacttatcattcatcagcttcttgaaaagataatgcgtaaaggtgatgacggcacaggctttgacaatgctttccttactctctcagatgatgagataaaagagtatatccacaaaaacgttaccgaatatataaaggaaagccttggtggaatgtttggaaaatctccgtcatttgtatttttacaggagcgtatggaaagcaatatcctgcatatcattcgttttatgcagaatgagcttcttcactcaaaattcagacctgcgcttttggaatacaaaatagacaagtccgaggaagaagaccgacttatcatagatgtaaacggcagagataagataatccttacgggaattatcgacagagttgacgttttcgaggacgagaacggtgaaaaatatgtgaggataatcgactataaaacaggctctattgaccttaaatattcaatgctctacaatggccttaatttgcagatgttcgtgtatcttaccgctttacttgaaaccaaaaatccagtgaatatagacggtggattgaagcaggctggtatcgtatactacacgctaggaaacaagcctaaaacatacgagcagacagccgacgctgacgtagaagaagccgagagcagatcacggctaaacgctttcaagcctataggaaaagtcgttgatataaaggctgtcactgaagctttcagttcagaagaaaattacgcctatgcgccttttaaatattctaaaaccaacggcaattcaggcactgttccagacggcttttttacaaagctcagagaatttgctataggcaaagtggcgcagtttggtgaacagctttgccagggaaacattcaggcaagacctgtggcggaagcctgcaagcactgtgattttcacgatatctgcggcaggataaaccaagaggacgttacagacgttaaagacagcgtttatgaagaaaaacttatggaagaactaactgacagaaaggagaaaaaataattggctgatacaaaatggaccaaagagcaggaaagagccattagtgaccgtggcaagggcattatagtttcagcggcggcaggaagcggaaaaaccacagtgcttatagaacgaatgatacaacttctttctgatgaaaaaaataaaatacctgccgacagacttcttgcagtaacattcacaaaagaagccgcttcaagcatgaaagaaaaactcagccgtgcttttgacgaacagcttcgccgtgaccctgaaaataagtggttgcttagtcagcaaaatcttatccaacttgcgaggatatctacaataaattctttctgtcttgaccttgtgaaaagtaatctacatgaatttgattttcagggcggacttgatatacttgatgacagtgtgcaaaatcttattttgcaggaagctatcacgcaggcttatgaaaagctttgtgaagaagattacgaaagctacaaactgctgaaaaacgcttttgcggataaaactctcaatgaaatcaccgacaatctttataaattcatgcgttcgctgccgtttcctaagcgttggatagcagaggtacataaaaactttactgatgataagatttttgaaagctttataaaagataatatatgtgtagctcaaacaaagctgaaagaagcattttcaatgtatgaagtttttgaagaatatgcctgccgtaaagagatagaaggcataccttttataaaacatatcaaaatgaatgaaactgccgacagtgacagagaacttcttcataggttaagaaagcttcttgaaagcggcgatatagatactattgctaagtcagattggaaattcagcaccataaaaagatttcccacgaacaaggctttcaatgcatcacttgacgatgatattcgcattaagttcaaggacaattatgccttctgtgcatcatacagaaacaaatataaagatatcgtagctaaaattaccgatatgttcaataacacaaaactaatcatgaaggaaaatatgcttgaatctgacagaatatttactgttctgtgcagggtatgcgaagatatagacaagatctcacaagaaatgaagcttgaacgaaatggcgttactttttctgacgttgagataatggcgagagaattgcttgtaaaagataccgagaatggacctgttcgcacggagctttgcgaggaaattcgcagaaacaggctatatgagcttattttcatagacgaatttcaggacgtgaataatcttcaggagcttgttttccgctcgctttctgattctgataacttggatatcatgggaaaaaatgtttttgtggttggcgatataaagcaggctatatatcgtttcagactctcaaatcctgaacttttcagcaaaacgagaaatgacgcttccgcacctgaaaacagcgaacagctcgaggctatcttgctaagcaagaatttcagaagtcgtgagtctgtggttgattttgtaaattttatgttccactatcttatgacacagcacacaggtcaggtgaattatgatagaaatgaagaacttcgatacggtgaactttatgatgaaaataacaagcctacagaaataatgctcataccttttgataaggactacaaaaagacaaatggctactctgtggagaacaaagtaatagcacaaaagataaagcacatgcttgaaaacggtgaggaagtcaaagatcatggctctctaagaccgtgccgtgcaggagatttttgtatacttgttcaaaaaaatgatgaaattacccttatggcaaaagcccttgaagaagtaggtctgaaagcatattctgaggacacaaacggatacatgaagtcaagagagataacacttgtgctgaatatgctcaggataattgacaatcctatgaacgacattgcaatgacagctatcatgatgtcgcctatcatgggttttacgcctgatgaaatggcggaagtaacagaaaagtcaaagaagcctaacagcaaactgaaagaccatatctatcaagtggtagcggcgtcagcttctgctgaggacagccacgaaaaggaagctactcatataagctttaataataaaacattgcaggataagtgcatagagcttaataagcttattaattccctgcgttatctttcaatgagcataggtcttgaacggctcataagaaaaatatacgacatgaccgaccttatggggatcgtttcgctgtatcttgattctgataaaaagcgtgcaaaccttcgtctgcttcttgaatatgcttcgtcctatgagcaaaatagtcaagagggcgtaactggttttctaagatatatcgactctgtgtcctcgaatgaaaaagcctttaagcaggcaatgacggtaacagagggctcagattccgtatacataaagacctaccatgcttcaaaaggtcttgaatatccatttgtatttttatgtcagcttgacataccacttataaagaaagacaaaggttactgttcacataacaagctgggctttgctttcagttttatggataacagcaaacttatgagaaaaacttcactttactatgataagctttcaaaggaatcaaaagcagaggaaaaaagtgaaaaactccgcctgctttatgttggatgtacaagagcaaaagaaagactttttgtaagctatgcaccaattatttacagcaataccacatatgagaaggttattgaacgtaagatgggaatagttgacagacttagaaacatatactcaaagcagggagattctcttgaaaatgttgtggcggacgctgaaacgatgcttgattggataacaatcacgcttgcacttcactccacgggtggtcaactcacatcttggcttggcactgataatatagctgtcagcggggacgaataccctgagcctgagataatatataatgaatacggcattgaaaatacagagccgacacaggaagaagatacagctattagcgaaatagaagcggacaaaacaatgcttagaaatcttcttgacaaatttgcatttgagtatgactggtcaggagtatcaacaccagcaaagcttactgttacggagataactgcggctgaaaaagagaagcagacagagaaaaccgaacctgagttttatcctagtcttccacggcttgatgatgagtttgataaactatcagcagcggaaaagggaacttttacccacaaatttatggagttatcggactatgataaggctcatgaaagcgtaaaaacagagcttgaacgtcttgtgaatcaggggtacttcagccagaaagaagctgacggagtttatgttgaagcacttgaagcattctttagatctgatttttatgagcgtgtgaaaaattccgataaagtgatgcgtgaaaagaagtttcttgtttcaatgagcgatcttgacttaagtgaaaatcttcctgaatataatggtaacagcggtatgcttcaaggtatcgccgattgtatcttccacgagcctgacggatatgttatcgttgattataaaactgacagatttaaggatgtgtcacagctcatgggctataaaacacagcttgcactgtataaagcatcgtttgagatgatactcggagagaaaataaaaagctgttatatttattcattctggttgagaaaaggggttgaaatcaagctctgaatgtgatataatgacatatagagaactttgataatatttttttgaaataatttgagaaaaggtattgacaagtgggtaaaagtgtagtataatatcatggtaaacaaagcagaacaatgtccgttctcaccttaagcgcagatctctgtagtaaaaaggtcaacatgaatttgcatatcaatgtgattttatgcgggtacggatcagttctgtgcccgttttattttatttttggaggtgctgcgtcattagcaacagggaacatcagatcaacgaagagatccgtgataaagaactcagggtcatagacgttgacggaaatcagcttggtattttaagtgctgacgaggctcttaaaattgcatttgagaaagatcttgatcttgtaaagatcgctcctcaggcaactccgcctgtatgccgtatcatggattatggcaagttctgttttgaacagacaaagcgtgcgaaggaagcaaagaaaaatcagaaagttatcgagatcaaggaagttagaatgtcatctacgatcgacactcatgattttaatgtaaaggtcaatcaggctgttaaattccttaacggaggagataagataaaagtttctgtaaggttcaagaaaagaactttggctcatccacagttcggtgaagaacttcttgcaaaattcaaagacgctatctctgaagccggcgttgttgacaagccatcaaaaatggagggacgcagtcttgtgatgttcgtttctccgaaagtaaacaagtaaaataataaggaggataaatacaatgccaaagatcaaaacacattctggtgctaagaagcgtttcagtgttaccggtagcggtaaggttaagttccagcacacaaacaaaagacacagacttactcagaaggatcacaagcgtaagagaatcctgcgtggtgcagcttatgcagatgataccaacatcaagaacgtaaaggctcttatcccttacaaataaacgagttgtagggaaaacaaattttaaaaatttcaggaggtaataactatggctcgtgtaaagggagcaatgatgactcgtaagagaagaaataagactctgaagcttgctaagggatactttggtgccaagagcaagcacttcaaaatggctaaacaggctgtaatgaagtcaggtcagtatgcatacattggaagaaagcagaagaagagagatttcagaaagctttggatcacaagaatttcagcagctgctaaaatgaacggtatgaattattcaacattcatgaacggcgtaaacaaggctggtatcaatcttaacagaaagatgctctccgaaatagctatcagcgatcctgctggtttcacagcgattgcagaaaaggtgaaggctgctctttaatagttaaaaacacgcacgttcttgtaacctgcgtgttttgttgtatattaaggcaacaccatatatgacgcatttggcaactaaatgattaaattttcagaataagaggtgacgcagtttgcatattaatagtaaagataaccctagagtgaagcttttcagaaagcttctgtcatcaaaaaaagctagggaagaacatggattgtttgctgttgaaggtgcaagaaactgcgttgacaccgcttatgaagctgtgtgcggaagaataaaagtccattctgttttctatactcaaacggccttgactaaatataaaaatacacttaaaactgatagccttttctcgtgcacaagacccgaagatgtttttgaaatatctgatgagcttgcgaaaaagatgacagatgagggaaactctcagggcatttatatgatcgtttttaaggtcgatttgccttttgtggctgagtatattgacaaaaacgggaagtatctcgtgcttgataatttacaggacccaggtaatttgggtacgcttctaagaactgccgatgccgtaggcgttagtggagtagttatgacagataattgcgttgatctgtataacccaaaggtggttcgttccgctatgggaagcactacaagacttgatctttttgtagtggataattttctgaacgtcgcaacgctttttgatgagcttggcatcgttacaaatgctgcagttgtcagaaacggtgaaaatatcacagaatttgattttgatagaccgtgtgctgttgtaataggaaacgagggcaaaggtttgcctaaagaacattcagacatttgtaaaaatcgtgtgactatttctatgcacggcaacatagaatcacttaatgctgcttgcgcaggcacaatcattttgtgggaaatgtttcgaggtggcagtcatggataaagaaagacttttattgtggataagagcggttctgattttcactccatcgagcaaacgtatatgggaagtttctgcaaattatgatgatatagttgagttcatgactgcactcgatgatcatatggtcagcggacttaatgataaagagctgcagaggataggaaaatatagtcttaaagacgcagaaatcataaaaaaacgctgtgaagagcttggcataaatatttattgttacgaaagtgagggctatcctgacagacttaaacggatcgcaaatccacctgctgttctgtatacttatggtaaccttgactttttaaacgataaatgcgttatttcagtagtaggctcccgtgagccgtctgaatattctgtaaagataacgaagcatatttgcacagatcttataagaagaaactgtctgcttgcttcggggtttgcaggaggtatagatcagatcgctaacagggtagctattgaaaataatagtagacctatagctgtgtgtggcacagctcttgattgtgattaccctaagggaagtaatgagctaaaaaaacagatcgctgagaatggagtagtaatatcagagtattttccgggttataaaccatttggaagtgcttttgtgaatcgcaataggattcttacaggactttcaaatgcagtgctttttactgagtgtagcaaggaaagtcatggtcttgataatgtcaatcacgccatatctcaaggaaaacaggtatttgtagtaccgccacatgatatctatgacagtcgatatttcggacaacgtgatctcataagaaatgagtgtcaacctgtgttcggcgcagaggatatagtgtattcgcttggcaatgaaaggtatcaatctcttagacttgtggaaagcctgggagagttcacgcttcctgctgaggattctgctatacttaacaatggcaagcctaagacagtgaagcacagaaaaaacaaaagaaaagtgcctgacagcaagactgtttctgaaacagaagtggtaaagccaacacctgagcctgatctgtcagggcttgatgacacacaaaagagcatttgcgaactgttaaaaagcggaaatatgcttgcggacgagataggcgcaaagcttggtatggatatctctgatgtgcttgcacagctaacggagcttgaactttatggcactgttaagtcatatccgggcaaaatgtttggactttaatatatattaagaatggagaatagatttgtctaatttgatcatagttgagtcaccaacgaagataaaaacaattaagcgttatcttagcgatgattatgaagttgtggcttcaaagggtcatgtccgtgacctgccaaaatcaaagctgggcgtcgatatagataataattttgagcctaaatatgtcaatataaaagacaaagagggcgttataaaagatataaaaaagcttgcaaagaaaagcgaccatgtttatcttgcaggagaccctgaccgagagggagaagctatttcatggcatcttgcattgcttttgggtcttgacctgaatgataaaaaccgagtaactttcaacgaacttactgaaactggtatcaaagccggaatgagccacccacgttctattgatataaaccttgttaatgcacagcaggcaagacgtatccttgacaggcttgtgggctataagctttcaccttttctttggagaaagataagaaaaggtctttcagcgggcagagttcagtctgtcgcagttaaaatgatatgcgacagagaaaacgagataagggcatttgtatctcaggaatattggtccattgacggaaaattttctgcaaacggtgaaagaaagacctttgccgcaaagcttaatacagttgacggagaaaagccagagttgaaaaataaagagcaggctgacgagatactgaaaagacttgagggcgccgagtttgttatcgacaaggtaaaaaagagcgttcacagaaaatctcctgccgcaccattcaccacctcgactttacagcaggaagcgtcaagacgtctcagctttcaggcgagaagaacgatgaaaaccgctcaggagctttatgagggtgttgagataaacgatatgggtcagacaggtcttatcacctatatgcgtaccgacagccttagaatttctgatgaagcaagagcagcggcatatgattttatcagaaaaaaatatggcgataagtatatccctgacacaccgaaaaaatataaaactaagggcaacgctcaggacgctcacgaagccatccgaccaacacacccagaggtaacacctgatatggtaaaggcaagcggagtgacgagtgaccagtacaaactttataaactcatttgggagagatttatagcttctcagatgtcaaactgccttatggacactgtttctgttgatatctctgcaaatggttgtaacttcaaggcaacaggctattctgtaaagttcgacggatttactgttctatatgaagaggctaaagacgatgagggtgaaaagaaaaacgtgcttcctccaataaaatccggtgactcaataaaggtgcgtaaccttgagggaaatcagcatttcactcagcctcctgcaagatacacagaagcgacccttgtaaaggcgtttgaggaaacaggcatcggcagaccttcgacttatgttccaactattacaaccataataaacaggaattatgttgagcgtgacggaaaacagcttaagccgacttcgcttggcgaagtaacaaaccagcttatgagcgagcattttgataaaatagttgatgttaagtttactgcaaacatggagaaatctcttgacgaagtggaaaatggcaagaaaagttgggtaaaaactttgcaggatttttatagtgattttgacgaggaattgactgaagccgaggaagccatggacgggaagcgtatcaaagtgcctgacgaagaaacagatcaggtgtgcgagctttgcggcaaacctatggtaataaagataggcagatatggtaaatttatggcttgctcaggttttcctgagtgcaagaataccaagaaaattgttcaggaaacaggcggaatttgcccttactgcggaaagaaagtgcttttgaaaaagtccaaaaagggcaaaaagtattacggctgtgaggacaatcctgagtgcaagttcatgacatgggatgttcctaccgaagagaaatgccctaagtgtggcagtacgcttttccagaaaggcggaaagaacggaatactcatttgccataagcctgattgcggatatgaaaggaatttatctaatggcggttaaggtaataggtgcaggacttgcgggctgcgaagctgcgtggcagttagcccaagcagggatagacgttgagctttatgaaatgaagccgaaaaagtttacgcctgcccataaatataagggttttgcagagcttgtctgctcaaattcattgaaagcggacagaatagattcagccgcaggtatgctaaaagaggaaatgcgcaggcttggctctgtcacaatggaatgtgcagctgaaactaaggtatcagcaggcggagcacttgctgttgacagggaaaagttttccgatatggtcacggcaaagataatggaaaatcctcacatcactgttatcgaggaagaagtcacagatatacctgatggcgatgttataatcgcaacaggtcctcttacaagcgatgggcttgcagagagtatcggcaaaatatgcggtgattatctgtattttcatgatgccgccgcacctatcgtcacatatgaaagtcttgataaggataaggtgttttttgcttcgagatacggcaagggagaagctgattatatcaactgccctatgaataaggaagaatatctcaggttctataatgaacttatcaatgcggaatccgctccgctccatgattttgataaggagcatttttctaaggacgggttcaaggtgtatgaaggctgtatgccggttgaggtccttgccaaaagaggagaggacacaatgcgtttcggtccgctgaaacctgtaggtttgacagacccacgaacaggaaacagaccttatgccgtcgttcagcttcgtgcagagaacgcagagggaagtctgtataaccttgtgggctttcagacaaaccttaaatttggtgagcagaaaagagtattttctcttatcacaggacttgaaaatgcagaatttatacgctatggagtcatgcatagaaacactttcatcaattcgcctaagctcttaaatccgcagtttaatatgcgagatagagaaaacctttattttgcaggtcaaatgacaggcgttgagggatatatcgaatcggcggcaagcggaatttttgcagggttaagcatggcaagacgtttgcagggcaagcctgcggttaccttgcctgataccacaatgctgggtgcgctttcaaagtatataagcgatcctactgtggagaagttccagcctatgggatgtaatatgggtatcctgcctgagctgcctgaacgtataagagataagaaattgaaatataagatgatagctgaaaggggtcttgcagactttgacaaggctattgaggaattttaaggagaatgttatgaacatagtaattgacgctttcggcggagataacgcacctctcgaagtcataaaaggttcaattgacgcacagaaagatttcggagttgacgttactcttgttggtgatgaagaaaaaataaaaaaatgtgcacaggaaaacggacttgatatcacagctttacatatcaagcacgctgatactgttatcgagatatgtgaagagcctacagaagtaatcaagggcaagaaggattgttcaatggctgtgggcatgaaaatgcttgcagacggcgagggcgacgctttcgtttcagctggctcaacaggcgcacttgtagttggagcaacgtttatcgtaaagagaataaagggcatcaaaagaccagctcttgcaacaatacttcctacggcaacgacgcctacgatgcttcttgacagcggtgcaaacgcagattgccgccctgaaatgcttactcagtttggaataatgggttcggcttatatgaacaagatacttggtgttgagtcaccaagagtaggtcttgcaaatattggtgcagaggagtcaaagggcagagagctggagcttgaaacttacaagcagttgaaaaacgcacctgtaaactttgttggaaatatcgaagcaagacagcttcctatgggcgattgtgacgtatgcgtggctgacggcttctgcggaaaccttatgctcaagctttacgagggcatggcaaaattcttctcaggggagcttaaaacgcttctgactaaggatacaaagtcaaagatcgctgctcttatggtaatgaagaacgttaaagaattcaagaaaaaggtagactactctgagtatggcggagcgcctctacttggtactgcaaagcctgttatcaaggcacatggctcatcaaatgcaagagcattctataacgctattagacaagcaaaacaatttactgaaactaatgtgatagacgagatcacaactgctatcgagcagttgaaaagcaaacaggagatgttataatggacgagcaaaaggctcttaaagagtttcaggaaagaataggttatcaattcaaagacgaaaagctcctttacgaagctctttcccattcatcatttgcaaatgaaaacaagaaggcaagaaatagcaatgaaaggcttgaatttcttggagattcagtgctttctatagttgtgtcagatcacattttcgagcattacaagcatatgcctgagggcgagctgacaaaaatgagagcttcacttgtgtgcgaaaaagcactgtttgagttctcaaagaaaatagaacttggcaagtatatctttctcggaaaaggcgaggagataacagggggcagagaaagaccgtcaattatttcagacgcttttgaagcagttatcgctgcaatttatcttgacggtggtatcgagcctgtttcaaaatatatactttcattcatacctgaaaatatcacgcctgatggagttgttttccatgattacaagactattcttcaggagataatccagaaaaatcctgaggagagaatagaatatcaccttaaaggcgagtcaggtcctgaccataataagaaatttactgttcaggtacttttgaatacgaatgttatcggcgagggtacaggcagatcgaaaaagaccgctgaacagttggcggctaaagaagcattggaactaatgggctatggggcacagtaatatatctgtcttcgtgccgcatataggctgtccgcatatgtgtgcgttctgcaatcagcgcaccataactggtacagagaagataccgcacgctgatgatgttaaacgtatctgcacacaggcaatgaacgaagtcaaggacgtttcacagacggagatagcctttttcggtggtagctttacagcagtgccgagagaatatatgctcgaacttctttgtgcagcgcaggagtttataggcaacgacaaattcaagggtatcaggatatccactagacctgactatatcagcactgagatacttgacattctcagagataatcacgttacggctatcgagcttggcgcacagtctatgtcagatgttgttcttgaagccaacgagcgtggacatactgttcaggacgtcgaaaacgctgcaaagcttataaaaagctatggttgctttgaccttggtctgcaaatgatgataggactttataaaagcaaccgtgaaactgagctggaaacttggtcgaagatagcggcgctgtctcctaaaacagtacgtatttatcccgttgttatccttaatggtacaaggcttggagagctttacaaaagtggcgaatataagcctatggactttgacgaggtagtgaaaatctgttcttatcttctcacagaagccgataaacttggtatagatgttataaagcttggtctgcacgcaagcgaggtcgtggaggagcaaatgttgggcggattttatcaccctgcattccgtgaactttgcgaaggcagaaattaccgcagtcttatagcagaggagcttggaaagcatggcaatataagcgatatagcttccgttgtgatatctgtaccgaaaaggcagataagcaaggcaataggtcagaaaaaagctaatatagaatatttcaaagatcttggtgtcaatataaaaattgtaggtcacgagggcagcgataaaataaagataaacgaaatcataatgaggggtggtgaaaaataatgtatcttaaatcacttgaattgcagggctttaagtcttttccggataaaatagagctgaaattcaataagggtatcaccgcagttgtcggtcctaacggctcaggcaagagtaatatcggtgacgctatgcgctgggtaatgggcgagcaatcttccaaagccctgagaggtgaaaaaatggcaggcgttatttttcatggcactcaaactagaccaaaagcgccttttgctcaggtaactatcaccatagacaacgaggacggtgcacttgaatatgacagcgacaccgtgtcagtatcacgaaagctttaccgcaatggcgacagcttttacatgataaacggtaaagaagtaaatttaaaggatatcgtggaactgtttatggacaccggtcttggcagggacggttattcgataatcggtcagggcaggatagcagatatcgtaaacggaaaatccaatgaccgccgtgagatatttgaagaagcggcaggtatttcaaaattccgttcaaagaaaaaagaagccgaaaaaaagcttgcggcggctgaggataatctctctcgtatcaatgacatcatgggagagatagaaggacgaataggtccgcttaaagcgcaggctgaaaaggcggagaagttcagagtccttgatgaagaaaagagaaagctggaagtctccgtatgggtgcataagctcaacgagtatatgagccaaatagcaggttatgaggagaagctttctgctgtaaaaaaagagtacgaggtcatcacgcaggagcttgaaagcattgaagatgatataaatgacagctttgcaaagagcgctgaaaaatctgagcttgctgacagctacaaaaatcaaatacatcaggtggagcttgaaaactctcaggcactgtcaaagatcgcagtatatgagaatgatatttctcaccttgaagataatattttgaagcttaaagagcagataagtgagtccaactcatcaaaatactatcttgaggctgagctgaaaacacgcagacaggagcttgaagaactcgacgagaaaaaagcaaagcagcaggaagccgtagattgtaaagaaaaagagctttctgagcttattgataaaactgcattatctgacaagtcggtaagtgaagctggaagctttataaatgagctttacatgaaaaagtcggaagtttcattcagacttgaaaatgctaaaaacaacctttcggatattgatgagcagatcgaaaattctcttgaaagaaaaaaacagcttgaagaacattcaaaactttcttcaaaggaattaaaggaactgtgtgaatcaaaaggcaaagctgacgaaaacaagcaggagcttacaaaccgcttgagcggacttgcaaagcttcttgaaactagaaacacaaagctttcagaatgtcgcaaaaatctcacagatacggaaatacagctccgtgacgttgagaacaggataaagactatagccgaccttgaaaactccatggagggctttcagttcagcgtaaagcacataatgaaagcctcacagcagggtaggataagcggcatttgcggtactgtttctcagcttatatctgttgaaacaaaatactctgtagccattgaaactgcgttgggtggggcacttcagaatattgtcgtaaacaatgaggactctgctaagagaggtatcaggcttctgaaagagaacagatcaggccgtgcaacatttctgcccgttacatcagttcgaggaaacaggctaaatatgccgcaacttgaaaatgaggacggctttgtggctctaggctgtgagcttgttaagtatgacagccagtttgagggcgtaatcaacagccttttaggcaggatatgtatagcagaggatatcgacagtgcaacccttatcgcaaagaaatacggctataaattccgcatcgttaccctggacggacaggtgataaacgcgggcggctcattcacaggaggaagcgtttccaaacagacaggtctgcttacaagaaaaaatgaagcggaagcacttgctaaaaagaaaacagcacttgaaaactcctttacagagcttaaacagcaggttgagaagctaaatcaagaggtttcaaaatacaccgctgataccgagggactaagggaaaagctttcacaggtaaacagcgatatactccgttttgaaatggaaataaagcgtgtttcagagtattattctgactatgaaaacaagcttgatgagatagaaacatttatcgaaacgctgaaaaataaatacaagatagtaagcggagatatcgacaaggctcagacagaactttcagaaatcgaagctgagatatctgataatgaagccaagcttgccgactctcagaacgagcaggcagaacttaaaaataagcgtgaacagctcagcgaagagctttcgcaaatgaagataatggcggcagagttatccaaagaccttgatgcctgcaagctttcaatatcacagcttgaagaaactatcggcgacagtgatactgacagcggcaagttgaacgataatatctccgagtgtgaaaagaaaatagccgagaagaaagagcttatttttcagaccaaacaggaactcagcggcgctgacgaaaagatagccgccgcacagaaaatggcggagcaggctcagcgtgagcatattgagcttgacaatgcagcaaacaaacttcgcaccaagcaaaagcacaaaatggacgagaaggaaacactttcaggtcagcttacaagagcggaggaacagaaaaaatctgttactgcaggctttgataagcttgtggcacagctttgggacgattatgagcttacaagaagcgacgctgcagagatagccgaggatattgtggatataacggtagctaacaggcgactcaacgaacttcgtggaaagataagaaatcttggaagcgtaaaccttggagctatagaggaatatgcagaagtgtcacaacgacacgaatttctcacaggtcagcttaatgacgtaaatacgtcaaaaacagaacttgaaaaacttatcgaggatctgacagaaaatatgaagaatatgttcaccgacagctttgagcgcataaatgcgaacttcaagaaaattttcaccgagcttttcggtggtggtcagtgcgagcttattctcacagacccaaacaatgtccttgaatgtggtattgagataaacgttcagccgccaggcaaggtcataacaaaccttatgtccctttcaggcggagagcaggctctggtggctattgcaatttattttgcgatcctgaaaatttcgccatcacctttctgtcttctcgatgagatagaagcggcgcttgatgatgtgaacgtaagtaaatatgcacaatatctgcaccaccttacagataaaacacagtttatcaccattactcacagacgtggaacaatggaagaagctgacgttctgtatggcgtaacgatgcaagaaaagggtgtttccaagcttcttaaaatggacgtttcggaaacacgtcaaatgaaacttgaataggagtgaagaaatgggattttttgaaaagctgaaaaatggtcttaaaaagactaaagactcaatgatgggcagaatagaaagtctgctccattcattcagcaaaatagatgaagatctttttgaggagcttgaagaaacgcttatcctctgcgatatcggtgttacaacttctgaaaagatatgcgataagctcagacagaaagtcaagcaggagggcgttaaagagcctgaaaaaatcaaggatatgcttaaagagataatcacagaaatgctcggtgaggatcagaagctcgatatgtcaacaacaccgtcagttatactggttatcggtgtaaacggtgttggcaaaacaacaactatcggcaagcttgcttatcagcttcacaaacaaggcaaaaaggttatcgttgcggcggctgatactttcagagcggctgctattgaccagctcgaagtgtggacagagcgagcaggggtagacataatcaagcacaacgaaggttcagaccctgcttccgtggtatttgacgcactggcggcggctaaggcaagacaggctgacgttgttatatgcgatacggcaggtcgtcttcacaataagaaaaaccttatggacgagctgaaaaagatatcccgtatagttcaccaacaggcagagggctgcgctctcgaagtcctgcttgcgcttgacgctacaacggggcagaacgcagttaatcaggcaagacagttcaacgaagtagctgatataacgggtattattcttaccaagcttgacggcacagccaagggtggaataattatcagcataaccgacgatctgcaagtgcctgtaaagcttgttacggtaggcgaaaaaatagacgacatacagccgttttcagcaagagattttgttgaagcactgtttgaataatagaatattggattagacacttaaaagtataaaatcagggggaatttttttatggataaggttttgtttgtagttgatatgcaggaaatgtatgtaggaaggggcagagataaaaccacatactcatatgatgccgaatctcttatcgacgccataaacaagcgtatctctgcttataaagctgaggaggtcttttatatcgtcagctacaaaaaggggcttctgggtggaggaatgcccaaagagggaacacctgcggctagctttccagcaaagctgaaagttgtatccaaaaatatttattccaaaagcaagcccgatgctttttcaaacgttgctcttgaagattttatgagagcaaggaatgtgaaagagatagaatttgtaggtgttgatggtggtatctccgttatcaacactgcaataggtgctattgaatgtggaatgaaagttgttttcaacgaagaatgtatcggtacagttttcaaagataaggcaaacaaatgccgtgaaaaattaaagaaaaataaggtaacttatatacacaactaaaggagaaaaaatgaaacttgttattgcaagcaacaataaaggcaagataagagaatataaacagattcttgagccgcttggttatgaggtgttctcgcaatcagaggcaggtctgatacttgatgttgaggaaacaggcactacttttgctgaaaactctgcactaaaagcaagagctgcattcaagctttgcggctgtgctgtacttgcagacgacagcggtcttgagatagacgccctggatggtgagcctggagtatactcagcaagatatggcggactcgaaactgatgatgagcgtaccgctcttgtgcttaaaaaaatgaaagaaatacctgatgataaaaggggagcacactttacctgtacaatacactttatcaaagcagacggtgaagagatagccgttgagggaaaagtattcggtaagatagctcacgagcctgttggcgaaaacggcttcggctatgaccctattttcatgtatgggaacaagagctttgctcaggtggactcagaaacaaagaataccgtttcccatagagcaaacgcactgaaagctttgcttgaacagctcacaaagcagtaaactgaaaggatttagattatgattacaactaaacaaagagcagaactcaaaggtatggcttcgcttatacagcctgcttttcagataggcaagggcggagttaatgacgctcaggtggcacagatagacgattatctgagagttcacgagcttgtaaaaataaaggtgcttgacaactcaatgtacaccgcaagggaagccgcagaggagatcgctgaaaagatatctgctgaagtcgttcaggtaataggctcaaaggcggtactttataaacgcaatgagaagcagcctgttataaaattaaagtcaaagtaatgaaaataggtgttttcggcggcacgttcaatcctgttcacttagggcatctaaattgccttaaaagcgtagcggagcaggcgggtcttgacaagatgatcgtcatgcctgacagaatacctccacataagcaagcggaggacttagcttcctctgaggataggttgaatatgtgcagacttgcttttgcagatatcccatgtgttgaaatatccgattgggaacttaagcaagagggcaaaagctattcagtgataacactcagacatctaaaagagatatatccacatgataagctgttttttataatgggcagcgatatgttgctttcatttgaagaatggtatcagtataaggagatattatcactttcggcacttatctgcgttgcacgctcgcatgaggacattgacctcatagaggtgaaagccaaacagctcaaaaccgagggtggagagataatcatagtaaaaactgacccatttgaggtgtcttcaactgagatacgtcaaatgctcaaaaaaaatgttgattgctcttgctatttgagtgaaaatgttgtacaatatatagtggacaaaaatttgtataaccgaggttttctaagtggcagataaaaaaacaataggcatttataaagcatacctaaaagaacatttatcaaaaaagagatacacacactctatgaacgtggcaaattccgctgtggagcttgcaaaaagatatggtgctgacgcagacaaggcttatattgcaggacttttgcatgatgttgcaaaagagataccagcattggagcttgcggctatagtttctaaatcttcacttgatgtgtgcgatatagagaaaaaggctgttccgctgtttcacggtattgcaggggcagagcttgtgcagacgctttttgatatccatgaccctgagataatctcagctatacgctatcatacagttgcctgtggcaatatgcccaagcttagccagatagtatatcttgcagaccttatttctgcggacagggattataaagacgtaaagaaaatgagaaagtatgccgaacaaagcttggagaaagcaatgtttgaggctttgaaattctcaataaaagactcagtggaaaagggtaatactatccctgtttccacacttgaagcatataatgattttgccgataattcaaaataaaggagatttttatggataatatttcacagaatgaaaagctgtcaactattgttaaagctcttgattcaaaaagagcagaggacatcaggataatagagatcggtgatctgactatagttgcggattattttgttatagcaaatggtacttcaagcactcagacaaaggcccttgcggaggaagttgagttcaaaatgagccagcttggcattgaacctaacagaacagagggctatcagggtgcaacttgggtcgtgcttgattacggtgatatcatagttcatgttttctataaggagacaagagatcattacaatcttgaaagactatggtctgacggcaaggatatcgacgtaaagcagttcttaccagacgagccacaggattaattttgacaattataatttaacaaaggattgataaagatgaaagaatacaatttttcggccatagaaagcaaatggcagaaatactgggacgagcataagacctttgaggcaagcaatgacttttcgaagaagaaattttacggacttgtagagtttccttatccgtcaggtcacggtatgcacgttggacatatcaaggcatattccggtctagaagttgtaagccgtaaaagacgtatgcagggctataatgttcttttccctataggctttgacgcttacggtctgcctacagagaacacagctatcaaaacaggtgttcacccaagaaaggtaacagacgacaatatcaagaagttcacggggcagctcaaaagagtaggtttttcattcgattggtcaagagttattgatacgaccgatgaaaactactataagtggacacagtggatattccttaaaatgtttgagaatggtcttgtattcagagataagaccctcgtaaattattgcccaagctgtaaggtcgttctttcaaatgaggattcacagggcggtcactgcgatgtttgccacagcgagatagttcagaaaactaaagaagtatggtatcttaggatcacagaatacgctgacaagcttcttcagggacttgaagaagttgactatctgcctaacatcaaactccagcagcagaattggataggaaaatcaacaggtgcatttgtaaacttcaagatcaaagagcaggacgagcagctcaagatctacactacacgtcctgacacactttacggcgttacattcatggtaatcgctcctgaacatcctatcatccagaaatacagaaatagtattgcaaacattgctgatcttgacgcttataagacagagtgtgcaaagaagagcgaatttgagagaactcagctcgttaaggataaaacaggcgttaagatagacggtctgacagctatcaatcctatcacaggcaaagagatacctatctacatctcagactatgttatgatgggatacggcacaggcgctatcatggctgtgcctgctcacgatacaagggactatgattttgcaaagaagttcggcattgacataatcgaagtcatcaagggcggcgacatttctaaggaagcctacacaggcgacggcgaaatggtcaactcaggtgagcttaacggcataacaaacaagaaagaagctattgaaaagatgcttactgttcttgaaaaactgggctgcggtgaaaagggcgttcagtataagatgaaagactgggctttcaatcgtcagagatattggggcgagcctataccgatagtacattgccctcactgcggaatggtcgctgtgccatatgatgagcttccactcaagctgccaccagttgaaaactttgaaccgggcacagacggcgaaagtcctctggctaagatagactctttcgtacactgcaaatgtcctaagtgtggctgtgacgcaaagagagaaacagatacaatgccacagtgggctggttcttcgtggtacttcctgcgttattgcgatcctaacaacaatgatgagtttgcttcacaggaagcactgaaatattggatgcctgttgattggtataacggtggtatggagcacgttacacgtcatatgatctattcacgtttctggcacaagttcctctacgacctcggtcttgtaccaacttcagagccttatgcaaagagaacagctcagggtcttatccttggacctgacggtgagaagatgagtaagtcaagaggaaacgttgttgaccctaacgatgttgttgacgaatacggtgcagatgttctcagactttatgttctgttcatgggtgactatgaaaaggcagctccatggagcgagagcagtgttaagggctgtaagagatttgtggacagaatttgggctttgcaggataaggtagttgacagcgacgagtacagcgacaagctgagatcgctcatgcacaagactatcaagaaggtatccgatgatattgagtcaatgaagttcaatactgctattgccgcaatgatgacgcttcttaatgagatatataatgttggctctatcacaaagaaagagttcagagatcttcttatcatactcaatccttttgcacctcatgttacagaagaactttatcagatgatcggttgcgagggagttcttgacgagcaggagtgggtaacatatgatgaagcactctgcaaggacgatactatcgagatcgtttgtcagataaacggcaaggtaaaatctaagctcacaatacctacagacgcagctaaggacgacgttatcgcactcgctaaggctgacgaagctatcgttaaggcaacggaaggcaaaaatatagtcaaggaaatctatgttcctaacaagcttgtaaatctggttgtaaagtaagcgaaaatttcctcagaaaaatcaaaaaaagagccagaaagctattgactttttggtggaaatatagtataattaaatttgtaattatatcggttttataaattccgcagattaaagacagagcggtccgaaagagtaggactgggggaacgtaaagcgtttcagtttgcttttgcagacaccttcactatcaccgttgattttcggaaattccgatagaattgcctctgtcacaggtggcaaagggagggaataattttggcagaaatccgtgttggaaagaacgaaactttggatacagcacttaagcgtttcaagagatcatgtgcaagagacggcgttatcgcagaggttcgtaaaagagaacactacgaaaagccttcggtaaagcgtaagaagaagtccgaagctgctcgtaagcgtaaatactaatatgtaattaaaggcgggcatttttatgtccgctttttattttatacaacaggagtttttttatgttcaaaccaacttatgtttttgacaaggtaggagagataacccccgattttcttgataaaaagcatatcaaggggctgctcctcgatcttgataatacgctgacaacacataacaatcccgttcccccgcagtcgagtcttgattggcttgctaagatgaaagcggcagggataaagcttatgatcgtttcaaacaatcatgctccaagggtaaagccttttgcagagcagttggagcttgactttgtacctgaaggcaaaaaaccgctgacctttggatataccaaagctatagctaagctggggcttaataagaaaaatgttgcggctgtgggtgatcagatattcactgacgtgcttggctcaaatctgaaaggtatacgctccatattcgtgttcccaatagagcctgaaacgagcttgccatttcgatttaaaagagcctgtgaaaagccgtttttaccaaagcttaaatagcataaaacgaaaggaatgatactaatgtcggcaaaattcggacctgcgggaaacagcgaggctttttccattaaatataaaacaacacttcaagctccgggatatctcgaagcaatggggcttgaccactatgaatatcagtgtggcaggggagttaaggtctccgataaaatagcttttgccttgaaagataaggctaaagagcataatatcacgctttcgctccatgcaccgtattttatttcgctttcaagccttgaagctgaaaagcgtgacaacagcataaattatattctgcaatcctgtgacgctgcaagcagaatgggtgctgatagaatagttatccattcaggaagctgtgcgaaaataagcagagaggacgctttggaacttgctaaagatactctcacaagggctagaaaaacagccgttgagcagggctttgagcatatcgttttttgccctgaaactatgggtaaggtaaatcagcttggtaacttaacagaagtgctggagctttgcaagcttgatgatacgttcctgccgacaatagatttcggacatctcaacgcaagagagttcggctatataaaaggtaaggcagaatatgagaaaatgcttgatgaagttgaaaatgctatcggtcacgacaggctgaaaatattccacagccatttttctaagataatgtttacaaatccaggcggcgagaaaaagcacctgacttttgacgataatcaaggctttggacctgactatgagccgcttatggagatagtcgcaaagaaagatctttcacctatattcgtctgtgaaagtgcaggcactcaggacaaagacgcactgacaatgaagaattattatttgtcggtgaaataaagataggagagtatttatatgaaaaaaatacttgttatacatggtcctaaccttaatcttctgggcgagcgtgagcccggagtttacggtacagatacatttgagagcataaacaacgagataatcgagcatgcaatgaaatatgagtttcactgcgacgtttatcagtcaaaccatgagggtgaaataatcgacaagcttcaccttgctagaaaaaattatgacggcgttatacttaacgcaggcgcttatacacactatagctatgctatcagagacgccatcgccgcaataaagattcctgtcgttgaggtacatctgagcaatatacactcccgtgacgaattcagacacacttctgttatcgcacctgtatgcgtgggtcagataagcgggttcggaaagtattcatactacatggctgttgacgctttgtattacaaatggaaaaatgaaagcggtgcagacaatgactgatcttgaaaaactttgttcacgagtaacagaagcggcagattgtgctgttatcactgacgatgtgaacagaagatatttcaccgcaatgaaatcaagtgcaggaacactagtggtttttccggaaaaagcgtattttatcatagatttcagatatattgaaaaggcaaagaaaactgtcacagcttgcgaggttattttgcaggacaagctctatgagcagataaacagccttattgaaaagcatggtgcaaaaacagtttctgttaatgccgatacctgcacactttccgagcttatcgcatatcagcaaaagcttaatgttgaggtcatcgcagacacaaagcttgcggaaataatacgagagatcagaacagttaaatcccaagagcagatagacaagataatcaaagcacagcgtatcgctgaaaagggttttgcacatatgcttgactttatcaaggtcggcagaactgaaaaagaaattcagctggagcttgactattatatgcttaaaaatggtgctgaagctctgtcttttgacactattgcactttcaggctctaatacttcgcttccacatggtgtaccatctgacaaaaaagttgagagcggtgagttcgtgcttatggatttcggagcaacttatgatggctggcacagcgatatgactagaactgtatgcgtaggcaaacctagtgacaagatgaaatttgtatacgaaactgttcttactgcacagcttgcagctcttgacgcagtaaaggcaggtatgtcaggaaaagcacttgacaaaatagcaagggatatcataactgaagcaggctatggagataatttcggccattctctcggacatggtgtgggagttgagatacatgaaagcccttattcttcgcctagcagggaagatatattgcctgaaaattcgatcgtaacagtagagccaggtatttatcttgagggcaagtttggtgtgagaatagaagattttgttgttgttacagaaaacggctgtatcaatatgacaaaagcctctaaagagcttatttgcttgtaactttttttgattttttggtaaaaaagttttcaaaagctattgcaataaacaaataaatatggtaaaataaatatagaggtatgcggacattttgaactgtgtacacattaattaagaatgtttatggaggtactaaataatggtaactgctggtgatttcagaaacggcgtgacttttgaagaggacggcaacgtaatgcagatcgttgagtttcagcacgttaaacctggtaagggtgcagcgttcgtcagagcaaaggttagaaatgtaatttcaggttctgttgttgaaaagacatacaatccaacagctaaattcccaacagcatatgttgagagaaaggatatggagtattcttacaatgacggtgatctttattatttcatggatccagagagctatgagcttgttccagtaaacaaggctgagctttcagataactttaagttcgtaaaggaaaacatggtatgtaagatcctttcttacaagggcacagtattcggcgtagagcctccatactttgttgatcttgaagtaacagagacagagcctggtatcaagggcgatacagctacaaatgctacaaagcctgcaacagttgaaactggtgctgagatcagagttcctctgttcatcaacacaggcgacagaataagaatcgatactcgtacatgtgagtacatggaaagagcataagttttagactttacggttttttagaaacggagggaatattatggagctgtcaaagaaggttgcatatttaaagggacttatggaaggtcttaaaattgacgattccacaaacgaaggcaagatattgacaattatggctgatattcttgatgagatgtctgctacagttgaagatattgccgaagaagttgacgaaacagttgagcttgtagatactcttgacgaggatctcggcgagatagaagatctaatttacggtgatgatgatgacgacgactgtgattgtgacgatgattgttgctgtgatgacgaatatgacgatgatgaggacgctatgtatgagtgtgtatgccctaactgcggtgacacaataatgctcggcgagaacattatcgctgacggttctattgactgtccaaactgtggagagagccttgagtttgatttctcagaaattgaggacgaggacaacgaggattgatctcataaaaagtgttcagcaaaatttaataatgtgtttcaggggtggtgaaattccacaccggaggtgatcgaatagtattcgtaagtcctcgaccgcagaaatgcgctgattcggtgaaaatccgaaaccgacggtaaagtccggatggaagaaacgacagatcaataacgcataaattgcaccctgattttattttcagggtgcttttgcttttgctgctgtttctcccgataattttattatttggaggaattaaaatgacaagtgataacactatgccaagaaataaaacttttacaacaagaaaaatggtaacggtggcaatgctcagcgccatagctactgtaatatattaccttgattttcctgtgccacttatgccaggatttatcaagcttgacctttcaaatgttatatccctgctggcaggtttctcaatgggacctattgcgggcgtgatcgtttgccttatcaagaacgttatccagttgattataaagggactaggcacaacaatgggtatcggcaacatctttgactttgtaacaagcgcagcttttgtgctgacggcttctgttatataccacaagaaaaaaaccagaaagaatgctatcataagctgtatcattggcactttggttttcacagtaataagcttgccgttgaattattttatcgtttatcctatatactttaaagcattcggcggagaagctgctatactcggtatgtaccagcagataatgggtagcgtaaagaatattttctctgcactgtgtattttcaatctgccttttacttttgtgaagggtattatttgtgcattggtcacaattcttatttataagcctttgtcgcctattcttaaaggcaaagactaaaacaaaattaatgctgaacacaaaaaaagccttggcaggcacattcctgtcaaggctttgatatttattatttaactgctttaagaagatcattgatcttgtctgtcttttcccaagctacatcaagatcctcacgtcccatatgaccataagctgcaagctgcttgtactgtggctttctaaggtcaaggctcttgattattgcagcagggcgaaggtcaaataccttttctacagctgcctctatcttttcatcagaaacctttcctgtgccgtatgtgtcgaccatgattgaaacagggtgagcaacaccgatagcgtacgcaagctcaacctcgcacttcttggcaagacctgctgcaacgatattttttgcaacgtatcttgcagcatatgttgcgcttctgtcaacctttgtaggatcttttccagagaaagcaccaccaccatgacgagcatatccaccgtatgtgtcaacgattatctttcttcctgtcagaccgctgtcgccctgaggaccgccgactacaaatcttcctgttgggtttacaaaataagtagtgttttcatcaagaagttcagcagggatgactgtctttataacgttctcgataatatcttctcttatctgctccagtgttacagcgtcatcatgctgtgaagaaactacaacagcgtcaactcttgttggcttgccatcatcatattcaactgttacctgagtttttccgtccggtctgagatatggcaaagtgccgttctttctaacttctgtaagtttaagagcaagcttgtgagcaagtgatataggcattggcataagttcaggtgtttcgtcgcaagcaaaaccgaacatgataccctgatcgcctgcacctgtatcgaatgcgttttcagctctgccttcgagagcgttgtcaacacccattgcaatatcaggcgactgcttgtctatagttgtgagaactgaacaggtgtgtccgtcaaaaccatacttgtctctgtcatagcctataccgacaactgtatctctaacgatctgtggtatgtcgattatagcctttgttgttatctcgcccatacacattactacacctgttgtagtgaccgtttcgcaggcaactcttgacataggatcttgctctagcagagcgtcaagtatagcgtcagagatctgatcgcatattttgtcaggatgtccctcagtaaccgactcagatgtaaataaatactttgacataaaaatacctcttttctgaatatttgttaatctaaaaacagccacaaaaaaagcgcttcattccgaaacgcttgaaattactcaatttcctcatctttcggaaataaccgcaggatttagcaccttaactaacgctaggttgctgggcttcacaggacctgtttcctccaccactcttgataaggctatttaattttaacaatatatattatacaccatatatcgactattgtcaactgttttacacataattatagattattttaatgtttcgtaataaatcagcaaatgctaataaaagcattgacttactatgacaagttcgttataatataaaaagaggtgagttttttttgaaaaatgacaattcaaatataagaacattgtttctgacctttcttaagataggcgtttttacctttggtggaggatatgcaatgatagccttgctcgaaacagaattttgtgtgcgcaaaaattggcttgataaaaaagaatttctcgatatgacagctatatcagagtccacccccggaccaactgctgtaaacagtgctacatatatcggctacaaaataggcggtgtgctgggtgctattgcggcaactgtcggtgtgtgcataccgtcgttttttataatctacataatatcacttttctttgacaaatttctgtctttaaaagtagtctacgctggattccgtggcattcaggtgggcgtaatatatctcatacttactgcaggactaagaatgttgaaagcacttgataacacattgcttgacaaaattataattcttggagttttcataatgatgatacttttcacacttttttctgtgaagttttcatcagtattttatattatcataagtggtgctgtgggcattgctgtgtatctgattaaaaccctcagaaagggaagtacaataaaatgatatatctcaaactttttctcatttttcttgaaataggcgcagtgtcattcggtggaggatatggaatgatatccattatccgtgaaaaagttcttacctttggctggctcagtgaggacgaatttgtgaactttattgccgtatctgagtccacccctggaccacttgcagtgaacatggcgaccttcgtaggctcatcgcaggcaggcttcgcaggcggattgatagccacccttggcgttgtgttgccttcgttcgtgataatatttatcatagcttcgatcatgaaggatttgctgaaatactcaggggtaaaagcaatgctttcaggcattcgtccttgcgttgttgctatgatactcgccactggcattacaatggctttatcttcactgctaaatatcaccaccataaattcaaagcctgcttttgactataaagcgttgataatattcctgctcatagccttggcagatgtgcttattttgaaactgaagaaattcaagctttcaccgatcacaattatcgtaagctccgcctttctcggcataatattctattaaaaaaaagctgtaacaccgcaaagtgctacagcttttaatatttgtgatatgaaaattaacccagaaactttttaagtctctcgtcaacagccttaaggaagtccactgtatttactttcttcttattttcaagtgtagaaagcagataaagatcacctgtcataacaccgtcttcaatagtttcgatagttgccttttcaagacaatcagcaaagttcataagctcaggcaggttatcgagttcgcctctttttctcagagcgcctgtccatgcgaacagtgtggcaactgagtttgtagaggtttcttcgcccttgaggtgcctgtaatagtgtctctgaacagtgccatgtgcagcttcgtactcataaattccgtcaggtgaaacaaggacagaagtcatcatagccagtgagccatacgctgtagctaccatgtcagacattacgtcaccgtcatagttcttgcaggcccagatataaccgccatttgagcgaataactcttgcaacagcgtcgtcgataagagtatagaaatactcgataccagccgcttcaaatttagccttgtactcgttatcgtatatctcctgaaaaatatccttgaatgtgtggtcatacttctttgaaatagtatcctttgtagcaaaccaaacatcctgcttcttatcaagtgcaaaattaaagcaagctcttgcgaatgaagcgatagaagttgacttgttgtgctgaccctgaatgattccgtcgcactcaaagttgtaaattgtttctctagtttccttgccgtccttgtcagtgcaaacaagctctgcctttgagccagcagggcacttcatttcaacgttcttataaacgtcgccgtatgcgtgacgagcgatagtgataggctttgtccatgtaggaatgtaaggagtgatacccttaacaaggataggagttctgaaaacagttccgtcaaggatagctctgatagtgccgttaggggatttccacatttccttgaggttgtattcaggcattctcgcagcgttaggtgtgatagttgcacacttaacagcaacgccgtatttctttgtagcatttgcagaatcaacagttacctgatcgtcggtctcatttctatgaacaagaccaagatcatagtattctgttttaaggtcaatatatggagtaagaagaatatcctttatatcctgccagataattctggtcatttcgtcgccgtccatttcaacgagcggtgttttcatctgaatttttgccattggtaagacctcctataaagtaataatggaatatccgttgtttttagctatcgcagatatctttttgtaaacgtcaagacttgcaataataagctcatagctgtcgctgtcaatatctatcatacatatgcaagcacctttgagagtgctgtcctttgtgccgaaaagtttcgagaaaatcccatagggacctccatatcagactttattattttgagagctgttctcttgtgtagtcaagcagaccacctgcaaggataatatcctttgttctgcctgtaagctcgcagagaactggtatctcaacacctgttgtcttattcacaacagtaagcttagacatatcagcctcaacgtctgcacgaacgtcagcaagaacgatctcatcgccctgatttatcttgtcatagtcagcttcatttacaaatgtgagcggaaggatacctgcgttgataagattagctctgtgtattcttgcaaagctcttaacaagaacagcctttatgccaagatagagaggagcaagtgctgcgtgttctcttgatgagccctgaccgtagtttgagccgccaacgattattgacttgcccatgttctttgcacgtcttgggaagtcctcatcacatactgtaaagcagtgctgtgaaatagcagggatatttgaacgcaatggaagtatctttgcgcctgcaggcatgatgtggtcggttgtgatattgtcgcccaccttaagtgatacctgacaatcaatgctgtcatcaagcggtgaagtctgtgggaaaggcttgatatttggtcctctaagaacctcaacgctgtccatatcagcctcgtcagctggcggaacaaccatattgtcgtttatcttgaaatgctcaggaagcttgaactcaggcatatctccaagtgttcttgggtcagtgaggtagcctgtgagagctgaaacagcagccatttcaggtgataccagatagatctgaccgtcctttgtgcctgaacgtccctcgaagtttctattgaatgttctaagtgaaacaccctttgagttaggtgactgacccataccgatacatgggccgcaagcggattcaagtattcttgcgcctgctgctatcatatcagcaagtgcgccgttctcagcgatcatgttaagtacctgctttgagcctggagcgattgcaagtgaaacgctagggtcaactgtcttgcccttaagaatgtgagctactttcatcatgtcaacataagaagagtttgtgcatgagccgatacaaacctgatctatcttaagctttccgatctcatttacgctcttaacgttgtcaggagaatgaggacaggcagccagtggtacgagctgtgaaagatcaatatctatctgttcgtcataaacagcgtcatcatcagcctttagctcgctccatacgtcagctctgtcctgagccttcagaaatgcaagtgttgtttcgtcagaagggaagatagatgtagttgcaccaagctcagcacccatatttgtgatagttgctctctcagggactgtaagtgtctttacgccctcgccgcagtattctataactttgcctacgccgccctttacagacattcttctgagaacttcaaggataacgtccttagctgatacccatggagaaagcttgcctgtgagatttatctttactatcttaggatatgtgatgtaataagcaccaccacccattgcaactgcaacatcaagtccacctgcacctatagcgatcattccgataccaccgcctgttggagtgtggctgtcagagcctataagggtcttacctggtataccgaaacgctcaagatgtacctgatgacagataccgtttccgggacgtgaaaaataaatgccgtgcttcttgcagacagaaccgataaatctgtggtcgtcggcattctcaaagcctgactgaagcgtgttgtggtcgatataagctacagacttttccgttctgacacgaggaacgcccattgcctcatattcaagataagccattgtacctgttgcgtcctgagtaagcgtctggtcgatacggataccgatctcctgacccttaacaaattcgccgtcaacaagatgtgctttaagtattttttctgttaaagtaagtcccattgtaacaacaatcctttcaaaaataactgatattaatattttataacaaattgcgatttttgtcaaggtaaatataaacatttgcttgattttatagcgttttagtgcatatttttgcatggtatacgtcaatttactgtataaattttcatttcttacgatatccttacttgacacggcaaatcgtatattatataatagttgtgttatcagagaaaacaaggcggtgaaaagcatgaaagcaaaaactgttttgatattattatcggcggtgatgctatgtcttacaggctgtacagagtcacaaaagcccacaacagttgtggataattcctctgccgtgactacgtcatcaagtgctgacagcgaaagcggcaatgataaatactatgacagcacacctatctcgcaggcatacctaacaggagatacatcaagtcttgatgaaaagcagactgaaatatacaacaaagcagtttcgacgataaatgaccttatcacacctgacatgaacgattacgaaaaagagcttgcggtacatgattatatagtcggctgtgcaagctatgacgaagcacatctcaatgcgcttggtattggcctgccaaactctgataatccatatgcctgtcttataaacggaaaagcaatatgctcaggctattccacaacgtttcagctttttatggatatgctggaaataccctgcaagaccatatacgccacagattttgagggtgacgatcattcatggaacatagttcagataggcggtagttggtattatgttgacgtctgctgggacgaccctatccctgactttacggatagaccagtaaggcacaagtattttaacgtctcaaaagaatacatgaaaacaaaacacgtctggaacgatacagagcttccttatacagatagtacaaagttcagctatattacgcagacagttacgcatataaactcagtaaatgagatagagagccttatggaaaaggctttggataatatgcaggacagcgtggcggtaacgtcagatatgagcgatttccaattcagtgaaactgaccagatagacacgaacttcaatgagagaaatatcaaagggcttagcaaagtttttgacggcttctgtgaaaagcatacagatcatcaagtatactgtcaacgcgtccaaaacggaaatgatatagttttggtgatatacatgagaaaattcagataggagagagcaatgaaattcagaccttgcatagatatccataacggtaatgtaaaacagatagtgggcggaagcctttctgacaaaaacaattatgctgtggataacttcgtttcagaatatgacggagcttattatggcaagctttataagtcatacggactgacaggaggacatattattatattaaaccctgtcggcagcgaattttacaacgcagacctcgaacaagcctacagtgcattatccgcatttgagggcggattgcagataggcggcggaataaatgatgaaaacgccgcacaatttcttgaaaagggcgcaagtcatgttatcgtgacgagctttgttttcaaaaacggtgttgttaatttctataatctgaacagactggtgaagtccgttggcaaaagcagacttgtccttgacctttcctgccgcaaaagggacgggaagtattacgttgtgacagaccgctggcagaaattcaccgatattgaaatgaacagccagaccttagaaatgttctcaaaatattgtgatgaatttcttatccatgctgttgacacagagggcaaagcaaagggcattgagccgcagatagcaaagataatgggagaatactgcaccattccatcgacctatgccggaggaatttcatcatttgaggatctcgataacctgaaagaactcggcaggggaaagatagatttcaccataggctctgcccttgacattttcggtggaaatatgaactttgaaaaagtcgctgtctacggcaaatagccacgccttatgcaataaacacaatatttatagctgtttgctgcatattttggcacaaaaagatttgcaattttagcggaaatatgttataatattatgatactaattcagaaaggacgaatttttatgtctaagatccgagttgccgttattttcggcggaaaatcaaacgagcacgacgtatctgttgtttctgcaactcacgttataaagagtataccaaaggacaaatatgatgttatttgtatcggaataacaaaaaaaggtcactggatgaaatatataggagatgttgacgatattgcgtcaaacaaatgggaacagcaccctgataatgttccatgcgttctcagccctgaccctcttcacaagggctttatcgctcttggcgaaaacggcgaatatcagaatgtaaaagttgacgttattttcccagtccttcacggaaagaacggtgaagacggcactattcaggggctttttcagcttgctgagataccatttgtaggctgtgactgcatatcctctgcaaactgcatggataagggacttacacacactgttcttgacgcaaacggcataaagacagcaaagtgggtaggcattataacctcagagctttcacatcttgacaaaaagtgcgacgaaatggaaagcaagcttggctatcctatgttcgtcaagcctgcaaactgtggttcttcggtgggcgtttcaaaagctaaaaacagagacgagcttaaatctgctatcaagcttgcatttgctcatgacagcaaggtcattgtagaagaaactatagtaggcatggagtgcgagtgtgcggtaatgggcaatgacgagccttttgcttcaactgtcggtgaagtatgctccgcaaatgacgagttttacgattttgacgcaaaatataatgacgccgcttccaaaacgcttatccctgcaagaatgagcgaggaaagcattgaagaaataagaaagacggctgtcaaggcatacagagcaatgggctgcagcggactttcaagagtagacttcttccttatgaaagacggcactgttattcttaacgagataaatactctcccaggtcacacgcctataagtatgtatccacagcttatgcagtacgagggaatgacccctgcacagcaggaagataagcttatcaagctggcacttgataaggcggaggttgattatgaataacgccgccattggagttttcgactcaggagttggcgggcttacctgtgtgaaagagcttataaagcttctgccaaatgaaaatatcgtttatcttggcgacacggcaagagtgccatacggctcaaaaagcagagagactataatgagctatgccagacaggatatagagtttcttaaacagcataacgttaaaatgatactcgttgcttgcggtacagtttcttctgtattgcctgcaatggatataaagtcagatatctccataagcggagttgttgagcctgctgtaaaggctgcctgctctgctacaaagaataacaggataggcgttatagccacaagtgcgaccataaagagcggcatttacggcaaagctataagaagcattaaccctaacatcaaggtggtcggcaaggcttgtcctatgttcgtgccactggtagagaatggctatactgcccctgattgtgtgcctgcaaggtatatcgcacaggagtatcttgaaataatgaaaaaagaagacgttgatacgcttattctcggctgtactcactatccacacctcactgaactaatttcagatataatgggcgagggcgtaacacttgtttcatcaggtgcggagcttgcgaaatatgcactcaactccctttcatacagcgatgatacggctgaaagagaagagcgtgagagccttgagctttactgtaccgacagcgttgagctgttttctgagaatgttgaacgctttctcggaaacaatatcaatgcacaaatatcaaaatgcagcctaaagctgtaaactggaggattttatttgaccagcaaggaagtatcaataaaacttgttagccgtcaaagcgacggtaatacaaaagaagaaacagagcttatctcagcaggactttatgaagcaaccgaaaaaggatatcgcatatcgtatgaggagtctgaggcaacaggatttgaaggaagcgttacaacgctagaaaccgaaggctgccgcaaggtgactatgaacagaaccggaacggttgaagcgaatcttgttgttgatataggcgaaaagcagcattgcgtttatggcactccatacggtgattttatgataggcataaccgctaaaaccataagatcagatcttgacgaaaacggtggaatgcttttctttcactatgttttagatgtcaattcaagctatatcggtgattttgagatagctatagaagtaaaagcggcaaatgttgtcgcataattatatttggaaggacggaaaaataatatgactaatctcataagcgacgcatttattcaggctaaggagcttgtaatgaaggctatgggcgagcttgttgcagacggaacctttccagcagagcctgttcctgcatttaatacggagatacctgccgactcaaaaaacggtgacgtttccactaatgccgcaatggtatgtgcaagacctttcagaaacaatccaagaaaaatagcagaagctatcgtatcaaagatagaccttaacggctcatacttcgcaagatgtgaagtggcaggtcctgggttcataaactttttctattctactgaatggtatgcaactgtagttgccactgttttggagcagaaagagaaatacggtgaaactgaccttggcgcagggaagagcgttcttgtggaatttgtttctgcaaatccaacaggtcctatgcacataggcaacgcaagaggcggagctataggcgactgtcttgcgtctgttcttgaaaaggcaggctatgaggtagcaagagagttctatatcaatgacgcaggcaatcagatagagaagttcaagacttcactcgaagttagatatcttcagatatacaagcctgaaactgaacttccggaggacgcttataagggtcaggacataatcgaccatgcaaacgcattcaatgagatatacggcgacaagtatgtgaacgctgacagtgaagaacgccgtcaggcactttgcgattttgctctgccaaagaacattcagaagcttcacgacgaccttggcaaatacagaatacagtatgacaagtggttcaacgaaagcacacttcataaggatggctcagttcagagagttatcgatcagctcaaagcaagcggtcatacctatgaaaaagatggtgccctttggtttaaaacaacagagttcggtgacgaaaaggatagagttctcgttcgtgaaaatggtgtgccaacatatcttgtgcctgatatcgcatatcactacaacaagcttgcagtaagaaagtttgacaaggcagtggatattttcggtgcggaccaccacggatatatagctcgtattaaagcttctatgacagcacttggcgttgacgctgacagacttgacattgttatcatgcaaatggtaaaccttgtccgtaacggtgaaaagtataagctttccaagcgttcaggcaaagctatcactctgtcaactcttcttgacgaaataccgatagacgcagcaagatttttcttcaatctccgtgagcctaattctcattttgattttgaccttgaccttgctgtatctcagacaagccagaatccagtttactatgtacagtatgcacacgcaagaatttgctctgtccttaaaaagatgaacgaagagggcattgaagttaagagcctcgacaaggcggctctcagcgtcctcacagcgcctgaggagcaggagatgataaaacaccttgctactctgccaaacgttataaacgaggctgcaaaggcttatgacccagctaaggtaacaaagtatgttatagaccttgctacaatgtatcacaagttctataacaactgccgtatcatgggagaaaacgagagcgttatgcaggcaagactttcactttcacttgcagttaagcaggtaataaagaatattcttgatatgctcaagataacttgcccagagtctatgtaataaaatatcagacccgaccgtggaaaactctacgatcgggtcttttgttatttctgggtatttcttatgtagtggaatagatattgctgtgcaatgccctcaacacccttcacacaagagggaagtccgttcggataccactgtgcaagcactcgcttcacccacacgtcttttgggaaagcgtccgttttgtaaaagccgaaaagcagtgtacaatcagcaactttcggaccaacgcccttgatcttcataagctcgtttcgtgcatcgtcaagtggcatttcttttatcttttggtagtctatctcaccgctcaaaaccttttcaatggcgtcaacaagatattttgctctgaaccctgaacgcagatacgcaaggctgtcaaccgtttcatctgccatatcttcggcagaagggtagccgctataatgctcacacaaacgtcctataatgccctttatccttgggatattgttattctgacttattataaaggaagataacgcctcccaactgtcctgcctgagtattcttatgccgcctgcaaatgagcaggcttttgacagagtttcgttctcagagaagcggcgtttaagctccccgtaatcagtattcaggtcaaaataatcgatccaaatgttttcaaagttctgcacagtggtgtcatgaagcctaaacacgccattttcgggttcctcacttatggtaagtttgttgttaaggaaagctccgctgtaagtttttttatctatcttctcccagcgaaaagcctgtccgcaatcaagtgtatcatctagcccaaaatcaggttgtttcagcaaaatgtcactgccgctttgtgtataatccataaaattcagctcctatttatcataaaatcatcgaatctacttgcaaaattctacaaaaaatattatactataaatattagtatttttcaagcggataaaataaacatatctaagaaaggatagatcatatgagagaaagcattctgacaatacctgtcacagatatatttgatccgaaatgcggctgtccaatatgccgcctgcgtgatacgttggagcagagaactgttgagtacataatgggagcggctatgatggagccagacgtgcgtatggagaccaataagctcggtttctgcaaaacacattttgaacagatgagagcctgcaaaaatagactgtcacttgcgcttatgcttcaatcacatttgcaggatatgcaaaagcatatttttacacgaaagaaaatgttcgagggcaagacagcaaagcaaaagaaagtcagcgcagtaaataacgaatgttttgtatgcagcaaggtggattggggaatgtcaaggatactcgtcacgctgtttgagatgtatgttcaacagcgtgatttcagagatctttttgctcagcaggaaatgctttgtctgccgcactatgaccttttagtgtctatgtgtactgaaaatatggataagaaatatcagaagcagtttattgacgcttgcggcgagctgacaagcaaatatcttgacactcttgaagcggacgtatcacactactgcaagatgtatgactaccgtaacacaggagcaaatgccgattggggaaactcaaaagactccatagagcgtgctataaaatttcttaccacaagataagaaattttcgttatttttcgttacaatggatatagcttagattttatgcagaagattgtaaaagtacaattatatgtacagaagatcagcttatattatttaataggtcattgttctttgatcgggtcatttttttgtactttggatctagcattgtaaatttattctcaaacaaattcaaaaattatgtaaagtgcggtcattccactgctaacaaataaccttcaacagacaagtttgtatgttaatatattcgtaacattctcgtgtgtatttgttcccaaaagttggcgttttttcgcttgaatggtcgattttcgttgtaatatgaagttttcaacatcctgcaaataccgataaaaccatgagttttcaacgttttcaacatggttttcaacagaaaatgcccctacgaatgttgaaaacttttcatattcaacatttttgtgttgaaatgttgaatattgcactttttaaatgccaacaatcagtaatataatcaagcaattggtatttagaggagttgactgtcatgctcaaaggaattaataaacaaatcatcgaaataaagtgtacagaaaatgaatgttttgataagattctattatttgtaaacgcaaataaaaatcatctacaccctgatattttaagaaaaaatgctgttgatatcgcaagtgcgataacgggggacaaaatgttttcgacaaacagaaaattcaactttgcggcagtgatatcaactataatgggtgtggcaatgcttgttctgctgcttatcgcattgtgtatgtgataagcataaatatcattgataaaatttgtgtaaatcgtcgaaagtctatataaaaagcctgtttactattggcattatgttttttttgtggtataattacgagtagtatatttttttgaaaaggaaaattcaatgagtaattatcaagataaaaataataatttagacgaagaaaatgaactgcagcttataattggcaggaaccctgttatcgaggctttaaaagcaaataagctgatcgacactatctatattaaccctgaggcaaaaggttctataacacttatttgtagacttgcaaaggaaaaaggcataaatgtcaagcgtgttaccgaaacaaaactcaacaatatgagcaggggagcttcacatcagggtgttattgctatgggtgcgtgtgcggagtatgtgtctccggaggatattctcagcatcgcaaatgaaaagggagaggatcctttcattatcatttgcgatgagatagaagatccgcacaatcttggtgcaataatcagaacggctgaggcggcaggtgctcacggcgttatcattccaaagagaagaagtgcatcattgaacgcaactgttttcaaaacgtccgcaggtgcagcaagctggttgcctgttgcaagagtttcaaatcttgcagcaactattgatatgcttaaagaaaacggtgtgtggatatacggaactgacggcgagggacagagctatactgaagttaagctaactggtcctatagggctgatagtcggctctgagggctttggcatgggacgtttaataaaagataaatgtgattttttgcttagtttgcctatggcaggcaaagtcaattctttgaatgcttccgttgcggcgggcatttttatgtatgaagccgtaagacagagaaatctataaggaacagggaggttaaagctttggctgataaattctcaatagacgatataatttcagaatacagcgaaaaagttgaaaacgatttaaaaactgatgagtcacaggaaaacgatgaaattttaaatgaagatactaatgaagatactaatattgatgagagtattgaaaaagataatgatatcagcgatatagatagtgacggctatgatccaataaaagcaacagattttgatgatgaattggcgtcagatcatacgaacgaaaaaaaacgtaacgaggaaaatgctgcacttataaataatctcaccaaacataaaaaaggcaaggctgcaaagcagagcattccgcctgtgaacagggcaagccttaaagatatcaaaatgggactgacgggaaaaataatcccgaaaacagaggagtttgacaaggcacttatccctgatgacgccacctatgaggaaaaatcctctatattgtcacagcacagaaagaagaaagttgacagctttgttcttaaaactaacgagcaggaaagcgagcctgacagtgatgatacaaacgataaagacaaggcagggcagacggagtttaagaagtttgatgacgccgaaaaggtctttggctctatccgtcatgtgaagagcaaccttgttctaaggctttgtgtacttctgtttacgggcattttcagcacattcataacggttgcaaatgacctggaactgcctcttataaagacatttgacagaactataacccctgcggcatatctgtttgcaaacactattttgggtcttatttctatagcggtgtgctataacgtgcttcttgcaggaataaaaagcctatttaaaaaagaggcagataatgatacaatagcagcgataggtatttttattacagtcattgcaggaataataaatctatttgatcctgagtctattcgtgacagtgtttaccatgtttacatatccgttgcaatcgtgggtctgatattcaatactcttggaaaacttatggtggtaaaacgtactgagcgtaattttaggtacgttgcaggagattttgagagatatgcagttacatccgttgaagatgaggaaatagcagaaaacttcacaagaggtgctgttgcagagccaaagatagcagctatgcgcaaaaccgagtttgtggacgattttatgaagaacagctacacttctgatatctcagatgagtattcaaagaaaataagtccttatatcctcattgcaggcgttgttatagcacttttgtcacttatatttgataagggtgcgtcaaacatgaaagaacgtttgtttatagcacttgcggctttctcaggcactgttaccatgtgttcttcgtttgcggtaatgcttatagtaaatgtacctttggcaagagctacaaagaagtatttgcagtattcagcggtaatgcttggatattcttctgttgatgaatttgctgacacaaattcacttcttgttgacgctgaacagcttttccctaaaggaagcattgagcttgcaaaccttaagcttctctcagctatttctattgaagactgcattttaatggcggcaagccttagctgtcaatcgggaagtgttcttaagtctacattctacaaaatgctcagaggaaagactgagttgctttatcctgttgaaagctacatttatgaggacggtcttggactttctggctggatagaaaacaaacgtgtacttcttggtacaagagagcttatggaaaaccactctattgacggtctgccgtcagaagcaaaagagaaggagtatacaaatgggaatgttgctgtctatctttctatttctggaataacagcagcaatgttcgttattcaggtatcgcctaatctgtccgttacacgttggcttcaggagcttgaacttgaaggtatcacaacagtaataagaacagttgacggctttctttcacagcgttttctctctgacctctttgatattgaaagcgacagcgttaagcttctcagcttcagatatcacaaggattacgaaagcgaaaccgagtacgttccacgtcaggcttcatcaatgctttgcagcggacattttccgtcatttgcaatgcttgtgataggcgcaaaaaggctcaaatttaccgcagaacttggtgcgtcagtgatgtatggtgcaacgatacttgcggcgctcatagcccttataatgatgctggcaggttcatttgttcagcttactccaacgctagttatcgtctacaacctcattgtaatgggagtagcgttgcttatacagcatatcaaaaaactataaaaataaaacctcggtctgtagtgaaacaaaccgaggttatttttttacttattgcttattgtccaatctattggctgaatattgttacttacaaggaaatcgttaaccttagaaaaatgtctgcatccgaaaaaaccattatacgcagacaatggagatggatgagctgccttgaatactgcatgaatagggttcgttataagtggtgccttagccttagcattgccaccccaaaggataaacgcagtaggcacattacgctcattaagcttttttattacagcgtcagtaagctgctcccagcctttacccttatgagaattaggctgaccctgacgaacggtaagaacagtgttcatcatcagcacgccctgcttagcccaatcggtaagctcaccattattagggatagagataccaagatcagcattaagttctttaaaaatattctgcaaagacggtggtggattaacaccagctttaacggaaaaacaaagaccatgagcctgtcccggaccatggtaaggatcctgtccaatgataacagccttgacgttttcataaggcgtgtacttcaatgaattgaagatatcatgcatatcaggataaacagtgaagtgtgaatattcgtatttcaaaaattcacggagtttcaaataatattcctttttaaactcatcagccagaatatcgtcccagctatttccgatatgcaccattatacagcactaatgacagttccgacgatcagaccgagtataagtgcggcaaccaaagcgagaacgagtattctcatgaccataggtttcttgtcgttcattaactatcgttcctttcataaaatatactactatgattttatcatattttcgctgtaaaatcaactgtttggaggaaatttataaaataatttgttcaaaaataatgaagtggctcacaaaggttcgtaagtaagccacttctatacacaaaaaaatatcatatgagcaaggttttaacctcgccttgctttatatgatataataaattttgttgtcaagggattaccgcaaatgtagtatagcttgacagcccacaaagtagggtgtatacttaaagcagtgcacaacggagagagccgacaaagcataaaagagccacaaacagcccctcgcacagcgtgtacagaaagtttcactaaataaaaatttagtgaaacttagagaagtgataaataaggagaatagatataaatgaaacaagcatatgtagatgattgcccatattatcttgacgattttctaactaacatgaaagttgtcaaagaccgttctgaccgcactgaagaagcttattttattgatatccgaacatttctgcgatatcttaatgtcaagcaccatgccgttccagccgaaacgcctttcaataaaataaaaataaaagaaacgccaatagaatggctcgaatgcttttcactaaacgatgcttatgtttatttaaagtatctcaaagatgagcgcaataattccacaaaaacccgtgcaagaaaatgttcagctttgaaacaattctatgtttatctttgccaaaaagccaagattatttcaaacaatccgcttgatgatcttgaattgccacatataaatcaagccttgcctaaatatctgtcccttgaacaaagccttgagcttctgcgtaatatcgactctaaaaatcaggtgcgtgattattgtatcattactctgttccttaactgcggtatgcgtctgagcgagcttgtgggcttgaatttaagcgattacagccgagataacagaactctgcgtgtcctcggcaaaggccgcaaggagcgcattatttatcttaacgacgcttgtgtttctgcacttgatgagtatattgacactacccgcccccatgtggaacaaactgccatttttttgtcagctaacaaaacaaggataaacaagcgacgtgttcaacaaatagtagatgaacagctccagcgtgcaggacttagcaatttgggtattaccacccacaagctcaggcatacagccgcaaccctaatgtaccaacacggcggtgtagatactcttgtactgaaagatatactaggtcacaaaagcattgcgaccactgagatatacacacatttatctgatgaaaacatcaaaaaggccatggagtcgaatccattgtctgaagaaattgaaaagaaaaagaagtaaacaaaaagccatgtgaggaaaatcacatggcttttttgctattttttcatacgaattatagaatgttctgggaacgtcagatctgatcttatcgacatcttcatagctgcatggtttgcagtatctatggagttgtcgtattcatcaaacatttcctccacggtgaacttcacagggctaccaacaggtgaaagcacttcaatctcgtcgcccttgttgaatttgtttttttgagtacagtatattcttccaccgctacaaccgtcaaccacagccacaacatcatattcacgaatatacccaccgttttcgtaatactggctttcctttgggtgaccaaagaaaaatcctgtacagtatgctctgtggcttaccttgaaaacttcgtccttaagccattgtggcaactcaaaatgctccggatcagacttatagatatccatagcctttctgtaggcatttgttataacggacacataatacgaagatttagctctgccctcgatcttaaagctgttcacgcctgcctctgcaagcttatcaatgtggttgagcatacacatatccttggcgttgaggatataagttcctttttcgtcctcaaaaacaggataaaactcgttggtgcgcttttcttccataaggtggtatccccagcggcaaggctgtgcgcactcgccacgatttgcgtcacggtttacaaggtactgggaaagcaaacatctgcctgaaaaacttacgcacattgcaccatgtacaaagcactcaatttcaagatctttaggggtctttgctcttatttcggcgatctcctcgagagaaagctctcttgcaagcactaccctcttagcacccatgttataaaattcatttgcagtaacataatttactataccagcctgcgtggaaacatggatctccatatcaggtgcatatttttttatcagtgagaaaacaccgatatcgttggctatcatagcgtcaacgcctgctgcaagagcgtcattcacaaactgttctaaatgcactatctcgtcattatgaggaagcgtattgcaggtcagatacacacgcttacccctgctgtgagcctcgtcacaggcttttttcagaagctcagcgtcaaagcttgcagaggcggctctcattccgaaagccgtacctccaagataaactgcatcagcaccaaaatccagcgccgcatacagacgttccatatctcccacaggagcaagaacttcaagcaaattattttcagtcattaaaatttcaatcctttattactttttctttgcaagtccagccttaacaagattttcctcgtgctcgtcaagtgtctttgcatagaatgtttcgcccgtcttaagattattacagaagtaatagtaatcagtcttcttaggctcaagaacagcgtttattgcagccataccagggttgcatattggtcctgctggcaagcccttgcacttataggtatcataacactcggtataatgctcgatagaagctgtgttgtcagcctcggtctttataacattcttaatataatttgttgttgtatcagactggagcataggataagtgtcagggtcgtcaagtctgttcaggaataccgaagctacctttggcatttcgtcctcagaagcggcttcaagctgaacgatagaagcaagggtcataacttcattaagtgacataccggaatttttgatcttagctttgacagtttcgtatttcttttcaaactgctctctaagcttcttggtaacgtttcctgcgctgtcattcacataaaactcatatgtatcaggatagaaatagccttccatgcgatagaacatatcgccgttatcatcaacatcattttcaaagtcaaagccttgatttttattgaattcaaacaggaagtcgtcagcagtgcagacctcattatcttcaagctttttagctatgtcaagaagattttctccctctgtgaatgtaatgcttacagtcttatatgactctctcatttgtgaaagtttttcgattatttcagaatatccgcttgatggctgaagtgtgatatcaccaggatatatagctgcaggcttttcaaatttcaaagcaagcataaacagctttttgttctttataactccctcatttacaagtatatcagctatctcactgtttgttgagcctgcagggatattaaatctgatatcctcgtcagtttttccgataccataatactccatgccaatagaaatgccgcccactgcaagcactaaagagactgtaagaattactataacaagtataattccgccaaacaccgaattattcaccttgcttttctttctttttttctttttcttcttgccgctttttgactttttttcttgcttttcgggcttctcaggccctttatcctcgtcttcctcgcttttgtcttcctctgacttgtcctcgtgaaaagctaggataggtccaggcttgtcatcggtcgcttctggagtttcctgtgactgtggtttctcgtcagtattatctgcctgttcacagtcttcggaactgttctcagtgtcagcgataggctctgcttcaacgctttcttcgtccgcttcatttttctcggcagactttatctttgcgttgacatcatttattatatcgtcaacattaaaattcagatcgtccattatttacttcctttcctttgtgtttatagtatatatatccttatcagtaaataccttgtctacagagatatcatagccgtcatgacaaaaactttctgacatacagttatcgtaacataaacctagcttcatgccattataatcagccaaaaatctgtcataaaagcccataccaaagccaagcctgtatccgtctttatcatacgaaagcgcaggcacgatacacaatgcattgtcaaaaacgcagtatttctcacaactttcatcaggctcaaaaatgccaaacctaccctctttgagatcataggtgctgtttattctgtaaaaatacataatattgccgtttttttcacatctcgggcatagcactatcttgctctttagcgcctttcttattatctccgccgtagacacttcaatatcagaggaaacatatgcaagcacagttgtacagcttttatactcctcgctgtcaaggaaagcttgctgaacagccacatctgcctgttttctttcttccgcagacatactaagacgtatctctttgaaatgctttcttaaagcttttttatctgtcatttgctctgcatacctgattcaagggcttctgccttttcttttgaaacaagaagctctacaagcttgagtgcaaacttcatgctgcagcctgcgccctttgcagtgatgaacttaccgtcaacagccacaagtctggcagaatgtatcgcacctttaagatctttctcatagcctggaaaacaagttgcatatctgccgtcaagaagacccttatgaccgattatggacggagcggcacatattgcggcaatgtatctgttattatcagcacagtaatcaactgcaccaagcacatcagggcttgcttcaagatttaaagtacccggcataccacctgggagaactatcatttcgagctcgtcattaagaactatcttatccactgttgtatcggtcttgacaggaatgttgtgtgagctgactatcatatcagagcctacacctacagtaaaaacttcaacgcctgctcgtctgagcagatccacaggggcaagagcctccatttcctcaaaaccattggcaagaaatacataaaccataacaaatgactcctttcgatcatctgaaagtaattacatttttattcaaaagaaaagcagggttataagaaagctttgactttctaaggccctctattcctagatcctcttccctgttgatgaaactgagaccctttgcattatgcgacgcaaactgactacacagcataggatatgccccctgaacgtcagcgagtgctttttctatatgcaccacaaaggtatccgaatttatttgttcaccaaccgtaaagcctgtcattttatcatttctgtaaagcacagcgcctttaagtccgagcctatccatattcgtaagaaaaagatcaatagcatattgctcaaccaccgccgaaggatcgtcagcgttgtcattcttattataaaactcagccgaaaattcaatacagctgtctatttccttatcagtaagctctctgtattcccaaggctcgtccatgaaacgctttatgtggttacgcttgccgtgatactttttgcctttaagctcgataaggtcggaagcattgtaaatatagtctgaactgtccctatcatactcgcagatgattttatcaccataatattcttttatccagcttaggttatcatctgttacagaagatacgataagcggctttccatgggcggaaacatattctttaagctcatcaaaaagcctgatatatttttctttgccctcaacgtctattttaacgcccgcaggaaatgtaaaatacggctgaccgtcctcaaaggaacagcttatataaaaatcaccatgatgtgttattacagtgtcattaagtctttgccacgccatattatttgcaaagcaatattctgctcctctgaaatctgatactgcaagacacttggttatccattctttgtcctcaaaacttatttttctgaaatcaaacattaaacacacattactttctattgattaaccccagaatatctccgaaaattttatcttttgtataaggctcgcttccgtcgctgcaaggaataatatcccaatcctgtttctcagcggtaaacaaagcggcttcacggcattttttcagatactccacatttgcttcatggatatcctttttgctttcatctccgccgtatcttcccgacatcagcttttgagatatctctattggcatatccaagaatatcaccttgtcaggtcttggaagcccaagcttgtcatactcgtaatcttcaagccagcctataaaatcttgccactgctctttcggcagttttgtcatctggtaaatgcagtttgacgtaacatatctcgctgcaagtacaagacttccctctttatagtcatgctcccaaaattgtttgtagcaagcgtatctgtcaacagcgtaaaagcttgaagctgcgtaggcattcacgtcagcaggcgttttgcctatctcaccattaagatacatctttaccaacgcagacgacggattatcatagtcaggaaagcttatagccttatgctttatgtcattttcactgaaataagcagaaagcctttcaaactgagttgattttccacttccatcaagtccttcaagaactataagtccagatctattcaacattattcatttctccgtaaattttctttacttcagccatttttccacagctcattgcgccctctggacacttgcctttcattacacatgacggacctgcgttcttgaaaagctcaggagcggcctgcttgcaaagtctgagcatttcatcagccacagcctttatctcccattgtgctctgttacagcatctatgctggaagaaattaaacagtgttctgacgttcattgtcacaactatctttgtttcacaagcgttaggaagaacaaatcttgcgtcctcataggcttttttcttagccttgttaagtgcgtccttttcagacataccctgctctaaaaacgccttttcatgtgtatttgtaagtatgtcggcaatcttattataacactcaagtagctgatccatttgcttgtcaaattcagcctttgcttctggcacagcctctattgatggtggcgtgataaactcaaagccgctttcatttacataacgctggcttttttgagaataagacgcaattctgtgtcttaccaactgatgagagcaggcacgggatatcccctctatgccaaaagtaaaagaaacgtgttccatagggctttcgtgaccaatagatacgagcctttcaataaagctctttgttttttcttccgtaaggccctctctaagcgaggcgatatcactgcttgaatagcaaagttttgcagcagtagcaaccaccttttcaggctcaggtgtatgggtaataagctcaactctcatcatatatgatcctttccacatattttttatattataccattaaaaagcctacaagtcaacattttattttaaatggctatttcaacttccgtgttgatgttaacaaatatttcacaatcaacttatgtaaaatgaaataatttagaacgcaatatttgttcagctatacaaagctcttgtgcatatgagagaaatatgcagaatatagtgacttttggtgttatatgtgttaaaataatgtgtacatagataaaaaagtctattgcaaaaaaagaaatgtgctgagtccaatgaagatataaatatttattatgcacaattattcattgcaataattgtgtgatatgatgaagttaaattaatttgcaacaaaacttgaagaaaatcacacctatattatgaaaaaacgtttaatatgaaaaagatcgttaagagaatcgcagctatgggtgctgctgttatgatgatgagttctatggctattggggctagtgcggcaaactcctacaatctgcactataataaaggagctccgtcatcagataacgtttgtgagaaatggatgtatggtataaaggcacagaataatggctatttaaaatccacctgcaaatccataaatacaagtggcaagtttagtgtcttagcaaatggatacagatcttcaagccatactattaattgtggttctttcgatatctggaacaaaggaacaacaaattggaaaaattctaattataagaagggttattcttatgatgttgttgctgaatttggagtgtctggcggttacacaaatatttcaaagtatgtttcaagtgcttctgcgtcaggaagttttaactaaagaatagtattttgagccgctgcggattatcttgctggtaatgacgagcggctcttactttagaggataaattatgatgaaaaagatttgtattttggttgttgcggtgtgcatggtactttcagcgtgttcaaacaaaactaataatgtaaaattcagtgaatttaattctgaatatgtgcctgtaaatgaaataacagatacatattcagaagccctcaaattggagtatgctcatttcactattcgtgacagtgtaagaatagctgatgtgagttcagttagcagaacgttatataagccgtcggacggttttctgttcaataaagagcagagatttatagactatttaaacggcagttctgttgatcttagcaaaataagtgttagcagtgacgatatgggtgaatatcatcagcttaacgccgaaggaggttatccctactttactgattatgatggtggctcgatagtatggatcaaagacgaagatgctgaggctttttttctaactaatgaaaacattacagtaaaacgatattattgttgcaacacctttgatgatgagaaatataagcttaaagactgtgaaatgtccataagtgaggcaatagaaaaaagtgctgaattttcagagggactgagaaaaattggctacccacaaatgtcgccttttgagatcagagttgagaaaataaacgatacttatgcgttcagaatagatatggtgcaacaggataacggagtaccgttgagagcagctaacagtggctttgagggcagggaatcctctgtcaatgatgttttcacaggtcgattgagcaaaataaattcaaatccagcgggatacacagtgcttataacttcttcgtccgatataggttgttttagaaataatgaaaatgtattttgtgaatatgaaaaagagaatatcgacaaggtgataacaccatattctgcacttagatatattgatgacaatttaagtgataattccagttacgaggtggattacataggacttgagaataagatatactgggtggacgctgaaacgggcgtatattcaagtactccaatgtggacagtttcactctatagccctactgaggaaaaattatactatgctctagtagattgtgaaacgggtgatttttcattctattcgcaaagcagaggtgatataaatttgtaattttacaatatagatcggagcttataaagtatggataatagtttaaaaagagccacagccttaatggcggttgtgctcatgttgacgggttgttcatctcaggacaacaaatccaataaccacagtacagatgatgcaaggcttgagcctgtggaacaggcttatgacggctgtgataagttgcttggcagcgatcacggcagttttaagctgccagaaaagataagcaaagtggactttaataaggtatattctttgtcctgcaatactttgaaaaatgatgatatgaccaatgctgaaaagttattcaagactttttatggcgacgatttcgacgaaagtgcactttcaactgacaatggcggaatagtttatcaggctggaatgaacacatctgcatactggggtatggatattgcactttattccgctgactatgagtttcaagaaaacaacagcggacagacttatgttgtggggcttgacgagggcggcattactttaggtggcaaagccattgatgtgactgatatcgacagtggattaaacaattatcttgccgatttttataaggattttacgatcaataccaaagagttttcggtgaatgacactgtgggcagaattgattttacggcaagtcttgactatgaaaatgtgccttttcagtattcgccctctgcatacagtcgggcagacaacgagaataatatgagttattggacgtttttgcaggtgacaggctctattggggcggacggcaaatttgattttatcaacgcaaatgcgccacttaacatacttgacaaaacagagaaaactgagatgataccatttgacgaggcggtgaaaattcttgagacggagcttgcaaaagggtcatattatgagttttcaaatgttgagcttatgtactgctgtcttgcaaatcagcctgcattggatatgaccgaagaggacaatgttgctaaggctgaacagttggcggaggaatacaacaagacacccaagaactttgagcctatgtggtgtttcgagataaaaggcggcgagggtgcaaaggaatatatcaaggtgaatgctctcagcggcgaggtctttattgatgttcagtaggtcagaacgaaaggtgaatagcatgatcacaaagcggattttttgtattgctgtgataggtggaatcatctgtcttacggcttgtggaaatagtaataataacagcgagaataattcatctgcggtggtggtatcagctgtgggaagcagaactgacagccttttggacagcagagtgacattgcaggctgaggctgtggcttacgataacggacagctcacctttgtttatgacggcaaggaatacacgcttgcaatggacagcgagctttttgaacatgatgaaaaatatgtgaatgggaaaagcttatcccaagcaataataaacaacgatatcggcgaggtcatttctgcggagatagttacggacgagggcataacaaaaatttatagttgtgatgttgtaagtcctaacggcgagaaatacgcttcgggaatgtatgaggacatcaaggcggacgtgcctgcggaggagtatgactacaagctttgccacaagagcggctctgtctatgagcttagcaatgcaaatcggactatcacggctgacttcaacgatcttgaggagtggcagaaaggaaaatatcccgaaagtgctgatgatgttatgttcggcggctatctttttaccgacggcaagtttattattgaggatatcaacttacttgttgcggtgaatgatgacggctcaaagacgtatgagccgctcacgaccagtgactaccccagctttttcggcacagtacagaccataggcgacaacacggccgaaattaagctcacagacggcaagaccgtttgcacagtgcctacatattattgcgacggagagcttagcgaggggcttgaagtcatggtgatactcgacagctccacagatcttttcgggagcggaaagtcggagagttttgattacgccgttatctgcaccgaccctgcggagtatgacccctcagggcatgagtttggaaatctcgcctacgccaaagctgacagcaataatcttggtaggtttatctacaccgagatcggagatatagagaaatgaaactaaaacttctaaacgcaataaaatgtgacctgaacaaaagcataataaacataggctttgcaggtgcggtgctgcttacaacagtgcttgctttcacctcatcagcctatacagaccttgccaccgataaatcatattcggtgttcgagtcacttttcactctcgataaaaatatcctccgcaccgacccaatgctgtcctctgtgctggttttcagaaacgggctttcgggatatatcacaatgtttttgcctattgtcgtggcattcccattcatggtgtctttctgtgcagagcgaaataacggactgatgcgtttcaccatatcccgcacaggcaaactaagatattatctttcaaaatttatatccgctcttatctcaggcggatttgccgttatgctaggtatagctgtttacggcatagcctgtgcagtgctttttcaaccactttcggagtctgacgtatcagccgaccagcttcaatacattatccaagacagcacaggtaaaacggtagtcaaaatgcttgcggtagctttcgcatatggtgcagtttccacactgcctgcgtttttcctaagctctttctgcaaaaatccgtatatcataacctgcctgccctttatgctgaactatgtactcaccacaatgctaaacaggataatagacgcaaatcttttcaatgataactttgattttgatagagcgaatgccttttatccaagctctgtgacgaattttctgtatatccaaagctttgacagaagcgcaaagtggataactgcggtgaactgttcgggggcgatcgttgccctgctgggatttattatggtgatgagtttgcacaaggacaagggggtgtaggtcagctatgatgaaaaatttcagcctaaaacaaagctttttctgtgcaagggcggagttcataaagtgggtatgcgacgcacgaatgataatcctgggagtgcttcttatcttcatttacagctttgctatcgagcctcttaaatcaaacgccaagcttatgggcgaaccgctgaatatccttgagccttttatcgccatagctaattcaggtgcgatacttcttatcataccgctggttttcctcacacttatagcagatttccccaagatagacaccaacacagttttctacataatgcgtgtgggcaggctgaactggctgttcggacagcttttgaagctcatttttatggcgttatcttatcttgcagtgatattcttgggcgcagtgcttccaatgctttcagacggcttttggtacaatggctggagcaacgtggcgacaaagtttgtttcacgctttcctgaacattcgggcaatttcggcgtgcagcttctccctgaaaatctctacaatcagctcacagtattttcagccgcagtgcaaagctacctgctcgtgttcgcataccttatgataatagggcttatcctgctgagcttttcacttgtgaaacacaagactgtaggctttgtcctttgcggagcggtgatatctttaggcacagcgttctgctccataaagaccacgcttatgtggacaatgccaatggcgaacagcataatatggctgcactacacaaaatatttccgtgagcctgttatgtcaatgagtttttcggtcagctatcttgccatatttatagcggtactgctggcgttctgctttatcgccataagaaaattcaattacgacaatgttgcagagatagcaagttaggaaattagggggacgaaatggatatcatcaatgtaaatgacgtatgccttacgcttggcaaaacggagatactaaagcacataaatgtgtcctttgaggagggcaagatacacggacttatcggcagaaacggcagcggcaaaacgatgctgatgaagtgcatatgtggttttatcaagcccacgagcggtgagattatcgttgacggcaagcaggtgggcaaggacgttgactttccgaaagatatgggtatcattattgaaacacctgggtttataccgtattacagtggatacaaaaatctcaaacttcttgcggggctgaacaacaagatcggcaaagatgagataagaaacagcatgaggcaagtggggcttgaccctgatttaaaacgtcatgtccgcaaatacagccttggtatgcggcagcgtttgggacttgcacaagccattatggaaaatccgaagatactcattcttgacgagcctttcaatggacttgacaaggacggcgtaaaagaaatgcgtgagtatctgctcagctataaagagcagggcaagactatccttatctgctctcattcggcggaggatatttctgtgctgtgcgataccgtgcacgaaatggataagggtgttattgagggggtaaggtgacatagactgagtaagtatggattcgtacaaacagatatcaggagccgatattgataggttaaaattaggactgttctgaatagaataagctgccacagattttttctgtagcagcttatttttgtttgtgctattccttcttgcaaagatatccgtcatcatcatatttcttagctatatgctgtgtagcttgccaatcgccccatttgtctacagctttatcccaaattgtcatatattacaacatgttttctgaaaaagtttacatttatcaacttggaagttgaaatagccttttaaatcatgcactattgccattttaaatgcacaaaaaggcagcaagctaacctgctgcctaaaatcattcaattcacacctatcactgttagtagaaaaagtatcatcatcaccgccgatacgctgctaagaacaagtccaaatatcacacagcaaactgcattcaggtcaaaaacttcatttcttttgccgtcatatctgagcctacacaccttatcgggtatgtatatctttgagcgcattactacctcacatgggaatacgtttggatactcactatcactaaccttgtaaaacgctgtatcaaatttcttgccctctgccctgccgaaacgcacaaactttcctttcacgcttttcgttccagtaagttttacagcagagtatacaaagaaactaaaaataaccagtagcaggacgacaagaaaaacaatgaacattataggaactataacaaaatctgcgccaagacacatggcaagcacaagaacaaccgtggctatgataacaaattccatgactataccctacaaaagacttctgtaatagtcgctaagacgcttagcgttagctttcaaaagctcgtcagccttgtttttaacgctttcatctgcaaaaataccacgctttgaaagttcagaagcctgcttggcaaagtctatcgccttttgaagatccgtggcactgtcagagcctgaatactccctagccaccataaggcaagctttcgccttaagcgcacatatctcatctgaaaattcgtcatcagcgtcatactctataacagccttatagttcttgtttataaattctttccgtatactgatatagccctctgcgtcaggggcgtttttggagtcgttttcatcaggcagaagggtattaggctctatctccaacaccttgcagaggtattcaagggtctttaccgacggcgttgctgagccgctctctatctgactaagcatattgcgggttataaaatcacccactacctcgctttgagtcattttctttgaaagccttgcctcttttatcctcttgccgagagtatttttctccattatatcgcctcactttatttactgtaaatttcatttacttatatgatagcagatagtaaaacagatttcaagtgtttaacgaaaaatttacaatttttttatgctaagcaatatataaaaaataattttaattattgtcgaaaatctattgacaaataagataaatgagtatataataaacgtaaataatatttacattggaggtgtaagctatatgaatgaatggtgggacggtttgtcgcttttacttaaagtgctgtattgtatagcgtttccgtcaacgcttatactgcttgtgcagactttgctttctatgttcggttttcatgatggtggaagcggtcatgatttcagcgacacgtcaggtcttgatcttgatgttgataccaacatcagcggtcacggagatgtggatattggtcactgtacacatgatatcggctgtgaccacaacgtagacggcggaaaccctgcggattttgcttctatgagaatgttcacgcttcagaccatagttgcttttttcactgtgtttagctggtcatctatcgttcttgtaagctcaggtgtttatccagcactgtctacagttatcggctttgttctgggtctggcgaccatgcttcttgtagcaaagatagttcaactttctgtaagacttgctgaaaacggtacggctgattataaaaatgctataggagaaactgctactgtttatatcccctgcccacctaaagaccatgggcttggtaaagtgaatgttatgataaacggacagctaagagaagtcactgcaataaacaatggtgatgagcttataaagacaggaactcaggttcgtattatcgatttgcaaggagatactgtcgtaatagaaaaataaaagaattgatagaacaaaggggtgctaaacataaagattctgtgaaatgacccgtcttgaggttattataatattatttgtgtgggaggaaaaattatggaaccagtaatcatcatctgcgtgatagtcgttgtgctttttgcggcaattatggcaatactgtcacgctacagaaaatgtccgtctgataaggtgcttgttatctatggtaaagtaggaacagacaagaatggtcaagcaagaagcgcaagatgtatccacggcggtgcggcatttatcgtgccaataatccaatcttatgagtatatggatcttactcctatatccataaatgtggatctaaaaaacgctctttcaaggcagaacatcagaattgatgttccatcaagatttactgttggtatctcaacagaaccaggcgttatgcaaaacgctgctgagcgtcttctcggcttgaagctcatggaaattcaggagcttgcaaaggatatcatattcggtcagttgagacttattatcgcaacaatggatattgaggaaataaactcggacagagataaatttctgcttgcggtatcaaacaatgttgagatagagcttaaaaagataggtcttaagcttatcaacgtaaacgtaacggatattacagatgagtctggatatctggaagctctcggtaaagaagctgctgcaaaggctatcaatgacgctaagaagtcagttgccgaaaaacacagagacggtgagatcggtcaggcaaacgctcagaaagaccagcgtatccaagttgctgctgcaaacgcttctgctatcgacggtgagaaccaggccaagatagaggttgcacagtcagaagccctcagacgtgagcgtgaagcggaagctctcagacaggctacagccgctgaagctgttcaggcagcaaaggcaaagcaggaagcttacatagctcagcaatccgccgagcagacgagagccgaacttgaaaaggctacacagaccgctgatgttatcgtaaaggctcagatctcaaagcagcaggccgagatcgaagctgaagcacaggctgaggtagtaagacgtaaagcaaagggtgaggccgatgctatctttgcaaaaatggaagctgaagcaaagggtaatcaggaaatactcacaaagcaggcagagggtatgagaaagcttgttgaagcagcaggcggagacgctaatgcagccgtcaaactcatagttgctgacaagcttgaagagcttatctctattcaggtagaagctatcaagaacattaagatagacaagataaccgtgtgggatacaggcgcaggtgcagacggaaaaggctcgacagcaaactttctaagcggacttatgcagtcagttcctccgctgaacgatctgttcaagcaagcaggaatgtcactccctgattttcttggcgaggacatacaggaagctttgaaaaagtcacagaaagaagcagtaaagagagcagctgaggctgataatgcagaaactctcgacccaaaagatgttgaggtaatagaacctgagaaataattaatttgacctccgtagtttaacgattgcggaggtcttttggtataaataaaagcgagtttcaacatcatgaaactcgcttttttatgttcaatatggttcaacgactactgctctgccctctttcaaggacctttgtacatcaataaaacgctgatttttgctgcccataaatttcaactcaaggcttcgctgtgacagaataaatggtccgtcaacaagataatcaagctgactaagaagctctatatagccgttttcagcgttagcgtttgcgattagatattcataagtatagcccgtgaatgaaatcacattcagtgaaaagccatggaacgcttttatccttcctgcaagttctgctaacggtttgcactgacagaaaggctcaccgccactgaacgtcacgccgtcaagaagcgggtcctttattatctcattgtaaagctggtctgtgtcaacgacaatgccaccgttaaaatcatgtgtctgcggattgtgacaaccctcacagccgtgtggacagccctgcgtaaaaatagtgaacctaaaacccggtccgtctacgatagattcaccgacagtgcctgcaatcctaagctccatggctaattgtcaccctcacagcaggcttttgcacgaggtatcctctcatgtatcaccttgctgtgttcagcctcagaacgtccacacttcgggcatttgtcacctattattcccgtatatccgcaaacaggatcacggtcaacagggtggtttattgagccgtagcctatgccaacttctttcatatatcttacgactttctcgaatgcagaaagattgttcagcggatcgccgtcaagctcgatatagcttatatggcctgcatttgtaagagcatggtaaggagcttcaattttaagtttctcaaacgctgttatcggatagtaaacaggtacatggaaagaattagtataatattctctgtccgtaactcctgctatctcgccataacgttctctatccattttaacaaatctgccagaaagtccctcagcaggcgttgcaagcaacgagaagttaagaccagtacgctttgtttcctcgtccattcttgctctcatacgtgagattatctccaagccaagctctcttgcttcttcactttcaccatggtgcttgccagtaagcactttaagacactcagcaagaccgataaagcccactgaaagcgtgccatgctttagcacttcttcaagtgtatcgtcagccgtaagcttctctgaatcgagccatatgccctgacccatgaggaacggataatttctcacacgctttgaacactgtatcttaaatctgtgcataagctggtcgatacaaagatccataagctcatcaaggctgtcaaagaaagcaccgatattacgctgtgcttttatgccaagtctagggagattaatggtagtaaaagagagatttcctcttcctgtcactatctcacgagtagggtcatatgcgttaccgataactcttgtgcggcaacccatgtaagctatctcagtgtcaggattgccctccttgtaatattgtagattgaaaggagcgtcgataaatgaaaaattcgggaaaagacgcttcgctgatacacggcaggcgagcttgaaaaggtcatagttcgggtcatcaggatcaaagttcacgccctcttttatcttgaaaatatgtatagggaaaataggcgtttcaccattgccaagtcctgcttcctctgcaagaagaatattctttataacaagtctgccctcgatagaagtatcagtaccataatttatggagctgaaaggcgtttgagcgcctgcacgggagttcatggtattaagattatggataagcgcttccattgcctgatatgtggctctgtcagtttctttcaaagagtttttatatgcaaaactctgtatcttcttcactataggtgcgtcaacaaaatttacaagaaactgtgcttcagcctcttgatagccgttatcattggcgagagtgatctttaaaccctgctcatcaagcatttcagttattttctttgcaatgctctgagcatcagaaacttcaccaaggagagcaagacccctgccgatattgtcacgatagcggtgtctgaatgtctttcttacgccctcagccatatcataatcgaacttcggaagagattgaccaccatgctggtcgttctgattggattgtatcgcaatgcaggcaagcgccgcatagctctgtatatcatttggtgtacgcaaaaagccatgacctgtagaaaaacccttatcaaaaagctttgtaaggtctatctgagtgcaagtggtagtcagtgtataaaaatcaagatcatgaatgtggatatccccctcctgatgagcctttgaatgctcaggagcaagaacatacatctcattgaactcctttgcacccacagagccgtatttaagcattgtacccattgcggtatcgccgtctatattagcattctcacgcttcaaatcgttatctttcgctgattggaaagtaagatcctcataaactttcataagacgggtattcatttctcttgcacgagtcctgtttgagcggtagagtatataactttttgcagtatcagccatgccctcctcgataagtacatgctcaacgcaatcctgaatctcttcaacagtaggcatatcaaggtgtttttccataagcttatcaacaactttacccgaaagctccaaagcttcctcatagttatccttgcccacagactgagccgccttgtatatagcgccagctattttctcaatattaaaagttacagtacgtccgtcacgcttttttatcttgattatcacaataccgcctccgattttcccgatttatccttatattttttatattctcacaactcgcaccgcaaatcacaacatattgtataaaaagcagtgcttaatacaagtatatagtataagtgacgcaaagtcaaggcgttatacaacaaaatgtgactttgttatttgtattaaatgcacaaagtcacattttcgtcagatattgattttaggtgtcaagtaaaatgcttttagctgtaatgcaatcgaactttacgatgtataatacaatatagtttagttcttgatgttgtaaagtgagctaacttgtcatcttatgcattttcaagtgctgctccatgcctcttaaatgtcgcaaataggcggactttgcaagtgcgtaaagcgttttaacttgtcgagcttttgaattttgcactatgctgctgaactgctctcagcactctcgtaagtgtaatcatgtgtgactacagagctgcctgtttcattttcaagtacctcttcgagagtagtattcatcatgtaggcacagaaagaaatcagcattacaaaaaaactcactatcaacacgatatccaatctataactatttttcttctttttgttatcgttcataagatcttctccaaaatatgattttaatactattatactatatccctctgcctttttcaagccaaaatgacaaaatcgcagatatttttataccatacacactgccatgtgataaatgcacaaaagacaatttcttttattgtttaatttttgtttttaccccttgcaaaaaagccgcatatagtgtataataaatattatattgcttgacgttcactaggcgacaagcggccgtattaactaagatacaggtaatttgatttaacagaaatgaggcttttatatgtgcggttttgttggatttacaaataaaatcaatgacgcttccatagttcttggaaaaatgatggatagaataaaacatagaggtcctgactctgacggaaaatatgttgacgagcagatcgcaatgggtttccgccgactttcgatcatcgacctttcagatcaaggtagccagcctatcttcaatgaagataagtcgttggtacttacattcaacggtgagatatacaactacaaggatctccgtgaggagcttgtagcgtctggtcacaagttctatacacagaccgactcagaggtgcttatccacggctatgagcagtggggcgagaatatgcttgacaagctgagaggaatgtttgcattcgttatcttcaacaagaatacaaatgaggttttcggtgcaagagatttcttcggtatcaagcctctttactacgcaaaaatgggcgaaactcttatgtggggttctgagataaagagttttcttgaccaccctcatttcaagaaggaacttaacacagacgttcttgaaacttatctcacattccagtattctcctacaacagaaactttcttcaaaaatgtttacaagctccctgccgctcactgctttacatacaagaacggcgagatgaacgtaagaagatattgggaagtcaagttccatgcggacaatggtccttctttagaggattgggtgaataggatatccgacactttcaagaactctgttgaggtacacaagtttgctgacgttgaggtaggttctttcctttcaagcggtgttgattcaagctatgttgccgctgttgccaacgttgacaagacctttactgtaggctttggcgaggacgaaaagtacaacgagataggttatgctaaggagttttcaaagtatattaataaggagaacttctccaaggtcatttctcctgaggaatactggaacagcctttcaaagatacagtatcatatggacgaacctcttgctgaccctgctgctgtggcactgttctttgtatgtcagatcgcctcagaaaaggtcaaggctgtgctttcaggcgagggtgcagacgagattttcggcggatacaacatctatcacaaccctgctgatatggcaagctacttcaagataccaagacctatcagaaaggctgttggtgcagttgctgagaaactgcctcacaagcacggcataaactatcttataagaggttctaaggaccttgacgagagatttattggtaacgcatacatcttctctgagaaagagcgtaaggacattctgagcataaaaacaaacgctcctgacgctatggctatcacaaagccgttctatgacaaggtaagagatcaggatcaggtaacgcagatgcagtacattgacctgcacctttggatgacaggtgatattcttcttaaggcggataaaatgagcatggctcactccctagagcttcgcgtaccgttccttgacagaaaggtaatggagcttgcagagcagatacctgtaaaggacagagttactgaaactgaaacgaagtatgcaatgcgtcttgctgcacttcaggcttgccctccacagacagctaagaaaaagaagctcggcttccctgttcctatcagggtatggctcaaagaagataagtattataatatagtaaaagataagtttacttctcctcagtcggcacagttcttccacacagataagcttgtacagcttcttgacgatcaccgtgcaggcaaatatgactattcaagaaagatttggacagtgttctcattccttgtttggtatgatgtttatttcagcgacaacgtataattacacaagtagtaaaagcggttacctccagcgggttaccgcttttactgtaaatttttttatataactatcttttagaaatacttttttctttatgtagtagcatcaacatatatatattagtgtacagctaataaaatatggtacggtcaatgtaaaatcattgaagattaaaggtaaaaaagcaaaaatattgtgtcttagctattgtaaattttaaaataatatgttataataaatcttaaataaatgagaggaacaggggggatcatatgacaatggctacactcaaaatagtcttttgggctttagctttcgtgttctttgttgtatgcgaggtcgcaacaggaacggcacttgtgtctatatggcttgctatagcagcgcttattgcgatgttttgtgccatagctaagctttctttccttacacagtgcatcgtattcgtcgtaagctcgatcatacttcttttgcttacaagacctgtggtcaagaagctccagaacaagccagttgcaacaaattacgagcttgatgtgggaaaaactgcaatagttattgagcctatagataactctgtgaacaaaggcagggtcactcttgagggcacagattgggcagcaagaactgaggacggctcaaagatctcagaaggcacaccagttaaggtcgtgcgtattgacggtgcaaagctgatagtttcagaagaaaagtaacagcttacataaacttatttttaggaggcatataatggaacctggaatttatatcgtacttgctatcatcgtattgcttataatcattgttatcagcaacatcaagatagtaccgcaggcatatgtatttgtagttgaaagacttggagcttttcatgcggcatggggaacgggacttcacgtaaaagtaccttttatcgaccgagttgcaaaaagagtatctatcaaagagcaggtagttgacttcaagccacagtcagttatcacaaaggataacgtaacaatgcagatagacactgttgtgttcttccagataacaaacgcaatgcagttcacatacggcgttgagagacctatctcggctattgaaaatctgacggcaacaacactcagaaacattgttggtgaccttgatcttgaggctacgctcacttcccgtgacattatcaacacaaggatcacagcaattcttgatgaagccacagataggtggggaatcaaggtgcagagagttgagcttaagaatattcttccgccaagagaaattcaggacgcaatggaaaagcaaatgaaagctgaccgtgaaagacgtgaaaaggtcattcaggcagaggctgagaagaaatctcaggtgcttgttgcagagggtgagaaagaatctaagatactcagagcacaggcagacaaggagtcacagatacttgcagccgaagctgagaagcagtctatgatacttcgtgcagacgctgtaaaggagcagaagatacttgaggcagagggtgaagcgcaggctatcgacatggtacagaaagcgattgccgagagtatcgtcaagctgaatgctgctaaccctaacgagcaggtaatccagctcaagagccttgaagcatttgctaaggcagcagacggcaaggctacaaagatcattataccaagtgagatacagggcattgcaggtcttgcaacaggacttaaagaagtcatgacagacgttaagaagccacagtaaaacgcatatagttaatccccttcaaggcaaatgctttggaggggatatttttttgcattgaaaagcgagcaggacactaagataaactcaataccctcccaatatcattaagctaaaaaaaatcaagaaataaaataactatgatacattcgcatgaatacgttagctatcggctctaaaaatgctccgtcagcaaaaaaaattgtatgcgttatgcagtccattttagttcgtgcagcaagttgttctgccgcagcagtgttgccgtccatcgctaatctgtataactttaaactatccagccaaaaatcaacagcatgataaattatcgaagttgtgagagcaaaaatttacagttttactttaactccataaatttcatcatcttcaccgatcaacagccaacaaaaatcacaaatgcaatacatattcaggctacaaggatgtctattgtttaggtagaaaatagaatcattttcataaaaataaacaaaattatccttttcattttcaattttaaaatacctatgagtatcattgcattcaatcatactaaataagcagtattcatttttatcaataaataatgaatcaaactgattactgtttatcttcattgaatcagaaacaaaaaatgatatatattcaataatattagttctactgtttactgctatatctaatggtgtatgctttctttgatgatcatagtaaaaggcatgataaataatatcactaggatcacttcgacatgttttctgaactttatacattgtgaaattatcttttttacttatacagtcaataatcaaatcatattgaaaactatatcgttgttgtataagatataattcataatcatctgaaatatatttaattttcatatgatcacctatccttcataaaatgcatggaaaactactccttctttagtgtcaattccgaacacccaaccgccaaagttaagatcttcatatctgcctaaaggtttgcttgcaagttctcccattgcttgatctaaagcagatacataactttctaacatcaattgacttcttaaatcaattgaaaaacttgtttcaccaaatcgaccaacatactcccccatatgttccgtagcattcgcattagttcacactacatttgtttcggtattaggatttatataaaattcttttaaataatcatcgggaatacgcaaatccagttcttttttaagttcatgaaaatattttttccattgaattgaaattttttcccaccaaccatcaattgaggttttaataagtatagcctcattattatcaccccaatcataacatatgcaacatccgcaagcaccttgaccataattaaagcgcatatcaaaatagtcacaatacttgaatcccagactaaattcttcatgtccgttgccgcaaaaagcgtctatcaaattaaaatccgaaactaaactaccaaaatattttttcatttcagtttcaacagcttgggcttttatttctgcttgattttcattcattataaaaacccctttgcttttaaaaatttcttgggaatttgcttttttacatctgtcgttatacattttatcaaactttcacaaagcttatcaaagtcggtattaagcgatgacgaaaatagcattttcttttcactgcgatttgttatgataaaaaaatataagttgttatctctaatttcaacctcaaacggataataatcataaacgattgaagccattttattattacaaaaagtaacagtatctattaaatgcttgtcataactacgtattttttgagttaatgttctaagtaaattaaatttttcatctaattccataccaaaaatctcctactggtagtaaatcaatatatccgtatttattttttaaatactcccattcattatatagcgatgttcctgtaaaatttctgtttaacgatttctttttcctgtattttctgtccctcggatttcctcatgatagaaataatccacgatcaccggatgcccctgcggaactcttccgtaaggcatttcattatccacaaagggacaatcatatttcttagccatttcctcagcttttacttcaagtgcttcaaagtagctgcggttatgcttgttatagatctcatcgtaaagcggtacaagatcaggatgttttccggcgatataatccataattgtcttcttgaaaccgccccgaagattgagattttcgagccagaacagatcgcactgatcctttacccgctcaaaaatggcttcaaaatccgtgataccgggaaataccggggatacgaaacagactgtacgaatatctgcttcatatacctgcttcatagcagcgatacgccgctcaatgctcgaagcagagtccatatcgttcttaaaattttcatccagtgtgttgatcgaccatgaaatggtcactcgtccaaggttcttcagcagatcaatatcccgtaccacaagatcagactttgtgcagatcaaaatatctgcgtcactgccgatcagctgctccagaagttttctggtattcctgaattgctcctcttgtggattgtagccatctgtcacagaaccgataaccacacgctgtccggcatatttcttcggatttttaatttccggccaatgcttcacatcaaggaaagtgccccattcctccgtgtgtccggtaaagcgcttcataaaagaagcatagcaatacttgcaggcatgtgtacagcctacataaggattgaccgagtaaccgcctaccggcagactggacttggtcatgatgttctttgtttccacctcacgaatgaggattccatcgattacttctgccatgatctctgcacctccaacactttgttgaattcctccggcatttcctgaatcatattttcattccctatgatagggacaagatcttccttcataaacaccggaatgccgagtgcgtgtgcctgatccgtcagagaccatgcccattccggctccgtatgaatcttcctgctctgagctccggtcatggtgccgacaacgatccaattgattccggaaaggtcaactgtgccgggatcgtcgaataacggctcaaaggtaacatggtaatgttttgctctgacgtttttccgaagggcgtcgatacgccacagttcggctttcctcgtcaccgtaacgccaaaccatgcgttttccagatcggtatcaaaatccagcagatcaggtcgtttggtcagaaacaggaactgatgctgtggattttcacggatctttgcaaatacctcgtctctccattccgacttccatccggagagatcgctcatgccggtaagaagaaagttctgcggacgtttcttttccatcatcctgagcttacccggaaagaattcagggtcagcaaagtcatcgatcatatgccagcgtttcacgttgttgcgggcatagcaatatgtacaccccactgtgcagccaatgacgatattcatgttctgaatctgatctttgatacaaatactcatgacttctgccactcctcaagattctttctgatgcggtcgaggcattcctcaaaccgggtaatttcttcctctgaaaaaccattgtagtaaatgctgcccatctcatcagatacagaatcgtactcgccctttaaggcatgtgctttctcggtcagaaacaggagggttttccttttgtccgtttcagactgaacacggcttatcagcccttgattttccattctttccagcatcgtcgtaagagatgttatcgctaatccgcatttagtcgagagcgacctgattgagataccatcctcctgccacagcacataaagaatgcgcccctgggctccattgaacgcatcaatatttttttcgctgagaatcttctcaaaaatccggtcaccaagctgttttattttggtgacaagaaatccgccatttgttttcatacaaaagctcctatatagtagtttattagattatactatatagaagctttgttgtcaagagctttttcaaaaaatattctgtacaaattccgatttgtcaatctgttttactttccgcttccggcttatagttcttttcaatatattcctctacagccttgataaacatctgattcatactcatgcccatttcagaagcaatagatttcagtttttcacgctgtccctttggaacacgaatcttgatgtcatcaaggtgtgttttcacatactttgccgtaatcgcttttcgtttttcattatagtacatagaaatcaatcctttcgtattgtacccattactataattatactctctcagaagctttttgtcaattcatcatataaaaattgtccggattttttcagagaactttgtgcgcattgcggcttgaaaaaacaagtgcaatgatatataatagtattgtacccaatactaaaatatgaaaggagtttttcaaaatgattcaaaaaaataattcccattgaagcaagtattacgttgataggctcagcaagtctgacagcctatgccgatatggttttgtcaatatcacttgacacattttattcgaacaagaattatgcagcgagaaagatatgatcatagtagagctttcttcgtactgccggaggcagcccaccgttggcagtgcagattcttctgttagcccagtaactcatataatatctccagatcatagtcttcaactctttcataaagtagttctccgactcgtcctcacggctgtagaacagctcttctttcattcttgcccacatactttcatagcgtgcattatcatgacatcttccgttggtgctgttcatgctttgaatgatcccatatttctttacagcagcatcctttctctgctgcaatgcaagatacatacgctctctgccgtagcagtcattatattggtctttttcgtggatcttcatcatttcatctgcaagcgcctgatacttccagggggcgttttttatggctgagatgatcgtaaaatgcttgtcttgtaacctccaaagccttgcagtaaaaactgatccttcctgtgatcctaccgtcatcagtctttttgaaaatgaactttaaccgttcttctttcctgacttccgacggtttgcggtgaaaaaagcagatgtttcctccagaaattcattaagctcttcaagctcactgtttttcttttcgagctctttgatccgcttgtttgctgcctgaagcttgcgagctttattgcctgctttttaaactcttcatcatattgttttcctgttcccattgatgacacactcctttgtttttattatactttgactgttttgtatgtgtcaagttttattatacaggattaatcgtaatacattacacattcctcctttttctacaaatgaaaaaaggctgttttatcatcatcactcaaattcgtgacaatatacaaaacagcctttaaaactttgtgaatattttttcataacaaatcggcaggatcagagcaaaatctgctcaaagtctgccgttatgttcgatttttttggttgtgtagggttcgacttccttttttggtgaaaaccggtgaaaagcatctacggttttacacctgaaatttttactctcaaaacgcaaaaaagctcgcaaatgcgagcttttcgggcacaatatctatttcattgcacaagtatggtgcgggtgacaggacttgaacctgcacggtgttgccaatagaacctaaatctatcgcgtctgccaattccgccacacccgcgtacaaaacaacattattattttatcataaactccctactttgtcaagactttttgctcaaaaaaaatgcccgatgctgttcagttgtcaatgataggtgacacatcttctcaaaaaataatgttaagtaactaattgcagcttttcatttggattttttggatggctatacaaagttttcgctgtcacgataatttttttcatttgtgtcttgacaagggggacattatatacagttcattgattattataggaattcccacaattgcaaatattattacaacaattaatagtattaataaatatacattatttctttttttcatagttgcaattctccaattttttcttttaataatcctcgttttattgttaaattcagtaactttttcagttccgcatacaatgttaccaatttggctgtcattttcaagccattcggtacagatagatttattcaagggtgattttatagtcatatcaagtacatcacaatctaaaaataaagctctataatatctacggtcagaggcatctaatcctcttacctgtatttaaagtgttatcatcacggtttttgaaaatatttgttattcctattataccatttttctgtggggaaagcaagcaggatcgcacaaaaaacaagccacaccctgtgcaatcaaatcagcacagagtatggcttgtctattactattttttcattgcatttaaaatagaatatatattttgttcggataaatatccggaagggatatggctcttgttctcgtgatactcaagatttgctctgccattagtttctgccaccagcaatgcagtaaaaaaacgctcccaactgaaatacttttcacaatctatatgttctgccgggtcagccaaaatctcttgaacattatcgttacggtcaaaaatcgccgagcgaagaataagccattcaaaactctccggcaaaaaaagatcgatcttattatttgatacagaccttaaatacataagctctttgatttctgaaccaagtgccgcagcgtcggctattacaagaatacgcttacctttatgctgttccagtaattttacaattccgctctttccgttagaactgatacattcgagatcgtgatcttcagttgctttcttaaaaaactgaagacccgacctgctgtcttcaacgattacaatatcatacggaaatgctgatatatcattttttgaaatgttcttatatatcttctcgaacttcggttttgcaccatttttatggatcttcctgatagcatctatactgtatggaatttgcgccaacggctctcttgttacaagaacataataattatcagaaccctgaatcgcttttgcaaactcataagaagatagaaatggtgtactttcttcaacaaaaacaatgctctcgtgagtattttcaagaatggtttcccaactagcatttgacaatacaaggcaaggtttactgcactttaaagttacaccgctttgttcaccaagctcggaatagtttctcaccatattgatgagtttcgtttttccggtgccgctgtcccctgtcaatatcgttacatttctctcaagagtaaaattaaacgttatgtgcctgttttttatttgtatttttattttacccctcattttcttcactcctcagatatctatctgcaagcatcaaatattcaattgggtctgtaatcacttttcttttcccttcatttattattttcacagaaaaagactttccaaagtccatcaaatgatgcaatgataccgtaatatccttgttttcagccatttcaagcagatactttgagcagttatctccgcaatttgaaatattgaagatctttttaggctgattatatatcagcagaagagtcttaacgcccgctgacaattccgttgaattaaatttgccaaaaatatcgttttctataagatcagggccaattacagttgagtcatcaatatccttaatgatcttttttgcaaatggttccatgacccacattttatcatactgatttgcataatagacctcagtattgtatatttctttagggtgttttccaaaaaatattctaagcacaacaccatctccttatagctattattcacaagcgaaacggacgtatacgcccatacagtctgccttcttgaaaaattttgttattctcattataccatttttctgcggggaaagcaagcaggatcgcataaaaaataagccacactctgtgctgtcaaatcggcacgaggtgtggctgttatgttgataataattttgttgtacatctataagttggaatttatctttcagcagcgatcagtatagctctgcaaggcgaaccgtccgcacctgatagatttaatggtgctgcgtttaagaaataaactccctctgaaacttctgctaaacgtatcccttcaagcaatacagcgccagctcctaataggataaggtgtacttccatcggagcattttcaggaccgacagtttgagattcattaccaagcagtaaaatgtttgattcagcaaacactttagctgcttccgcagagacctctgcatctcccttgataagaattctctttgccgcttctgaattctgttttttcgctttttcaagtatttccgtggcatcatcggcagaaacgattccattatattctgcaacataagccattcctataaatgtatctaaacttacggaatctacggtttttccgtctttgataaaatgaaacggcgcatctatatgcgtgccgttgtgagcgcacatactaaaagccgtcaggttatacaaatcgcctttttccattgaagaaatcaccctttttttcggtgtcgggtcgcctggatatacctgacagccgaaaacctcttgagaaatatcatagattttcatttcatattctcctccacaaattccgatttgtatttccattcataattatccactctacctttccactcacctcgccaaaaacttttgatacttactcttcggcttctcaggtatcgtcataataagcctgccgcttgctatcattggcttgacgtacctttccataacgtaagcgatcgtcattctgccattgaaaaactccgctatctcattcctgcttctcggcgttttacagaattcaagtatctcagtttcaatgtcatctatcggcacgctttcggcggcgctgttgtacaacgtcaccttgaatacgcctctgtcgctctcgaatttcggtgcaggcagaccactttcttccattgcatttattatcgtgggtatgccgctgtatctgttctccgtttcaccgagtatctccatagcacccgctatcttagggtttcttgtgtcggcagacacttttcccaatctgtcaagggtcattctgccgtaaagtccgccgggattttctatctcaaaacggtcgctgaacatctttatggttataggcgtcgtgtccgtgtggatactgtaatctctgtggataagagcgttcaggatgagctctcttatagcaattacaggatattccgtcttgtccgttcgcttgcccgtgttcgggtctatgatagtcgcagttttcatatttttgcgcacgaacaccaaagcatcattcagcatctgcacaagtgttccgtctattcgctgattgtctataaaacgttcgccgacgcttgccgtactgcttatctcagttccgggtacggacacagccgttatgcaaagctgcggaaaaaacgcctgcgggtagtttgaaaaaagcattatccctgccaaagtcggtttgccctcatcagtaaaaccttgcagacgacatatttcttcatttgaaagctcggcaagattaggctttttgcttttcagcaggtcaaaataaagcttgaatgcgttggtctgaatgtccttttcaaatgtcctttcgcaagttctcagctcgtcgtgaatgctttttttgaaagcctcatagctgtaaacctcatattccgtcataagtctgtcagcgtcgcccgacctgacatatgagcctttcagcctgcctacaccgctgtaaaagcagggtttgtcagcattatcaatctcctgtatctcggcagacacgacagttttcccgtcgatagatgcaacggaaaacagcggtcttatcacaggcgtcatttcctgacactgcgcctcgacctttttcataaggtcagcagcgtcatatactccacagacagcgtagccgtcatgttcatctacgccgaaaataataacgcctccgcccgactgatttgaaaaagaggacagcgaatcacgcaccttagggcagcccttatttgccgcttttatctctatcttgttgctctcgctgcgaacaagctgtatttgtttcaccatatctacaagttcattatccagcattttatcgcctccataatataattatactgattttattagaatttgtcaagattaatttcttataaaattgtaatttgtcttataaaagtctaataaaagccgtataaaatgaggtgatggcttataatttgatatggaagtgcaaaaaaatcaccgatacaggcacaaaggcttgtatcggtgatttttctttacccatagtcatttgatcgaaaagcccgcttagcctacctcagctcagcgaactaatataataccctagtgtactcttaggattaagctccgaaagatcaacagctacgcctactgccatgcctagccgctcgcggtctgcctgcgatacgtcgaactctatgccccacgcgttgccgtctatgtttatccacgctgtcgggccgaacgttccgccgtcaagcgttgcgccctccaggcttgggcaaatggctttcagctcgttgtacgtcattccaacctgcacgccctcggtgatgtatccgcccggcgtgacgtgtatcgcgtacgggaaatcaagcgtgccgatgttctgtatgtccatggtgtaaaagcctattttcgtgttcggatacacgtcgtcgttctccacggcgatgatgttttcctgccccactgatataaaatccatgctgaaatcgtcgcccagttcggcaaaaatatcgtccgccgtttcgtagataaggtcgttcgcatacaccgtgtcgtcgtaaatgtcatacggcgcaagcgtggtcacgggcttagtcgtggtcgcctcggcggtcgttgtggtggtagtttccgtcggctgagcggcgctgtcagattgttcgtctgccgaactaccgccaacttcgataagaaaagtcgccgaatgttcgtcaccgtctgaatcataatggctctcagtgatcctgaaatcgcccgcattgtccacaccaatgcaagcctgagccttgcaggtgcttccgataggcgcttcatttgggtttctcgtaacgtcgcccgggtaactgtaacccataacgccattgctgtctattatggtgtcctccatgtcgaagaaaatgccctttgctatgccgtcctcgtcctcgtaaccgatgtttgtatattcgtagtccacgatatagaccgccgcaggtttttcgtccgcatactcattgcgctcagccgtttccgtgacgcctgtaacggtaagcgaccactgcccgtcaactgtccaagtttcgccaatggtgtagtagtctttcttcatgctttttttgccactgcctgaatcgctgtctgagcaagcggtgagcagcaccaccgcacccgcgaggaccgctgctgttagtttttttatggtcatttggtgataccccctatatcttgatctcgatagctagcagtttctcctcagttttctcgacctcttcaagaaccgtgcttctcgttcttacaatgtacttgtcaaccgtttcatgaaggtcatttttgatatcttttgctctctttatgtttatctttatctctgcaaaaagttttttcataagctctttggtaacgtcctggttcatgaatttcagtatttttcccgtcgattcggcgatcctttccacctgctgacttacttcttctttgaaagcctttgttgcgtcaaaaaacattatcgggtcgttcagcagttttaacgtatccataccaaaaacgatcgtgtaatactcttttgacagctgctgataataattatacgcatcgttaaactcgctatttagtttcattacggactttataacgaacacgctgaattcattatttatcttctcttcaaattcatccagcttatgatgctttcgcagaacaaagcttgtacttgccaccatatcatgaagcttatcgtgctcgctgcgaaacatttcgttggcgtgctcttttattttatacggcacttttaccttgtaattgttccacaagttgcggataatgcagtttactacctcttcgcgtccaaacttttttacctcgccagaaataagttttttctcatagttgtttacaaatatcaccgagtcagccgaaacgccgccgtcttcaactatgcgccttttcatgcgctccgctctgtcgtcgttctcagatttgcagtgggttatcacaacgtttacgttgtttttctcagctataaggtcgtttattatgcttatctcaaagtcttccactctgtcagagtcggcgctaaggcagtagattatggtgctgaaccattctttgatagagtgcttgtcgtactccgctactttgtcgattatctgcttgtgccatttgtccgccttatcgggttcaagaccccagctgtcgcatatcgaaaaagatatgcggtcgttatctttcagctcgaaagaatattcgtgcagaccctcagccgtcacgggctttcccgcacccgtttccgcgacctcttcgccaaatatgtaattcagcagactgcttttgccaacgcccgatttgccggctatcagtatattagtttttatcttgttgccttccattattttcttgctccttttttcgtatccttgaacatatcaactacagcttttactattctctctacaattttctgatccttgcccttgctgatctctttcattacctttttcagattttcaacagtaaagtagtcggaaattttggtgatcataaggtctttcgagccgccgttctctatgcaggctttagtgtattcctcgcagatcttcgttatcgcaacgccgagggtagccgtaacagtagttgccactgaaacatttaccgtagctttcgccgcgccgccgacaaatgggatcaccgaaagcagctgagaagccagcgtttttcctatataagaaacgaagcccgctccggctaaatttttcacaacgcccttcatatcattatctattccgtagcagcttaaaatatccatcgccatttttacctgtatgcccataagcggtaccgaatcggaaagtggcacgggtacaaatgatgtagccgtaacaatacctgcggctaaagccgcgtatttcggtatcttgtgctttatcatcatttctgccatttgaccctgcgcttttttgagcgacgggataaagctttctctgaggtaatcgtcaagattatgatgtgcccagctgtttatctcagatttctgcacatactcgtcgccaagatcgctgttagtagaataggtaaacacctcaatgccgtttatcctattgcgttttccggcttcgccgacagcgtcctttatctgagcgacttcgttctcgtcaagattatccacctttgtaataataacgcacacggggatatttctcgcctgtatgtcttttatcagcctttcatcgagatccatgaagcggttatttatgcagtaccaaacctcgtggatgtgcatacccaaatccgcaggataattatttttgcgttcgtcgataaggtcgattatgtttctgtaaaaagcactgttttccggcgtagacgagctttctacctcgtagccctcagtgtcgaacagggtaatgctctttgaatgatactcgtgtatgccccttgtctgcggttttccgctgcttccgacaggcgcggcgctatccttatcaaactcgaagaagtcgtttataaggctgcttttgccaacgccggtagctccgcacactatgatattgatattatttgaagcattttcctttacttcttcatagcacttatcatagtcaaagttttttacgtcaaatttcttgttgatgttttcgttcatgtcaaaaaactccttttccttattgatttgtcaattatcaactataactgacataataatacgtttttgtatgttaattataacacattctttttcacttttgttaagctggctgcttagtataacgttttcgtaagatatttttttattttaacaaaaaacatggcacaatccgcttcttatacaaatatcgcattatttcaaatactttacatcattatatcatattatttcacatatttcaacccctttataggaaaaattccgacataatgcataatgatataggataaaatattatatatgggggtgcaaataatgtacgagaacaaattcatgtatgacaataattttgctttgaggatctcaaaacttcgcacacagaaaggtgtttccgcaagggatatgagcttatctattggacagaacgcagggtatataaacaatatcgaaacaggaaaagccctgccctctatgacctctttcttttatatctgcgagtatctgggcattacgccgcaggagtttttcgacgccgacgccgagcagccaaaagagctgagtaagctgatctctgacctgaaaaagctcaacaaaaggcagctggagaacattgcagatattgttaatgatcttgctaatgggaataggcggtgagagggtaaaaggtaagtttgtacgtctgccgcatagacaagaccgacactttgaagcatgattataaggtaaataggtacaggagaggtgagttcagggcaaaaaaaatcacagccccctcgaaagctgtgattccttttcaactcaatactcctccgccaacagcagcgtaatatgatccacatcgtcgatcaaatacgccctgccgtttacctccacgtcggtcggtatgaaatattcaagcttagcctcggggcattcctgcatatgataaatgtgcaggaattttttctgccccttgacttctgtaactatctcgaaaacttgcagataatcaagctgtccgctgaccttttctcgcatttgctctacggctgaaaataacgccacttgcaattcaatagggaagttttctgccacgccgcttgtgacgtatctgcttccgctaaatgtgtatgccataaaatacctcctaataatattcccccaccagcaccctagcctcctcgatacactccctcaacatactcctgtcgcaaagcataccctctatctcttcgtccgtgtaacccatatcgtaaagcagcataagatcttcctgcgataccccgaacataccgcatatgtcaaaaagttcatcatcgtcataagcgggctttctgtatccgtaatagttccagccatagcagaactcgtttggaataaaactgcttttctcaaaacgcccacgcttgtcaatgcttatgatctccccctctgtgacctttatcacttcaaaaggaagcttttcaaggaaactgcctttcagcacgttcttcataatgtcctcggtggacgtataaacatacagccctaattgcttgtaatggataaggcaaagcggattgtcgccctttgctatgaaaagcttgttcttgtcgctaagtatcgtgaatacgaacgaaccctctaccgcctctgacatcttcgctatggtcttgaagtcaagtctgccgtatttctcgataagctgtgcggcaacgtagctgtcagtttctatcttgcttttcggcagatgttcggactttgcaagctgactgtcgttgtaaagcacgccgttgtgacataaagcaaaagacccgtccgcagttttgcctgtgaacgggtggttattgcaaatgtatctggcgtcgccttgggtagtcattctcgtgtgacctgtgaggataactgtgtcctccggcacataaagctttaccttgtgagcaggctttgctctcttgaaaactttaagttcgccgtgtttcacatacgctattcccgttgcgtccttgccccttacctcagactctacggataacctgttgataagttctttcatctcgctcctgctgagcgaacgtctgtaatttacaaatccaaatatcgcacacatagttaatcctcctcgctgacaggctcgttaacatagagccttttctctttcagatacctgataagttctgtatattcaggctttatgcccagcacaaaatccgcccaagattgcttgttcatatcatcgtcattaaggcaaactgcattttcgcatatgctgtcaacaagttcaagcgtcgccataaagctgttgaattttagagtgcccctgaacagccttatctccacagtatcagcatttgttatgttcacacaggcatatctgcccttagtgcttttctttgccttttcaagtatctctttcggcttgtcattgtaaccgtgtcttgctgcccagcggtcaacgctgtatgcagtacgccgtgagaatttgaaaagctcgttccaatggctctcgaaaaagaacattattcggcttatgacgtcttcctgttcctcataggaatatccaagctgttttcggcctatatggacgtgaagtccgcaggtagacgtattatgcgaacggtagccaagagaaagcgcttttctcacaatatcctcccacggaaacttctttcgatgaaaatctatggaacaagggtggctgacaagttccattccctcgtccagcgagccgtctgactttatgtaaagcacttcattctgaacattagctgtatcatatatcttctccgcattatcatcatatcttcctgcaccgtctatctctagttcaacgccgtaaaaacgcacgttgtcttctttcggcagcttgtaaaacacgggcttaggcttgtagtaataatcattgatgtagtcgccgctgtcacagcaatcgtcataacattcacggcaataggcgttatcgccgcgccagtaagtatcgtctgaatgcacgatagtttcgcagtttgaacagcggtaataatgattatcatagcaatctgtgcagaggatagtgttttcatcgctcacggtattctgttcgatacagcgttcgccgcaatggtcgcataccacagtttcgttatcgtagcaatcctgacaaagtatctcgttttcgacttcatagcattccgcctcgtcctctaaagtgcagccgcaaatgctgcaatgggtaagttcgctcattttaaaactcctttacaaaaattaaaggcagacccgaaagcctgcctatggtgttcactcgtccttatctgctatgtaggtgatgatctcctgtgctatctccaccagcacgctgcccacaagcacgagtatgactttagctttgttcatcgtaacgccctcctttccgcatttgcgttacttcataaagatgatgtatatttgtaaagatcaagtttccgtaaaaagcctatttaaaccgtcgaacattaagataaaccgatattttttgaaaggaatgataaattatgtttgacgatattcccgatatacttaccgctaaagaatgtcagcagcttttaaagataggcaaaaactctatgcttcgttatcttaaaacaggggagatagagggtttcaagattggcagcaggtggaggatatacaagtttagtgttattgagtttttgaggaagaggtgaaaaaagaaccgcccctgtactgtgtttttcggtacaggggcgttattatgatccctacaaatcacctccataccaaaacacttccttccccctagactttctgcgtatatattcatacaacgctttttcctcctcactcggcggagaaaaccccaaaatagtgttcagcgattgtaaaaacggcgtttccttgtcgcttgttggaactgatgaaacgcccatatcctcaaatttgctgagcagctttgaaactgaccgctgacatttttcgctgttctctatcacgctctccatagtaggtcgtgaagcgtgcgcaagttgctttgaaaaatcattcatcttttcgccaagctttgtcttgcccgaaacgtactttttgatctgttttttctgccagtagggcgatataaaacaactgtctttgttaagcacaaaaacgtcatcgaaaacatctcttatgacctccattctcctgcggtaaatttccaccagcttttgagccgtgtatgctttctcggaaagcttgtccgcaaactttttcctgcacctcacttcaacacgcatcgtgtctttgtaatgttctttctgttcatcactgctgttcttcttattgcgaacttcgtgacccttattatatacaacaaattctacatttttagagtcattgacagcattgaatgaactgtcaggatcaaaaccctcagtattctcctcaagcttcttgttgtgatgaaaaccaagcgtcaaataaagctgacgcataatgcgtatgtactgagtgattttgtcctcagggataccgtgaatatcctccgtcagatcgaccctcgtgatctcaaaatcgtctatcgtcaagccgctaaaacaatactgtatctgcatatccaaccgctcgaccatatcgcaaaattctataatattgcttatatgctcagtcttcatataaggcttataaaatttattaggatttatcctaagtactaatttgtacttactgctatttttatacaactcagccttactgcttcttcttgtttttattataatgcccatgtcacttaattcagtggaaataaattctttattgcctgccccttttttagggtctaccattttaaaatttttagttagtttaattatgtcatcgaagtcggaactgtaagtgagttccagcgtatctatgaaataaatattcaagataatacctcctaacaattaattttcaacaaatatttgtcaaattaatttcatgttatcttgctatttgaattttatgtcacagacaaatatataaaaatattaaacttacaactattatttagtaagtagtatttatataatactagctatcaaaactccctaaaattagaaataagaattatgggggtaagggggagaggtatcctaaaaatgacaaaaaaggtgcagcggtttcacatttatatatagacagaaaatctgaaatacttacgaaaaaaaccacaatggtaacggttgaacccttatcattgtggtttttaaacttattttttcatggtaaatttacagtatattttataatttacatatataggtacaaggcgactatgcatttcggacgtttagtgtcctttatgatagagtgtttttaatgctcaaacttactttatctgcaatattctcagcacggatccactccaaaattgaaggtgtaatgtcggtaagagtagccctcttatcacgaactttaatgagaaaattcattatttcattatcaaacttcatctcttccagaagcatatccgctttttgtcgtgctacatcgtatgaattaatacattcctgtgtcaatggccacttttcacatttattaatagcagcaatacaacttcttacgacattaggttctgggtgaacaaggacaatgatgttaagattatttattaactcactgatatttgctttatagaaagtttcccattcctttgaaattgaagctataaatgtttctgatttctgtttaaaatttccaggacttacagcctttaaattgtcaaatgtttgttttgaataattcatgagatactgcaaatcagtagcagtatttgattgcaaggagaaattaaattttttcctagcaagaacataggatgtaagagacggggtgagttttgttaagctgtcgaaaaaagtagaatttcttttggcagcattggcgttatcattctctttctgcctattatcaacaacatcttcaattagagcgatggttgactgaattttttcatgtagcactactccaccccctctaatgcctttaataaaatttcaaaatctttttgctgttgttcaaaacgaggatcaacattatcgttccagttgcctttacgtgtcaaattctccttttcactatgcatctgaccataagcggtatcaatatcattgtttactttttgcagtattttaagaaaaggtaaaacaacgcctattgggtttgatgagaaggaatataacacagaaatatcttcatcttcagaataatccttttgaagtattctcatggcctgtacgatttttggagccgatttttttagctcttctaaatcgacattattactgctaatattgacccccgcaataaaacattgttggtaaaagctttgaatatcattgatgagatcacgaatatcacttgcgtccatctcatcctccatgtcaatgttttcaaaaaagccaagtatatttgctgcagtttcatgtgcaagattggtttcttcttctactactttttttactttagtaattactttttgtgccagctcaaaaatttctttcttatccttgatattaacatcattttcatctagaatatattttgatttgcgaatttctttcaatgcagcttgataaagcgaataatttagcacatagctatctgtgttgatcgacataccctgaataaggttaaagtatctgacagaagctgtatatgcgtcgggcgttttagggtcattatatataaattgatgcaagtcgtaccacgcacgagagtgccctattgaaaattcagccgatttattttttaaactatccgcacgaagaaatgtttcatctcctagatgattaagttttgcatcacttatttttccgttgattattaacttgtacactttttcaatcatagctgccttgatatatgcaggaatggcagaacctttatttacatcctttataacatttacaaactgatctttgtttcgttgcaaccatgaggtagcaaggtagattgctgaagctgaatcgggaaaattccaagatttatttcctagatagagccacttaccaaagcagagaagaagttgatacgtctcgtctgtatcacgaagtatcacaatacatctactaataccttgatcttgcctttcaaacccaattagtctgttgcctacagaatctttaaatctgttttttgaatcaagcggaactccttcttgctgccaattgatcgcatcataaacaaaattactaatttgctcacgaacattaacaaagcccataaggttggcaccatcataatgccaagcaaacacagattctttgaatgaattataatttttctgatttttcggatcaattttaaggatctctttcaatgtgggatttgaagattgagcctgatcttccgattcaacggcagcttcatcatttataccatccgtgtcatttgttttagttagagagtcgttagcattaactgaagtatctacgtggtctggtatattcttgatatttgtcgtgcttgtgagcttgccaacaaaatcactaaaatcaagttcgaaaaatatctttgtatttattccagcaatgcgaccattactcgtaacatcaagtgttttatctgtccaaaaactcataaaagtaaccaagcgttttctgtaatcagatttctgttcctgaggtatttttatagattgaactatatttcctattctgttttcaatcgattcaggaagtgaagaacgccaacctaagcaaaatttaggaaatgtcgatatactatataatacctcgtttacagcaggctctataatatctctcagaatatatctcggcgttttatgatttgacatagcatcgtatagatttataatcgcatttttagtgaaagggaaaagagatatttgccttcccgatgccagtttaaatttatcccaatggtcaagatcatcgtcttcataaaccggcatttcttctgaataagcaccatttttcacccattcatcaagaacttcgctatcgagagatatagcattaagatacttggcgacaaattgaacaaggtcgtttttgttttcaccgataacgccgtcatgtattgttatttgctttgtgatacggtcacggtagttatctctgaattgattatagtactgggttgtggtacctacaacagaaatcagtctacataagttgtctacttcatttgaacctgtatgaccagttacaagagcgttaagtagagcctgattaacacctgtaaatgaagtaatatcttctattagcagtattaaattttttccctttctctttaattcctgtctaatttctttgaatatctgctgaaaatcgcctggttcaatgccggcacttgtctgaattacagtttcaacgaaagaattcatatatgctgttattttcactataaaatcatcatcgccgccttctaaaaggttgtcggcaaagtcccgcgcttttttgtcagcatcatctaattggttggtaaaatcaatatcaagtgttaagtcctctttggtaaactgagcgatcaaatcaagatcaatactagatgatgaacttgttatcttgttgtagatcctgtctattggacctcctgcagccattagcctttcttgaaataaagagttattaagtaaagcaacaagtttttttcttttcatgctgctcaacatctcgctggtatcattctcaatttctactatgaactgatgatagatggttgacttaaacttattttcagtaatagctttatttgcttttacaagacgttcgtaggcttctttgtttgatatttctttaacttccttaatatcaagaagctgtctgatagttcctttaagtgtgttatcacttcttcgtatcaaaagaactgcatcatctttttcttctttggcagaaagcatagcatataaccaacgtataaaatgtgatttaccagcaccacttgagccttcaactataacaaattgatgttcatttttcgttagttcattattaaagatgtccctatatatatattcttcagatctataagtttcctcaaactgatttcccgattttgtaccaactactattttgcgaaaaggcacatgggttgcaagaaaatcactgtctgtactatcaatagaatctattcttaacacctgattgattctctttttggcaatagccgtattcattacttcaccaccttcttaataatgatatgtgtaacttcagaagtgaactcatgttcgtcatttgggaacagatgccatgttttttcactatcaagatgtctttcaagttcaatttctttattatcatgcattagtctaagagcatttgacatggcaagattcaacgtttgttttattctggcaccttttaatgcaacagacgaactgtggtgaagattgttgaggaaatcctcaacagaatattccttgtctttttcgatattaccgaggagcataaaatctttcaatgctgtgtacatatttggaagaaagattttagcttgttcctgaaaaaatccaaagccaagaaagttgatccaaaatctcacaccaaggattacatctttctcaagtttaagagaaggtattcctgtttcagcatttataagtcttataacttcagtagaagtagtaactgaaccataacttaaccatttgtcatctgcctccaaaaagcaagagattactttataaaaatcagaagagctatcgttaaaaaccattgaattacagaatagacgaaatgaagttaatgattttatattatctttattgccagtgaaaatgattttattttcgccattataatctataagtttcagctccttggctgtgtctaacacagatccgaaatagctgtttttagcaatgttcaattctggtggtataagaatattattgagatctttttcatctattggtcctttatcagcaacaatttgacttatcgaaagaacacgttctggaatagtttctttctttataggactaaaaaacattatatcagctccttcttaataatataatcatacttacaagctccgtttaccagttcggatatgttcttgttccgtttagcaatataaaaatcggagtttactacgtatacacggttgtattccttgtcatgagatatattcagtactctctcagcaagttcttgatcatcgccaatataaaaaacgatgtttcctgaaagatagtagtaactgttcattcgactaagttcaaagaattcactataccccatgtagtattgtgtgggttttataattttacagcttaataacctaactgctaattcagactcatcaggtatgattatgatatcagcatcgatcagtaaattttgtattatttcataagaatcttcttcacaaattataagcatttctttagtgccagtcataacatcacatagttttccttctggaattgatacaggatagaaaatgggcttttttaatggaaaatgatttcctcgttctgatcttatattgttatgattattgcatccagcacagtattcctcggtaagaagatagatgtcattgaacattgatgaccagcagctttttcctactcttcgtaatttagaggtcaattcttttatttccatatagatacttttactttcatcatcacgtataccattaaagatctcaatggtttgctcacaatcaaacctaattcgtttgtcaattagctttatattaaaaatatacctgtcgtcgctatatttcacgtctgttatttcgatcattctagctcttctaagcaatagaataacataaacattccatgtgatatcggcattatttacgtcaacatagaaagaatctatatcactgtaattaggtttaacagatgtatctatcacaatagaatccaatcgaatattagttttgcggttgttaagcatactaaaccaacgtccacataatttctcaacggtaagaactttttgtgtcattgacatagttgcttttatatcatcatcggtatagagcataacgcttagacatggcaggccatcacgtccaccacgtccgcattcctgataatactggtctgcgcttgagggaatataagaatgaataactgttcttacatcttttttgtccacacctacaccaaatgcgcaggtggctatcatcaggtcaaatttatcacttatccattcgtttataatacgttctcgatcaattgattttgtttttccagtaaaaatcctagtattgtcaaatccaactttggctaattcatgttgtactttttcagcatcatcaggagaattaacatatattatcataggacgtggaagcttacaaacaagctctttgatcctatcgtgcttttcagtatatgagttgcactttataatgtcaaaacgcggttcttttctcagtgcatcaagtcgtatctctatccagcggtcatcatctccatagaacatttttagattgtcaacaacttttttactgaaagtagctgaaagcaggtaagttctaagagaagggttatcttttaccaggagtcttttgaaagaatcaagacactgaaaatctacgcggaatgaagctccccattcaatgattatatgcgcttcgtctataacaaggttttttaaatagccttttgaatttgctttgagaatgctgtcctgtatcctaatgttcttaatcaaagcttctggtgaaataaagagcattctgacaagatttttatcaagtgcggagatcaattcatcgacattacatccactgtgatagtacattatctcttttttattatcaggtttaattatacttgaagcgtttctttgctggtcaagcataagtgaaatcgtagggacaatgataattgtcagaccgttgtcatactgataggaaacagtctgcgtaataaggctttttcctccgccagtggacatggcgaccatagcagtatagccagcaggaacacgaagtgctcctataacagcaagttgttgttctattgatttgaaagtcataaatttttgtttagtaagtttgtagatatatggattaaccaccttgattgctgtgtcatccgcaactttttgtacttgctgattgtcaaaaatagttcttacaaaggtttcattaacatagttaggaagctcaaaattagcatagatgctatcgtttgagtaatttaccttcaaaccaaaacaatttggtgtcaacaaattatagtcttttattgttacgcttgttttgagaaaaagcagaaaatttcttaaagaacattcaaactctatctgtttttcaaaagtttggttagacataaagcgctgataagcgtttatcatacgctcagccacagcagtattgacattgtcgccatttagcaggtctgtgctattaactctcatattcggattatcaaaaaaatcctgaaccttatgaattatatcatgatctgtcatcgattaatcatccttatgtaacatgttgaatcgagcacgattctcggtttagtaaatgatttaagtattagctcatttactctcattttctccgtaaggtcaatatctctatggaaatattctgctgaggcacatattgagctgtattctctattaagcgtatcacttagaagatctattcgtctgagtttatgaaactcttgaatagcctgttttttttgcaacatcatgacaagctgttactttgcttacccattctccgacagaatgagttcttttaaaccacagtagatttgaacttgcaaattttctacttatatcaaggaaatcatttgaaggcgtgcgtttgccaaagtttgcaacataatttttcagttgtgatgccggtatgctgaaatatttttgaaattctcttataacactttggtctgtttctacacacattccatccatagatatatatgtgctgattattttcgaagaaagaaaaccacggtactgattgatctgtttcaatgaaatactattctgtagtaaaagcagttcatcaggagtaatataccaattaaaagcaaaaccttcccagtttatttcgctgcgaatagcaacagcagcacaccttcctttatatgcagatacggcattgttcactatactgtcaaaaatcccatcaccaggtgcaaagaaatgaaggtaatcattctctaaagccaaattacgttcaaacgttccctgaatagagtaattatcattctgtatagctttatcaccattaagcactcttatgtggttttgcatctgatttagtttatcatttataattgcatccatgtcaggaggaacaaatagtgtgttgtatgctgatttaggtgagaaagatgatgcattaaatctcactacatcctccacaactttatttccgtgaaatccagcaagatgtgaccatgacatcatagaattgcggaacagctctctctcattttcattatagcgctttacagttttctcaatttcgctatttatgtgttgatatgcgtatgctgctatgtcaaaatgccgttcttcttttacacgcttttctatctttttgatttcatcgatcatgtcatcaacaatagaagctaaaccatatttgaaatcactcataacggcgtttcttatctgttcatcaatatcattcattatgatttcaagaccactttgtgatttattgaacatattaagacccttgttccatatatcagcaagatccttttctacagagtcatttgcataaactattacagaaactacatctttagttttgtctcttcctattctgtcaagacgtcctatacgttgttcaagtgtattagcgctccatggaaggtctatacaaataagctcatctgctttttggaagtttctgccttcaccgccgctttcatcagaaagcattatacggtaaccaggttcattttggaaacggtaagtattaagttccagttcatcaggtgacatcccttcacagaaaaaagcacaatgttcttcaccaaatactttggtcaacaatctacgaaacagcttatgcgttccggtaaaatgtgtgaatacaagtacctttttatcgtaagcttcctgttctagataatcacagatggtaaccattcttgacataaaatccatagggtcatccagaatacttcttattttttcaattgtttttatgtcttctgatatccatttatcagtcaatcttctgatttcaacaggaacagaagggatccttttcagctcatcagaaaatgcctctgatgaactaaaaaatgcactgataagaggcagtatcatggtatcaaactcttttttgttgaagttattactagatatccattcagaaagtaatgaataaaccctaaattctgtattattgaagtcagaatccatttcataggatatctctttaagaactctgttgtttgtgtcttctggtttctttctgttgcgtattacacatttttcaatttggtatgcctcacagatatacgcaaccatcctttcgagatttatcaaggaaaaattatctgcttcataattgagtttttcaatatcttcttcgatcattttatcttttgtttttccagctatatcctcaagtgtatcaacaagttcgtcaaatgcttcgagagtatcttcattatgttcattatcagaatcccttataacttccttataatcttcaagatactctatcgcagaatgtactttgcggactattttattttgtaattcaagtaagccagtaaattcttcttctcccatatcataatatctttcaggctggatcagcgaaagaagtttgtgatattcttcgctacgactttgaacaggtgtagcactgagcattattacattattagcagtgcgaataagttttagtatcgtttcatagcggcaatcattgtccagaacagagtgtacttcatcaataataataaaatcatatttgtcatttgtcatcgttatctgactcatcggagttatttttatattgtttccgcttagattgtcaccattgaacagactaaacctaaaagcaagctctgtcttccactgttcaaccaatgcgtcagggacacacacaagtacttttttatttttcttatctgataaatacacctttaaaacagaagcggcctctatcgtcttcccaagacccacctcatcagctatcatatatctgcaactgggttcggaaaggcaacgcataactgttttaagctggtatggctttaaaaatatcttacaaccagcaagttccttaaatccgtagaaagcgttatcgatagtatgaatagcgttattgactgcacttctgccaaaataccacataggattttgaaactcaaagcgctttaactgtgacagtggtgacacatcacttgaattaaatgtggttttaatatctttttcacaaatcttcaatactgtgctagtgtcagaagtcagataatagtagataaagttattactcttatcaatattgtgctggataatatgatacatatttccgttgtattcagcaagagaaccatttctaagtatgcaatgattaagctttgataaaggaaattccagcgtttggggaacattataatattttctaagatttaaaagatcaaaaaattccactttggctacctcggaaaaatcgttgatctcaactattctacccgaaatgaaatctcttggttcattaggattttcaacatcgatcgaacatctgacatacattcctattttcagcatatcatcaccacctaaagcttaattttgtgctattcgcaaacaaatgtccttactcgaacaatatttgcaatggacacctcgattatctttgtatctttctttgtcgttatttataatattctcaagatcaatacccattgcattccttataaaatcgtctaattttactaccaaaaaatcatccctgaatctatggatgtcagatggtttgttaaaactgttatgctttcttagatatcctacaagatacttatacaattctgagattatttgagatttttcatattcatttgaaatcttaaacttatcatcaagaatttggtattcttcaataatgatgttcttaagctccttttcgtttaatctctttccaacgtagttagtaagaatagcattttgcaataagactctcatatagaatattacaagaaatctttctctgaaaatagttttaccttgcacaacactttcaagagcaaatctatatggacacatactatatttgattttatcaatgccttcattatcctttggataatgctctcctgtcggatcactatacttcaaatgcggcatatagctatcaaaagtatcgctatgatattttctaactttaattcctagcatctttattaggtgatataattcgttatttttacaatcaacagtcttgacataactaagtttacaaccgatgcggttaaattctaatccgtaaagcaaagcataacgtttgaaattcttaaattccattttagacttaaggaatatttgatagttttgttctaatggctcataagaatattcaaaaaagttaatatcgagaggccaaggaagccgttcgtccttagctgcacatatatcgctgtcactaagacaacaaaaatgataacaagttttctctgctttttgtttgctacttctaagaatatcaccatctatctgctcaaaatctcttacaatccagtttgccccgtgcattagattatcatcttgactaagataaaacgacattgtttgtttcagacatgtaaatgtgcctgtatcaggcagatctattttattcatacgatcaagaagtttgccaataacctctttcatctccttatcaagagactccagatcttgcgttcgtttaacaataaaatcatgaatacgcctgtagaaacggttgaagttatcaccaccactactaaaatcagagaagaaactaatagctatttcatttagttcttgaagtgctatcctaagtatgtcaagcttctctttgctggtattaagatatcctatacgctggagttttttatcagacggatttacatactttccaagccttttaagagaacttataatgccaacaagtgttgtttctttttcaatatacggttctatagtattgaatgtattgagaagttccccaggaacattttctttgattattcccgattcaaaacaatccttgataagagacatatcctcaactttgacacactcattttcattgtcccacatctctacaactgcaacgaaaaagtgaccaataggataatcaaggaaatggcgttcgccaaattgttcagggaaatatgctctaagtatgtcatttaccttgccagaagccgaatacaattgttctgacatatcatatagaactggattatgagagccattatgtttatttactttacgtgcgctttcaaaaagtttagcacagtaaccagcaaactccgtagtattctcaaattcgataacctcaatattattaaggattcctggcctaacttcaagcttaccatttgaaagtgttccaatattgtcagcaagtgtgttacaaggatagctatcaatcagtagagaaactggtttaaactcaggttcatcactgtattttattccttcttcaaatagagaatagatgttagtccatgtctgatagattgattcatactgtttctgataattaaaaagcaatactacatttttgaagtgtgaaatatcctcaatggcacacagcattgcaggtgtaaactgatgtatgccgtggataacaacagtatgtctatcaagtttatcatacggaaaattcttatgtttggttttgagtgcttccagtatcttttcatctatgatttctgataagaaaggtcttttaaattcaaaggaagttttttctctgctagaaatatacttatatatttctataagatatttttgatctgcgttcagacgtgatgtatcaaagctatttgcatcaagtcccaattctttgaaaagacgtatgcatttaactagcgatttggtattgtattcaagagatcgcctggaattaccggtcacatcttcgtcaagagggagagcattaatggcattatcaacttccattatctgtttcactcgtatgttttcatcttcccagtcggagtaaagcgtgttgatcaatatacggatagttgttagataaccgccttcttttagtgacggataaatatcttcaaaaccatttaccattgtctgtgaaacacaaaaatgagcgcaatcctttatctcattccagtatgattcacgtctgatctcataaggattagagtatgtatatattttcaagcccatattcttacacctctccgctcatttcctcaagcattttgccccaattgtttcccttggcatcgatattattgaaccaaatgaaattgtcaatagctcttgtcattgcgacatagagtattcttgattcttccatcatcatttctcttatttcaatttttgattcataaaaactattagagtattgcttaccattagcaaaaatgctgtaccctatttcaccattaatgtacgacacctcaagtccatttttatggggtctgtcgatttcaacatctgtagcgggcataataactgtgccatattcaagaccttttgatttatggacagtaagacaggtaactcttatatcatcggtagtaatgtcgatctctctcgattttgcttctgttcctgtcattatgttgatgtgaagagactcattaattgaatcaagagtaagataactcttcttattcatcttggacaattcctcaaagataagttcatagtttgtacgatagtattcctgcatatactcatctgatggagcataagctctccaaggtttcgtagcttcatatatcagcctgagtgttttcagtaccggctctttttggatatcacgaacaagatctttccaggtcttgcccatagcagaataataaaacttatcaaggcaatctataaaaacatctgttttctcatcagcggttttaccgattatagaacgaatatcaaaaataatattcacattccttgagtgaataagatcaaaaagatacgtagggttatatggattgcagagtgccgatgtcagtcgacacaaatccgtactcggtgcaagtctataaagatcactattgttgtcactctctataacaacttctcttcttttagcctctttcaaaatttcattgatctgatagttgcttcttgttagaatagctatggttcgtttatttttcgaaagttcttttgttcccatttctatttcaattcgctgtcgttgttgttcaataatgttgaacagcatatcatagtattttgttgaattatttttgtcagaattgttatatgaaatcggaacaacaagtagatcttcgctaatgttattagatttgatacctcttagaacatcagtagttagatcatatttaagcagatccatcttgctcatgtaggaaaaagttttagcgaacctgtctaagagccttttgtcacttctgtaattaagatttaaagtgaacgaaagccaactctctttattgcatcccatttttttaaaagcagtcatagtcgcaccacgaaaacggtaaatgctctgtttaagatcacctacaatgaaaaaattgaatccaagttttttttgcatagcaacaaatgatgctatctgtgcatcatccgtatcctgaaattcatctataaacacatatttgaattcataaagattggtgttaaatgctttattatctatgcacttgttgagatggatcatatattcagacaatgccactgcattgttgtctataagaaactttgagtactctttttcaatctctacaactactttttcaattatcctatttaggtacggcatattatctggcgcatccccccatgaagtcatatcgagagtctttatgtcacaacctttttcataaagcttattagaaatatcaagcatcagcttacgaaaatcctcgatattaatcggaagaacattaaagaatataggattgcgtttgttttcttcttccaaataagcagtaaaaagacgatcaaatattttttgtttttcatactttccgataacagtagcgaactctgtgccaatgcccagtgttatagcagtattcgaaataatttccttagcaaagctatgaatagtagaaatacgcattttctcaatacttgttaccatttcaaggtactgcgtatcattggtaagtataaaataatttacaaaaagttgtttaagccttgacttcatattgatagctgcatcatcagtaaaagtaagcattgctatttcagctgcagggtcaaatacaccagaattagaagcatgactacaaagaaaagctactcttgaaaccatagaataagtttttcctgttccggcaccagccttgacctgaatatctcgtccaatttctgcatgttcaatatgaaattgatcaatgttaaagtttgtaacagccgcaatagtcgaaagaattttttcttgctcttctgaaagtttgccattatatgcttgaaaagaacttatagctatatcctggcttataaagaaagcttcaaaattaaataaagaaagtctattgttttcaattgtgagaatggtttctgtgttgccagatgtgcttatagcaagattgccttcttttaatattatatgatttttggtcagagcttctgataattgttttgctataacttcaagatcagaaacaccttgtgtgaatattatctgcttggttcctttaaaatatgaagttataatgtcatttatattggtaagagttagcccttcagagaataccgacagacaagagtaaggaataatattttgagaaggagcagtcacaacatatgtaggttcaaaatgatgccttgcagtatcatagttgtcaccaatcattttgtcaaaattcagctgttgcgaatcctgatagacaccaagtattttacgcgaaaagttgtagctgttttcaatgtcttctttgaaaagagtgtattccggttctgaaacgatacttaacccaattttattatagtctatttcagagaggaaagggtaacagatcatattcatgaccagtggatttataccatacttttcattcatcatgtttttgagtttaaaagcatacgatcttgcctgtttctttggagaatcttctatgcttccattagacataattatttcgtcaggagaaacgacttcactaatatggcttttgtcccaccccttaacttctattatcatgaatccaacatcttttataagtaggcagaaatcgaattctctgccttttacttctctgttatagtagcagagaatatcttctggtagattatcctttatgcactgccagacttgcttttctccctcatagttgtccggctgcttgtctttcattaaagccataataaaaccccattacatataattcttataatgtataaacttattcaaagtaatcttcattaagcttgtataccgtatacgttttaattttttcaagacctataccatacgtgatcataagatcggctaacagatcaccattgataagttttagacttttttgttgttgattttctgcataatttatcgcttcttttgtaaatgttgatgtagtgatgaatactcctttctgaacatcctgcatagcaccaacaaaagattgtagtatctgtctgccaatcgtattcttttgatcatatctcttagcttgaatatatattttactcaagcctaatctatcttcaaatattacgccgtcgataccaccatcgtgtgattttccaattacttttcccgcttgatcatttacgccatatcccatttcaagcaatagatgtacaacaaggctttcaaaaaaacttgggtggcatgcaagaatgcggtcttttatctgagctttcaagccattcttataaaaaagatatgtttgatcaatcttttcctctggtaaaagattttcttcggaatatataattttctttggattgttttcgctattcggttcgttaggatcaattgccgcatataggtcgtgctttccttttttacctgtaattttgaaatacttaacaggagaggcgcttggaaaattcaagccttcacaatgacaacgtatttccgaatttacaacatttacaggatttttagctccaaaattgtataatcctttttcaattattttttcataggcttctttggatgtaagacttccgttttcttttagaacaataacaactgcatcaataatcctcaatacgatcacatcctatatattctttgttaaaattgaaataaactggtcaatatcttttttcattgtgaacttatttagagatattctaagtatcttactggtctgatttttaagtcctaaagcgtttataacatgagatggctctccgagactgcaggcagacccggttgatattgcgacttcattactaatacgcttaacgaacctttcgttattaaagtcttctttcataattaaaatgctgatgattccttttgccctgaattcatcaggaataaaaattttgatattatcacaactctttagtttagcgataaggtaattatccagatcacatgtatgattgtagtttttctccatatcacgcatagctatttcagacgctttaccaaatcctacaatattatgcactgcaagtgtgccagcacgtattccgctctcttgctcaccaccatgaagaagtgctgttattggaggaagtccgtatttatcagatttgatatatgcacaacctattcctttaggaccgtagaatttatgtgcagacacggacatgaaatcaacatcaagatcttttacattgacaggaaatttccccactgcctgtgtaacatcagaatgaaataacacattgtgactatgcgctactttggctaaatcagctatgttattaatagtaccggtttcgttattgacataaatgaatgaagcaatggctgttctgtcagtaattgcaacttcaaacttttctgttgatataatcccatatttatcgacttcaacaaatgtagcattatagcccctgtcaactttgttgttagcagcgaacaacgacatagtagcatcgttgttggaataaatttcaccatttagatatttacatacgtttaaggtagctttatgttcggcgttagatgttataacatgatttttgccttcgcaataatatttgctgtagtcaaggactcccttaataatcatattcgtgctttcagtggatccagcagtaaagattatctcttcgctttttgcgcctaataaagctgcaaccttagaacgtgcttcctcaactgcctgcttagcgttatctgccttgcagtaatacttactagatggatttccatattcttctttaagatacggaagcatagcatccagcacttcttcatcaattggagatgtggctgcgctatccagatatatcatacagtatcaccaacccccaggacatgaagaatatacttatcaacactacctgcatgattgtacatatcaagaagcaacttacttccgcgatcaatatgagctttcacatatttaggaaagaattcatcttcaccaagaaatcttccctcaataagctcaaacatggctttaaagtactcttcattatcacctgtaatggtctgtctgtttaaatccaatccgtttgaatcggatttaaaatcttttacggatgtcttttctgcgacagaccatgcaatagcatgttttaccaatgtatatggcttaaaattggtacgtctttcaagttcctcaaatatttcctgagtctgctttgacgttttcaatctaaatatcattttatactcacctttaaaagaaataaccctcagttaccgttgttttgttttcgctctgatcgtttttaagcaaatattctttagatatgtaaggttttattatagtatagtaatccttagtaatctcttcatcagtagaaagtataacaacctgactactgatgtttgggaagaactttgatgaaatctcctcacggtgattagcatcgatacgagcataaggtgtatcgatgatgaacggaatatgctttcccgaaatctgaataattgcccaataaagagcaagaatgaaaatttgtctttctccttttgaaagtgtatttaagtcgacccttctatagagctctatctcttcattattattatcacaggagagaatagcatctttaagaccctctgcttcattaacagagaagtgtctgcaaagctttcttacgctttcactaccaataatagccaagaagtccttaacaccaacattgactataagtgatcttagctcatccatagtaaattgctgcgtttgaaacaaatcaaacttgaaattttctgagatctcaattatagaaataagattatctttacgatagatttgctgaagattctctattatctttttagacagttgtttacgtatactgatcatactgtcgctaatcaagcgctccatcatctgtgaaatacttgtactaagatccaacacatgtcttttctgggcgttgtcgcgtatcttttcgcgcaacgagttaagttcagaattaagcacctgtaactttgattcaagttctatcttttcgtttttcttttgtaaagattcaagctccaaacgttctatgtcctgtttagaacgttctatctcatctgtatattttttggcatcttcctcagacaaggcattttttaatcttttcctgatagacctaactctcttgtccattttatctttatcatttatcttttttgtaaactcttttgaatcaaatgacgtaactgcatcagcaagatttaatacctgtcccatttcagcctttgaaaaatcaaatatcatctcatcaaaggctccattagccacctcgaatttttttactatcgcttcataaagagcttcagaaataccgttgtctttttttgttttatcagcaacgatattgcttatgaattctttggaaagcatattgatgatatactcgtgaattgaagccttctcctcatacttgacctgctgttttaactgaggaatcatgtctttcataatgaaaaacggcatcaaatcttcaaaaaacgactttatttcctgcgcaatgacctctcgttctttatcatatttaagtacatttttttcaagtattttaacttcttccggtggtagtcctccagaacgaacaaactccgtttcacgctgctcaataatggtccgaagagtacccattttctgcatattatcgttaagtatggattcgcacgcagttatcgctttttcagtttcaacaatcttatcaattaagttttgatactgatcattaagatccatttcctctttgctttctattctaccattataatttctgcagaaatgctgcaatatttcaaaatcatcaatgccgcacattgttagcaaagcattttttacatacttgttatatccatcagaagcaaatatagtaccgacttcttcaccatcaaaaaggaaaaactcaaacaaatcaattggaatgatatttaaaatatagctttcgaatagtattctatcagtatattcaagaggtttgtttccttcataaacactataagattcttctattttagagtcaataatatgccaattgcgattaattgtataatattttatttctctctctttttttacctttacttctatagaaattcctgatgtaaatggttgcgtttgaaatgctttatcgtttataaatcccctgattttcttgctataaaaggtattattaccagtataaccaaaagctaaaggaccataaagcgcaattttaatagctgtgaagatagatgtttttcctgcaccgttaagaccacctatcagtattataggctgttctttttttacggtgaagtcaaatacagttttgccctcataggagctaaaattaacaagcaccagtttcgttatctgcattttctatctccttcagtatatcaaaatgaagccactgctgattcaaaagtttttcaagatccttacgcattattttcggatttgaatagtttttgttttggtggactgataataaaagattctttacaagttcactcgggacattatattcttcgcacatattttcaatactgtcaacaatatctgcctttataagtgcttctttataactatcccaagggagtttttcacctgtaagatcatagtatagatcaactaatactctgcgtgaaagatccagctcacgatcccatatttcatctattgctctaagttcatcgagagtaattagctcataattgatagctttctgtgtttcaataagtttcgtaaggataagttttcttgcttcccaggtaaatgggccataccctttatttccatgcttatccgcataaacagtgccatccctatgctttttttctcgatatttatcaacgtctcttatactcatgagccatgttctaaactctgctaacggaatcaactcgcggtgtcctgctttaataaacccattgagtgatttgtcctctttaacaacagtgcaacaccaacagccaaatcttgactgaccacaactctgtgtttgtcctgaattcgacattcctgcaaacggacattcgccgctatcagcatcagaatataaggcaacaagttcactattatctgatccccacggggttttgccactattgtgttcaagaagaactgtccatacatcttcagtagtcagttcaactatcggattatagacatatgcatttgggatagtttcatgtctgttaagcatacgtgttgtaagttcacgaccctcaatacgccgttttctagcaatactttcagctttacgtacacctagaagaactatgacttccttgtcttcctcagccatgattgcttttatcttatcagcacttggtttaatcttaagtctgtcagtacaccatctgaatgtaccattcattcttggtgtaggaaagcctttaccaataatattcgtccagaatgtattgttgaattttggagttaccatgcacgacttaatagggagcctgtcttttgcagcagcttctccgagaaggttattcattttgttaagatatatcttaatcaaaggattttcaataagtgtatcagaggatattatgtaaacattcttgtgcctatgctgtggagcaagtgacttaagcatttcatagaccagttctaccacagtagtggaatcttttcctccactatatccaataatccacggtcggtcatctgaccgataaacatatttaatctcatttaatagttcctcataggaaactatatcaaaatagctactcattatatctaatcaaccatttctacaaaattgggtacaaatatactattttattatacactatttcccgctttttgtcaatgagcgttaaaacaattaaatattttaccaaatttaacgctgattatgctaaacaagtattcttcaggctgtcttcactaagcaaaaaccaattttcggtggaaatacttacgaaaaaaaccacaatggtaatggttgaacccttatcattgtggtttttaaacttattttttcatagtaaatttacagtatattttataatttacatatatagtatgttaactgcttgcaataagatgtcctttgcttatggtaaaatcaagaaaaactctatttattagagtcgagcgatttagatttcttattatgatcccgtttgttaccgcaatttgttctcttagaatctcccaacgatataagaaaaaatgtatcacatttttcgcatcgtttataagttttatctgctttgtaacaaaacgccagcgagtaatataaagcttcaagaagagtgttgaatttgattttcaaacaatgagtgttaagcgggtcaaattgtacagtcacattttggatattgtaatttatctctgtcttgacaacatctgtcgctatctttatcaaagcatctctcatatcttcattaatattatcataattcgttttttcttcatcttggtgctttattcctttcacagaacagccttctatcagtccgacgcctagtgaatacgcctgtataaaagaagctattctgagatctttacgagttcttatgagatgtttatttttatttctgtcattattaaaaatcaatgtgttctggcagaatagccaattttggtttgtcggatcttcgatcacggtctttcctgtagaatttctgagcatttcattaaattcgtttacaactttattgccatcaatttttttattcttgaagcctgaatctgtatcatctttagtatcctcagagtttgaattatcgttaactttttttccgaatgccatattcatattatccatccattgcttaaaatcggcattttcagtatttagatcaaaaaacatatcatcgtcgctatacacttcttttaaactccaacttccatattcttcggatggaatataagcattgatcaataggcgataatagttatcttcataagatctatatgtaaagtttttcatttgtatctctattgtgggacacgttaacagcattaacgtaaggccaagaactttttcaaatgtactgccctttgaacctatgtgtttttccttttgaccatctgttaacgctgattttttcagtatggataattctgtgatcagttcggcgacagtcttaagtcgttttatgatcgaaacaacatcctcatattttacatcttcactgtcatatacaggaaaaagaaatccatatttgtttatcaatccgaataaactgtttttgtcttcttctttatattctaattctgcattcagaaatttttcaagaatactattgctagcagcatactctttggcacataccagaccatagtcatatgatgttcctttcttactaggatacacaaattgaaaatgtttctctttaggtatcatattcgatgatccatcgttgccgaattttgggtctaaaagcatcatttgtgttctgttatttgttagcagacttgaaagctcaatatagtcgtttttagacgctctacattgtggataatcaaacgctgcctcttccaaaaacttcaaatcaaaattaagtattttttcacattctttttttatcatagcatttcccttcataatattgatttttattttcagattatatatatttctgattttttactgtctttaaatttaatattagcacgattttcttacggaatattatataaaaaatacggatagtgtaaatattgaaaaaaagtcaatggttgcgcgatcctttctgctgtgatataatacagtaaatttaaatttgaaaggatcttacttatgaaaataaaaaattaccccaggggctactcagcaggtccggacggtatctactatcacggcgagcatttttcaaacgctcttatagaaataaccgattactacgaagtaaagtcattgacggcagatgacccaggtgactgctatgtagaggtcgcatttaaggtcggcgaaaaaatctacacggcggtaattccgtgcagcggtcttgaaaaagctatgcgctttatcccacgtaatgatgtcaagtttgtaaaaagcgaaagcgtatgtaacagatttttgtcggaaactattggtaagtctcttcttgatgcgaaacgccataccaaatattctctcagtccgggatataaccactttcaagtaaagggcgattcaaaagcacactacgtcttcttgcttggcaactgcattatcggcgaaacggaacgtataggcgttgatctagcaccgcagaacgaagccatcgcaaaatttaaacgcccgctgtcaacgcaaaatgctgaatttatgccgtgggtatcggattttcttgattcagataatatacccggcgtattgcttatggcggcacttacgccattcataatgccacttatagacgaatcgcaaagaagcagatttgagttcaacacttacgtttacggcgattcgggttcgggaaaatctgcgataaccaaactgcttgtagattatttcgagggcagtccaaatattataaatctgcacagcaataaaagcgagatcgacaagatattcgagtacaagcattgttgcgtggcaattgacgacctctgcggcactgattccaacagagaaagagagaataacgaacagaaactttcggaaaatctcaaacgtgttcaaactccggggcagatagtccgtgacggcaaaatgatcaaaaatgaaagtatgctttttgtgacgggtgaatatctgcttaaaagttcaagcacgctaaatcgctgtcttgtagtaaatcttaaagatccgataccgccgaaggagatcaacaagctttgccgtaataaagatcagtatcttgaaatggtgcggtgctttatcgagtgggtctgcaaaaattatgacagacttagcgaagatcttaacagcaagcttagcgatgtgaagaatcacaaaaacaaggctgagaggtactcgggctttaaccgaaactatgctataaagtcattactgttttgcatttgcgatattttttgtgagtttatcagaagcgtttcgcacgatgatatgacaatgatcacaaggcgccgttctatcgaaaactctatcgaagcacagatagatgacacattgcgtcaccttgaaaaccgcagcagcgaatatgcatcctctcgaaacatagtcgagaaagccgccgccgctattttaaattcgcaaaacgtaactaacgatattaataaatttcgtaaagcgatacgcttagatgaagatcctcgttatttagatgaaggccctcattattatgataaccagcttgagggaagctttatcatcagcggcaaggaattgagaaatattttttcgtcaaggctttctgcgaagtccataggtgaagcccttgctgacgagaacgtgcttatgctgtcaaaagacggaagcagaacataccctatcagaaagcagggcaaatcgcaaggcaaatggacgaaaaagttttatcacataaacgccgatgcgctaaaagagtatgccccttgttccgatgaaacggaagataaaaagcctgaaaagcgtgaatcgagcatattctggcaacgtgaggctttttgggacaaaaagaaaaagcaatgatttaacttatacattattttcaagataccaacaggaggtaaacaattatggatatggtcagagaaagggaactgaacgtccctatatttcaaaagcaaaacctcactatcgaggaagccgccgtttattcaaacatcggtcagcacaagctgagagaactcacggcagacgaacgctgtccgttcgttttgtgggtggggaacaaaaggcttatcaagcgcaggcagtttgacgagtatatgtcgagagcttattctatctgaactgtgagaaatgtgaaaaatgccgaccgtccggaaagccgatggtcggcagaattttgaaaggagagttttattatggtaaaaaggcgcagagacagcaaaggcattatgctgaaaaaaggtgaaagcgaacgtgcgggcggtggttatgattaccgctggacgcagaacggcgaaaggcgcgtgatatatgcacccacgctgcaggaacttcgtgagaaaaaagaggaaatctctgccgatgttctcagaggcataaggcctaacgcccgaaacctcacggtaaatgacatctataaaatgtgggtgagagataaaatggggctaaaggacaacactatgctgaattatatgtatatgtacgaaatgttcgtcaatccctatatcggcaaaagcaagatttcaggactgctgtattcggacgttaagggcttttacaatatgctttacagagaacgcgggctaaaagtttctactatcgacaacgtaaataccgtgcttcatcaagtgcttgaactcgccgtgcagaacaggcttatccccgcgaacccctctgacaatgcgataagagaactgaaacatatgcacggcaaggagatacagaagcgtcaggcgcttaccacaaaggaacaggaactttttcttgattacctccgcagcacgccgcgttatcagcattggtatcctgtatttcttacaatgctttatacaggtctgcgtgtcggcgagataacggggctgcgctggtgcgatgttgatcttgaaaacggctttatcagcgtcaaccacacacttgtttactacaagcacgatacaaacaaatgtcagttcagcatacacaagcctaagacagaagcgggaagccgcagcgtgcctattatgagcgaagtcagggaagcactcgaacaggagaaagagtatcaggatatagcggggctgagatgcaaagttaaagtcgacggcttttctgattttattttcataaaccgctttggcaatgtacataatcagaacaatctcaacagggcattgcgcaggataatccgtgactgcaacaaaagagtgcattcggaagcgcagaaaagcgaaaacgtcaccctactgcccgatttcagttgtcacaccctccgtcacacctttgcaacgcgaatgtgcgaaatgggcataaacctcaaagtgattcaagacgtactcggccattcagatttcagcaccacgatgaacgtctacaccgacgccacgagcgacttcaaaaagaaagaatttcagacccttgaaaagcttctcaaaggcggcagtgccgaataataaaaaagagatcaccgatgaaccaaaacatcagtgatctctcatatgttatcatatttttttataagtttctgaccgattggcgtaaaattggcgtaagccgtcggtcagacctgctgaaaacctcgcaaaatcaagggtttattactctagtgtcttcatcgtagggaacaacagcacatctctgatagccggtgagttagtcagcagcataacaagtctgtctatgccgtaaccaataccgcctgtaggtggcatacctatctccaaagctctcaggaagtcctcgtctgtgtggtttgcttcctcgtcaccctgcttcaatgcctcttcctgcgctgcaaatctctcacgctgatctattggatcgttcaactctgagtatgcgttgcacatctctctgcctgtgatgaaaagctcaaatctctctacataatcaggattttctggcttcttctttgtaagtggagaaatctcgatagggtgatccattatgaatgtaggctgaataagatgctcctcaacatattcctcaaagaacaggttgagtatgtcgcccctcttgtgccttgcttcgtattcaatgtgatgctcgtctgcaagtgcctttgcctcttctgttgtggctacctgtgagaaatcaacaccagaatacttcttaactgcgtcgatcattgtcattctctcaaacggcttgccaaggtcgatcattacatcaccgtatggtacgcaagtcgtgccgcatacctcctgagcaacgtgcctgaacatattctctgtgagatccatcatgccgtagtaatcagtgtatgcctgataaagctccataagagtgaactcaggattgtgtcttgcgtcaacaccctcgtttctgaatactctgcctatctcgtatactctttcaagtccgccaacaataagtcttttcagataaagctccaaagaaattctcagcttaacgtcctcgtcaagtgcgttgtagtgtgtctcaaatggtcttgcggcagctccgcctgcattagataccagcattggagtttcaacttccatgaagccctgtccgtcaagatatcttctgatagatgaaattatctgcgacctctttataaatgtgtcctttacctcaggattgcatataaggtctgtgtatctctgtctgtatctagtgtcctgatctttcagaccatgccacttctctggcagcggcagaagcgactttgaaagcagtacgaacttctgagcgtgaattgatatctcgcccatttttgttctgaatacaaagccctcaatgccaacgatatcaccgatatcgcccttcttgtaatcgtcaaattcttccttgccgatctcgttcattctcagatagacctgaaccttgtcgctcttatctctcaggtcgaaaaagcttgccttgcccataagacgtcttgacattactctgcctgcaacgcttactgttatgcggtttgcctcgagaagctccttgagcttttcctcgtcttcgcctgcctgctccttaagctcagcctcaagcttttcatattgtgctttagcctcggcacagcttgccgtaacatcatactttgttatctcaaatggattcttgcccttggctttcagctcttcaagcttgtccattcttatcttctttaagctgtttatgtcctcctgagtaagctcttcctcaggagcgtttgtgcggttttcctcgctcatttatattttcctttccgtgtgttttgtaagtggtctgttactttgaaatgtcgatgacctcgaatttcagcagaccggcaggtgtttcagcctcgaaaatgtcgcctaccttgtgcttgagtgcagccttgcctataggtgactcgtcagagatcttgccgttgtcagggtcagactcagttgaacctactatctgaagatcctcgatctcgtcaagctcgatatcctttatcttgatgatagagcctacgcctatctcgtttacagaaatatcatcgtcctcaacgacagttgcgtttgaaatgagaagttctaactcattgatctttgattcaaggatagcctgctcgttcttagcctcatcgtactcagcgttctcggaaaggtctccgaaagaacgtgcttctttaagcttctgagcaacttcacgtctttttactgtaataaggtattcaagttcctcctgcaatttagcataacctgcttttgaaacagtcttagaaatagctgccataattaaacactcctatatcaatataattttatacgggtactatcaacttaatattatacacgatttgccctcttttgtcaaggtcggaagccgtcgcaaacgggcttttttgcacctttggacagtctgcacgattttacattttgcacaaattttcacctctgacagcgtgttaggatattgaaaataataatagtatgatttataattatcttatgataaaacaagttatgaaaaaacataggaggaaattttcatgccaaaccccattttgcctgcatgggagtatatccctgacggcgagccgagagttttcggcgacagagtttatctttatggctcacatgacagagccgctcaaagcgacttttgcgactataaactgaaagtctggtctgcaccacttgacgaccttaacaactgggtctgccacggacacagcttccatacccgtgatgaccgtgaccataagtccgataccgaaggaatgaccgaccgcaagctgttcgctccggacgttatagaaaaagacggcaggtattatctctatgcctatatagtcggctcaaagggcgttgttggcgtgtccgataagcccgaaggtcctttcaagctcctttctcaatataaatatgaccctgaggacgcaggcgatgacggcatttataatgatgcaggcgtgcttgttgatgatgacggcagagtgtatatttattacggcttcacagaatctaacttcaacgagatagaccctgcggatatgtataccattaaaaagggaagttacaaaagagcggtcattgatgacagcgacaacgcaccgcaggaacagcgcttcttcgaggcaagctccccaaggaaaatcggagatacatactatcttatatattccccatgtgtaggaagcaggcttgcctatgcaacctcagataagccacaaggtccgttcaaatatcgtggatatataatagacaacggcgttgactatccgggtggaaatgaccacggctcagtgtgcaatataaatggtcagtggtatattttctatcacagaatgacaaacaataccataatgtcaagacgtgcctgcgttgagaaaatagagattctccctgacggaacgataccgacagtggaaatgacctcgcttggctttgaagacagccttgaccctttcaagccttatcctgcggatatagcctgcgtgctgaaaggcggttgttttatcaccgaaaaggatatctttacaagaagtatcgtgaacatcaccgagggtaatgttataggctataagtattttgattttggcgaggacttttcctcaaagaccatgaagatagccctgaaagtcaggggcatgggaacagtcgcaaaggtggcggtctatgctgatgactatgagaacagcgagcctgtaggctatgttgatattggcacaggcgacggagtttacacaggagtaatcaagtcactcacaggcagacattctatctattttgtgcctacagctttttcagatgagcttgccgattggatagcagattatttcaaaaacaagccgctttttgaacttgaagaatttgtatttatgaaataggaggaaatgacatggaaaagtttaggcttatcccgcttcttactgcggcggtcatgggctgtactgcactgcttgcaggctgtggaaagggaagtgacagctcttcaaaggcagaggagggcgcaaagacctctgatgacggaagcataaacaaagacctcaccgcaaccgagcttgcaagacttctgggcaacggcacaaaccttggaaacaccatggaagcctacggtcacaaaagctattctgccgacaccgaccctgaaagctttgaaactctttggggtcagcctgtcacaacggaagagatgataaaaggtatgaaagcaagcggctttgactctctccgtgtgcctgtggcatggacaaacgcaatggagtatgaaaaaggcgattacaccataaatgaagcctatctcgacagagtggaggagataataaactacgctttggataatgatatgtatgttatcataaacgaccactgggacggaagctggtggggaatgttcggttcttccgagcagagcgacgttgacaaggcgtttgaaatgtataagtccatgtggacgcagatagcgaacagatataaaaaatactctgacagacttatatttgagggtgcaaacgaagagcttggtgacagactcaatgacacagacgtttgcaaaaactcaggctcgctttcaaaagccgagtgctatgaaatggccaacaagataaatcagacctttgttgacactgtccgtgcaacaggcggaaacaacgaacagcgttttcttcttatcgcaggctacaataccgatatcacaatgacctgctcaaacaagttccaaatgccaactgataccgcaaaggataagctcctgctttctgttcattattataccccatgggattattgcggaacaaagggccgctcagattggggaacaaagacagactatgaggagcagaacagacttttcaagaacatgacaaagtattccgagcagggctatggcataataataggcgagtatgcagtgcttacaaacggcggtgacgtaaagaaaggcactgacaagtttattgacaacctccttgacaactgtgacgcctacggctttgcaccattcctttgggattgcagtgatttcttctcacgttcagaacttaaaatgcgtgatgaaactgtggcaaagatatttgatgaaagacgccgtgataaccagtcctcgatgacagtggaggaggaaagagccgctgctgtaaacaagcttgatgaaactcttgcggctgcacctgaaaagctaacagatgataccgcaccgcaggctgacgagaacacagcggtggcatggataatgtatcagagtgcagatttttccgtgtgctacagtgttggtgacgagtatgacccgggttcaaagagcgacggagttatcgcagaaaacgcagttatagacggtaagggaacttacacagtaagccttgatatgtcatcaaacaacgccaacggcattgcattctcggctctgggtatcgcaaacggtgagaagctttatccgaactatatcgcaactattgacgagataaagataaacggggaagctgttgaaaccatagcggagggctacaccacatctgacgaccagctttgcacaagagtgaaccttgtaaatcagtgggtatccgcaccgcctgaggacgcaaggatagcaggcggtgacctttcaaaggcttctccaacaatacttgactatgcaggaaagataaacactctcgaaataacattcacatacgctcctgcggcataaaataagcaatataaaaacggcagttcagcattaagctgttctgccgttttggtttgtgaaatatcagaactgcgaattagtccagtccacaataccttggatagacttattacgcttgttaatgaacgctcttatgcagtctgaagaagcatatcctccatgaagcgcttcttcagccgagcctgtttctgggtatcttgcaaagaactgctcataaagaggggaatatatgctctcaaattctgcgagcctatcaagtgccttttctttttcaaacgtaccctcagacatctttaaaagcctgtcattgaaatcgttcctgaaatcttcatttgacataagataagcaaaactcagaaccgcaggatttttcgtgtccgtgtcaagcagtccctttggcttgtagttatcctctttcatggtgttcgtccaagcgtcgccctcgccgctcactccgccgaactcaacgtcatagaacatgaaacgccatttgtcgtctgcatattcgttggaactgtctgtgttctgcaccttccacattgaccagtttttgcccggccaatcccacttgttgtttatccaaacctctgcaaggaaataatctctcacactgtcggtgtcaacaagctttgagaactcctcataatctgcctgtgcggataagtctttgtgagaagcgaagaaatctgtaagctccttgaagaaatatccctcgtctgtttctccctctggaagtttgccctcgtcaagcttgtagccgctctgataggtttctgcgtcgcctttgtagaccaccacatcgtctttgttcacaccgtagtggctttcaaaataattgtcggaatagtcctcttccagcacataaagtccccagtattcgccattcagataaacaacgcatggacgtgaagcctttgttgagccgtcaagctctgtcataagactctgccaataggtgtcattgaattttgctgtaaaagcacaattaccacctgcacgaagagtaagcgtcttaaagctgtcgatagtttcatcagatgcgtttttcagcccctcaaagacctcataattaaacttcttttcaccgtatttctttctggcgtaaagcctgaatcccttttgcaggtcggagcgtgaatagtttccttgtatccttatgccgcaatcctgtgacaaagcgttcgtcacatttccctcggctgaaatctcgttaagctcgatgtgacaatcacgttcccattccttgccacgctgtttgtagtttgcgtcaagctgccttgcagtttcgttttctatgctttctccgctggatttatagtcttcaagtgccttgttgaaaatatctcccttgacgtatatgccgatcttgctgtcgaaaaggtcagcgtagtccattgtgatgttcattaccgcaaggtcatgcccggccgcttcacagctttctttaagcccttttatatgctcctctgcgcttcctatgtaaaagctgcctgagaagctttgtgaaacgcttccgtcgcttttttcgcttgacgctcttataacagtgcatttgtccaccgcattgtcagaaggtgcttttttgttgcaccagaaatccccttcgccaaagctgaactcattgaaatttcccgatatcatttctgtcggcacggctgaaaccacattagggtcattgcttctgtcttttatctcgataggggcagtgtattcttctctcgtggcagaggtcctggggtctgtgccgtcagtggtgtagtatatcttctcaccctcgtttgcggtaagctcaaggctgaaaccgctgtcataaaagccgctttcctgtgaaaaacctatcacgctgtcattgaggtcaaaatcaggcttgtctgtttcaggctcggtggtggtattatcatagtctgaaacactgctgtccgttttgccggagctttcagccgcttttgatgaagcctgtgaaccgtccacaccctttgaacagcctgacagcataagcactgcggccataaggcataatatttttcttgcgttcatatatttcctgctttctgttttatgtaaacgttttactttgcacatatgattgtaccataacaaagtcctggaagcaatagaaacgctccattttcggcatttgcaactgtttgaagcccgtttgtttgtctattatggatataaaaagcgacataaaaaagcgtcggataaactacccgacgccgtgtgtattgtattttaaattattgtttgtttttattgtagattatcataagccctttgagcagaagctcatcgtcaatgactatgtcacgcttgcagtaaggaactattatctttgccacaccgcctgtggaaaccacagtgcatttttcgccaagctcgttttctatcctctcgataactccgtcaatgcttgcagcgttgctgtggattataccgctcttcatgcagtcgatagtattagtgcctatgacctttttaggcggtacaaggctgatgaaaggaagctgagaagccttgcccgaaagcgagtcgagggaagttctaagtcccggtattatcattccgcctacgaaattcttttccttgtctattactgatatggtagtagcagtgcccatatctatcattatgataggcacagggtagaggtttatcgccgcaactgcgtctgcaactctgtcgcttccaagctgtgcgggattgtcgagatttatcttaagtcctgtctttattccaggtcctaccaccatgatgcgctttttgataagcctctccatagcctctttcatagtgagcgtaacagaaggcacgacggacgagattatgccgcccctgaaatctgacatatctatagaatgtatctcaagaatgttcttgagcattatggcatattcaagtgccgtggactgctgatttgtagaaagtctttcaacaaaaagtatcctgtcgctttcaaaacagcccattactatgttagtgtttcctatatcgactgctaaaaccatttgtatgttatcctttcggtgaatttatgcctgcgctttgtttttgctgggtatgaaccttgccttataaagtgcagcacccactgtacctgtaacaaatgtacatacagccatttcgaccagagcgtttatgcctacaaaggtgcagatgaatactatgatattctttccgcccataagctcttttacataatcggtgttgccgaaaagcaaaacaagtgcgctcataaagaacgcagtgttcaaaaacgcagtaaaaaagcccgtaacagcatatgaaacataattgtttgttaccttgctcatgccttttgcaataaatcctacgataatgccgtcaagaagtcttggtacaaatcgctgaacgaaagccaggaccggatcgatcgcaacaagtgctgcacccattccgcttggcacgcctattccgaagcactgcaaaaaactaagcagtccgaaaactcctccaatgactgcacttcccacagggcctaccgttacagccgctatggcaataggaattacgttgagagtaattaccagcggtccgataggtatagaaccgataggagtgaacgagaagatcattgtgagagctgtcatcaatcccagtatcaccaatgattttgtgttgacctttgttttcatattaaatttcctccttgttattattcctccatcatgggaggatacaatacaataccaatatattatatcacattttttcgcatatttccatagtttaagcaaattttttatgaatttttttatcttcataagcaggaatatctctgcactcacaaatgtataatttattaacaaaagaaaacgaaataagcactgcaaaattccatatagtgcaaacaaaatcgtgatttttcatgtaattgtgatatttttttcacctgttttacacattcatatgtacatttagctgtatgcacatacttatatatgctatgtaaaagttaataattaatagaatattcatagattatgttagaatagttcattgacattttgtataattaaagtcaagcaaagagagaatttgtgtgagatttacacaaacctctttgaacacattattacattacatataggaggaattagaaatgagatttacattaccaagagacctttatcacggcaagggagcattggagaacctgaaaacactgaaaggtaagaaagctatcatcgtagtcggcggcggctcaatgaagagaaatggttttctccagaaggcagaagcttatctgaaagaggccggtatggaagttaagcttcttgagggcgtagagccagacccttctgtaacaacagttatgaacggtgcaaaggtcatgctcgaatttgagcctgattggatcgtagcaatgggcggcggctcacctatcgacgctgcaaaggctatgtggatcaagtatgagtatcctgactgcacatttgaagatatgtgtaaggtattcggtatccctgagctgagaaagaaagcacacttctgcgcaatttcttcaacatcaggcacagctactgaggtaacagcattctctatcatcacagattatgacaagggtatcaagtatcctatcgctgactttgagatcacaccagatgtagctatcgttgaccctgaccttgcagaaacaatgccacagaagctgacagctcatacaggtatggacgctctgacacacgctatcgaagcttatgtttcaacagcaaactgtgcatatacagatccacttgctatccacgctatcgaaatgatccagaaggatctcattgattcttacaacggcgatatgggcgcaagagatagaatgcacgacgctcagtgtcttgcaggtatggcattctcaaacgctctgcttggtatcgttcattcaatggctcataagactggtgctgcttttgctgattacggtgcacacattatccacggcgcagctaatgcaatgtatctgccaaaggtaatcgcattcaatgctaaggacgaaacagctaagaagagatatggcgttatcgctgattatatgcacctcggcggttcaaacgatgacgagaaggtaaagctcctcatcgagtatgtaagaggcatgaatgacaagctcaacattcctcactgcatcaagaactatggtacagacagctatccatgtgagcagggattcgttcctgagaacgtattccttgagagactccctgagatcgctaagaacgctatcgcagacgcttgcacaggttctaacccacgtcagccttcacaggaagaaatggaaaagctcctcaagtgctgctactacgatacagaagttgatttctaattctccagattatagaacagagagcgtcccgaacttgtttcggggcgttttctgcttttttgtgtatttcgcttaaaaacacttgatttttactagattttatgttataattttagtagacttgggaatttttattatataagcaggggagagtgtttattttgcaggatatggactattatttttctcattttcctgtgctggaaacagaaagactcatactcagggcgaagaccgctactgacgcagaggatatgaaaacctatatggctgacgagaacctttacaaatattggggcagaaacatgacaaggcaggaaagagagccgtcgctttttttcggacgcactcttaacaacggcaaaaaggatcatataagctgggggatagagctaaagaaaaatcataggttggcaggggaggtaaatctcttcaatattgagaatgacagacaggcaatgataggctatcgtatctcggcggcgtatcagaacatgggctttgtcaccgaggctctaaggcgtgtgatcagattttgctttgaggaaacaggcgttcaaaggcttgaagccgaggtcatgacggtgaacgtggcttcaaacagagtaatggaaaaatgcggatttacctgtgagggaacaaagcgtcaggcaaagtttgtgaacatctatacagacttcaatatctatgggcttctcagaagcgatattatgggagagcgtgcggcttctacataagacagaaaaataacggacggaagatttggtcttccgtccgttttgtgttgttctgtattagcttatcagcctatagctttgaacgcctctcttattgagcgcacaccgattattttcattgaaaacttgctagtgtcaacgcttttcagcgaatgtgcaggaacgatgcaagtttcaaagcccattcgttcgcactccgcaaggcgctgttcacagtgggaaatgctcctaagctctccgcctaagcctatctcaccaagggcgataagcttgtcgcttataaccttgtccgtcagccccgaataaagcgccaatgccaccgacaggtcagccgcagtgtcatcaagctttaatccgcctacaatgttgatgtaaacgtccagcccgccgaaaaaatagccaagccgtttttcaagcacagctattattatcgccattctgtagtagtcaaagcccgtggcagtacgtcttggggaggcaagcacgctcttgcacacaagtgcctggacttccgccataacaggccttgtgccctccattatgcaggcaacgcaagttcccgaagcgtctgtcggtctgccctccaaaaacatcatagagggattttcaacttccagcagaccgctgtcagccatttcaaacatacctatctcattcgttgagccaaaacggttttttatggctcgcagtatcctgtaggtgagatttcgctgaccctcaaaatacagcacgcagtcaacaatgtgttccatgacctttggtcctgcgatagcaccgtctttgttgacgtgacctactatgaacattggtatctcttccgactttgctgtgcgcatgaacatatttgtacattctcttacctgcgtcacagaaccctgtgcagaggatattccgcttatgttcatggtctggatagagtcgattatgactatctcaggcttttcttttactatcacagagcatatctgctcgcagtcattgtctgcaagaagatacagattttcagaatcaacatgaagcctgtttgcacgaagctttatctgccgtacagactcctctcccgatacataaagtatggtgtggtcttgtcctaaatactgacatatctgcaaaagcattgtggattttcctatgcccggttcaccgcccagaagcaccagagagcctttcacaagccctcctccaagcactctgtcaagctctttcagccccgttgcataacgtatctcgttgtagcttgcgtcaacaccgcctatgccaactatcttgtcggaaatatccctgacagtcgtgggcttagactttgcaccgcccgctctgaccgcaagctcgacctcctcaaaggtgttccattcgccgcagttagggcatttgccgttccattttgaagtttcatatccgcactgactgcacacatacgaagttttcacctttgccatatggacgttcctttctgcgtatttatctgatgatttgctgatatatataaatgctgcaccgattttgtgtaggggctggcgcccacgacagcccgtttatgttgcggtgatcgctcgtgcaaagcactgaaattacttgccctcaagccccttcaaagcctttatctcgtcacggtcgagccttataacagaatcctttattacctcaatatcgtctttcttcacaacaacaacgttgtcgtttttatccattttaactctcagcttgcctgtgagcagatttacttcctcaacaacgcctctgccgtcagccgttcttacgatagcgcccacctttggcgtgtgcttgagaagatcctcatagctgtcctgctcgtatttcagacagcacataagtcttccgcaagtgcctgagatctttgtagggttaagtgacaagccctgttccttagccattttaatagaaacaggctggaactctcccaaaaatcttgaacagcagaaaggctgtccgcagatgccaagaccaccaagcatttttgcctcgtcacgaacgcctatctgacgaagctctatcctcgttctgaataccgccgcaaggtcttttacaagctcacggaagtcaactctgctctcggcggtaaaatagaaaagaagcttgttgttgtcaaaagtacattcaacgtcgataagattcattttcagcttgtgagcggctatcttctgctcgcatatcttgaaagcgtccttttccttttgtctgtttttttcgatagttttcatatcgttaggggtggcaagccttataatgccttttacggggtttgtgaatcttgtttcgtctatttcccggtccacaagcgcaacttcaccacattcaacgccccttgcggtctcaacgataactttgtcgcccattttcacgtcatagtcttttgggtcgaagtagtatatcttgccaacgcttttaaagcgtactccgattatttttaacatctctttttcctttcaaatatatatcacggcatgaccgctgtgccagatctgtatccaaacgggtgaactgttcaccctgcaattttttgtaacacagccgtaagccgtcagctactttcctgtgacagaatatatctgtcctgccagactgtttatagtcaggcttatgttgcagtttgcgtctatcctgcctatgtagtcagaaactatatcgtaaagcctgaccgcctgatctgaggaaaggcttctgctgagcgtctttgcaccctctttcgcacagctcacagacttttcactttctcccccgagcctgaatgccgcactgtcacggagtatctcctgaaaaaggctcagcccctctctcagcaacgtttttttgccgtctgccacaaacagcgttttcaaaacgtcatattcgtttccgccgcacattgcgtcgcacagacctcttgcaagcttcacgctgtcaaaaaactgggagtgttcaagatactcgacacatctgccgatatttccacgccctgctgaaacagcttcgcttatgagcgcaggggcaacggcaggatatttctcatgcaaacactccatgctctccgcctccgtgacagaggtcatgccaagggaaagcactcgtgagattatggtaggcagaaaaatttccttgctcctcgccgtaagtattatagcggtatgctcaggcggttcttcaatgactttaagcagaatgttctgcacctgaataacagtgtttaccgacaagtcaaggtcagggattatgtatactttcattctcgcctcgttcggtgcaacgggagcttccgcaactataggtctgatagaatcgtcaacgatatagttgccgttgctgtttgcctttgccaccataacgtcagggtgagctccgtcggctatcattctgcaggtcctgcaaatgccgcaaggctcgcctgtctgacgttcgcacaagagtgccgccgctatccaccgtgcaagggtctttttaccaagccccttttctccgtgtatcattatggaatgcggctctcgtttcttttttatcatctcagatacgagcctgcgaggctcgctgtttccgtatattatcaagccctctgacccctttctgaaaattttctatcccttagactttctcgaaacgctcgatatcagtaacgaaaatagttgcgccgccgatagccacctcaacaggatatgaagccgcaccgtcaggctccatgatagttgatgacggaacgaactgctttcttttctttgaatactttttgcagacctctataacaaggtctacctgctcatcagggcagcagataagaaaggtggtgtttcctgacataagaaaaccgcctgttgaagaaagctttgtggctcttatgccggatttcagaagtcctttatttacagcgtaggtatcatcgctgtttacgatagcatagacaagtttcatgattttgcctcctgttattttgatgtaataatagcttttttagctacaccttatattatagcacatttatgcgttcaattccatagtttttcaaaatttttattacctgcggtgttatctcctcaccgctcactgccacaggcacagagggctgacagcttgtgacggtcattccgcatataagaccgcaggcgtcctctacgtttacggtgtgctgagccgaaaaagccgcctgccttatacccatgcgttttatcccttttggtatagcgggtaagtcaccgaaaagccttatcctaggctgttttatctctgaaaacgccttttcaagtttcaaaaagtcctcctcgctgttgaaaggcgacggcataagcacaacatattgtgtgtcactgtattcaggctcgatgccatattccctcagcctgtctgcaaggtcgtcacctgtgataccgcttttgtatgcggcaatggttatcttcataggctcttcgcctatggtatgccagccgaaagctgttatcctatctttgcagacttttaccctttccacagtgcgttcaaggtcacgaggaaaatcaccgttcacatagtcagcgcaaaggtcaaggctctccattataagataagaggggcttgttgagccgaacattgacattatctctttggcgcaatcatcataattcgcaggggcgtgatttgaaatatgaagcattgctccccctgtgtagcatggaagcgttttgtgagcagagtcacagcacatatcagcccccaagtccattgggtgcaggctctcagggagaaacttcagataagctccgtgagcgttgtcgcaaagaagaggtacaccgtattttctgcaaacctcgctcatgccctttatgtcactgagatcgccaagatagtcaggtgaggtcacataaacgcaatctgcctttgtccttgacagcaccttctcaacgtcctcgggagtgacacttcctgcgcatatagacgtaaactcgccctttggatatatccactccacgtcaatgtcaaggagtatgcaggcatttataaatgccttgtggacgtttcttggtgcggcaacagttatcttttttccttgcccactgcgacatactatgccaagcattgcctttatgcaaaggctcgacccctcggcagagtaaaaagtccgcctgctgccataggctttcgccattttggcttcgctctgtgcgatgatcccctcggcttcaaaaagatagtccgcaccctttatttcagtgatgtcaagagcctcaagaccatgaaatttctgccctttgtgaccaggcatatgaaacctcgctatgcctgactttgcatattctctaacgaatttattcacaggtgcgttcaatgctatctccctttcagtgcgcttttgagcatggcaggcttcatgccgcaggatatccgctttcttgcaagcccgatagtcctggatactgtggattttgaaacaccctctgcgtcggctatctcctgcattgtcatgccctttgtataatacattattatataacatttctgccgtttcgtcaaattttcccgcactatctcacgcatgagcctgttttctatggcagaggcagggtcgggactatctttctcagtgtcacgagaacttgagatatagttttgtataagctcgtatgatacctttgtgtgctgcataaaaatcctttctttatcttttttcgatgttttctgaccatttttttacccactatatattgtgggcaaatttttggacaaacacaattttcaaaattcttgtttaatttgtgggaaattaaacggactgtttgtgcattttaccattgcaatttaaagaaatatgtgttataatgtatctgcaaatttgtttgagggtgttttgttggacttataaatataaataaaggaaaaagccgatatgaacatcttttgaatgaaaagggcggtattgtgtaagctgcccgttctattttgagccgaatactgcggataaaaataaaaacacagggcagtgtgaagctttaaggagaagtgtaaaaatttatggagaaagtaaagcttaacagattgtctgagcttactgctattgcgagaaaaagagagcttaccgcagaggagaagtctgagcgtgaggctttgagaaatgagtatcgcagaagcgttatagctaacctgacaggtcagcttgaagccacgacgatcattgagccggacggctcaagaattaaggtttcggatatgaaacgcagcggggaggataaaataaagtgacaggagtttccagacagaaacagaagcttttgaccatgaaaaagctttttgagaccaagacagacgaaaagcacaccattacaggaaacaggcttatcgagatcctgggcgactacggcataaaagctgagcgtaagactatctatgacgatatcaagaccctctgcgacagcggaatggatattgagataactaaggacggtcactccaacgcttattatcttgctcaaaggctgtttcaggacgaggagctgtatgttcttgcagacgcagttgcttcaagcaggtttcttacacagaagaaatcgaaggagctgttaaagaagatacaatcacttacatctgaacacaaggcgaaggatctgcgccgaatggtctatgtgtcaaacaggacaaagacattcaatgagcagatatactatgctataaacagcatacaagagggcatattcagtggcttggagatacacttcaagtattacgaatacaccgttgaaaaacgcaaacagcttcgccacggcggcgaggtgtatacggtttcaccgtattctctggtttgggaaaacgacaactattaccttgtgtgctattgcgaaaagcatgaaaagatatgccgctacagagttgacagaatgactcaggtcactgttacagatatccccaggagggagctttccgaggaggagaagacagaggtcacaaatcgtcagactatctacggaatgtacggcggcgagcttatgacgctgcaattgcagtttgacaataagctcatagatgttgtaatggatcgttttggtgagaaaaccatatgtcacaaaaattccgacaataccttctatataaatgaggaggtgcaggtcgcaccaacattctggggctggcttttccagttcggctcacaggcaaaggtgcttggacctgaaagggcagtggaaatggcaaaggacgctatttcagatattgccgattgctacaaataaaaatttggacaaggataaaagagccgagatataaataggcgaacgtctgctgtaaaaggcaggcgttttttatttggatacactgcttcactattgattgtagcacatatgttcgatgttgtcaaggggtaatgtaaaatttccgtaagatgtgggcaaaaagttgacagcacaggggtgaatatgttataatatttacacaagcaaaggcgctttgagtagaagatacccaaagcgctatttttataataagacaataactgccatatctatatgtaggggcgaacagtgttcgcccgtgttcagaaattgccataaattctgaattgtaggggacggcgccctcgacgtcccgatcgaagtgacgaggcttgaattatccggaatttgtgtagatcaacattgtgcggatacacaaatgagatcgcagtaaatgcgatgtgtttgttgtgaaaggagtgatatacttgaccacaatgctcattttatcttctgtgatagtgctgtgctgtgtgtttttcaataaaatatcggacaagtttggacttcctgcattgctggcgttcattctccttggaatgttgttcggctctgacgggctttttaaaatagagttcgataactataaatttgccgaggagatatgctcggtgggacttgttttcataatcttctacggaggctttggcacgaaatggagcgaagccaaaaaggtggcaggcaagtcacttatactcgcttccgcaggagttttgctcacagcctttgcaactggagcattctgcaagcttgtgctgggctttgagtggctggaaagtctgcttataggcgctgttataagctccacagacgccgcttcggtgttctctgtgcttagaagcaaaaagctgaacctgcgatacggtacggcttcaatactggagcttgaaagcggaagcaacgacccttgggcttatatgctcacggttataatactttcagtaatgaaaggcggtgcgacggcaggaggctttgttgtgagcttgcttgcacaggtgttcttcggtgtgttcttcggtgcgcttatatctttgggcgcagtgtatctcataaagcgtgtgcgatttgacgcagcaggctttgacgctatctttgtcactgccatagctattctttcctatgctttgccctcggcggtgggcggaaacggctatcttagctgttacattgtgggaatagttcttggcaacacaaaaatatcaggcaaaacagcccttgtgcatttctttgacggaataacgggcttcacgcagatattgctgtttttcctccttggacttttggcattcccgtcacaaatgccgtcaataatacttcctgcggcggcgatagcattgttccttacattcgttgcaagacctgcggctgttactgttatcatgaagcctttcggtgcaaagtggaagcagatagcccttatctcatgggcaggactaagaggagcgacctccattgttttcgctatcatggcgacagttgatgacgcatatatgaaaaatgacgttttccatatcgttttctgtatcgtgcttatgtctatcggtattcagggtacgcttctgccgctgtttgctaaaaagctcgatatgatagacgatgaggagaacgtaatgaaaacgttcaatgactacagtgacgaaacggaagtgcagtttataaagctttccgttcagccggacagcaattgggcagggcgtaagataaaggatataccttttccgagaggtctgcttgtggtgatgatacttcgtgacaaagagaagataataccaacaggcaaaacccagatacttgcaggggacgttgtggtgctgagtgcggcaggcttttatgacgacagccattttgtactaagcgaaatgaaccttgataagcatcacgagtggtgcggtctgaaagtgtcagagataacaatgtcagaggacagcctgatagtaatgataaaacgtcaggggcgtatacttatcccaaacggcaggttgcggctcaaagagggagatgtgcttgtggtcacgtcaggatagagaatatgcaggcggcggaaattttctgccgccttttttactcaaaaaatcaagcacagccatgaaaagtatgctatactataagtacagtaacgttactatatatacgagggggcaggggaatgagaaaggaagaccagaacaatttctgtattttcaccacagcacttgattatatcgaacacaatctgtgcagtgagttcacgcaggaggatatagcggcagtgtgctattgctcgctttcggcacttcagaaattgtggagatacgccacgcatacaagtcttaaagagtatatctcaaaaaggcggctcaccaatgcagggatagatcttctcaatactgatatgaccgtcattgatatcgccatgaagtatcagtacaattcccacgaagtctttacaagagcgttcacaaagcagtggggcgttgcaccctcggtgttcaagaaagagtggaacaagagctgcggactttttccaaagctcaaccgtgactatttaaaaggagcatattatatgggcaacaagaaatttgacgtaactgaactttttgattatcttaacgagagaacaggcacatatgtattgtgctttgacattgtgggactgatgaggataaacgatgaaataagcagagaggcaggggacaaggtgatacttgagagcctaaaaaggataaatgccgccgcaggggaagatatgcctgttctgaggataggcggcgacgagtttgttatggtcacagggcttgacgatgttgaaaaggtgacaaagatagcgaaagctgtcatggagaaaaacggcgttgaaacggcgtacaaaggcggcacagtgccggtatccataaggtcgggagcggtgatgataagaaagccgctgaaatattcgatgctttgtcatgactttgacgaggtcataagctttgcgagaaatgacggagaggtgcattttgcaaaggcggagcagagataaaacgatatgccgagggcggacaatggtctgccctcgttttgtgtgcggacgctgtttgcccctacgttattatgaaaaccactttgccattcttatcagcttattttcagtgtcttttcataaaactatcatattgaacaggtattatatatacaaggtcagaggaacaccgagaaagatctcaggcaaaagctttgagagcttgatgaaagttccgtcaaccaattactcataatgagtttttcatataatgagttttcatatataattttccttcattcttcttttcatttcatctcgctgtgctctgaattttcagagtgcggcaaaagtgaaatggcatggaaaaatacataacttacgcattccccattcataattttttcttcatattatacttcttacttctctgaaagaccctgtggcttttgccgcggggtcttttggatttgtagaatttatatcaaaacaaacgttcttatctgtgcatatcgacaaaaaaacttgctgtccaaaaaattacccctcaaattcatgaagttgtgttatcatacatacagccccgaaatagaaaaagaaaaatatgaggatgtgtgtaaaaatgatatggataatcatgatgaatgtttttatcgttgcggcaggtgcaggcggcgacaggtggcttatgaaaactataatgagaatggtgctgtttttcctgtttgttgcggtggcagagaggaacatgggagcagtgtttgccgcaggcatcgtgttcacagcggcatgggcggcactgtcgctttttgaagcggaaaccaaaaagaaacgccatgcgaataaggtcagacagtgccgtgtcagagaaaatataaaccgtacaatacaaattgagcaataattaacaaaaaaatcacttattttatgggcatatgtgttataattaataatgattatagtaatttagcctgagaggtgatatagcttttgaaaaattctgctgattttgaactgtatgataaaataaaaaaatatagaagatctattttgaaaacaagcgtgctagtgctgttcgttgcttgtctgcttgtgtatgcgtgtgcctgctattacagcggtgtgaatgcatttcagaaagaggctcagctttgctctgccataaatgcggaagcagaccagaatgtggctgcctttatgaagaaaatggaggacactgccaagcttgtaatgggcaatgaggactatgcgaaatatgatcctactgatacatcaaagagtgaatttgctgtgcttaatgaggagaatgttctcactgagaggcttatagagcttagtacattgggcaactatactgattttggcattgtaagcagtaatgaacataatgtaggaaagataaccgacggtacaaaggatatctttgacgatgagatatacaagagagtttccgaccttatgggtgacagcaagataaaatggttcacgggacaggacgataactacagacgagtgtatttcgcaggcaggataaatgacgatcttatttttatctcctctgtgttttcaacggagtttgatcttgtttttctgccctctgacaattacagcgagataaataccatgctgtgtgatgacgatggcaggataatctatgctaacgacggaaaaagtgttgtcggcgaaaagctcgatgaaaagctctctaaattccttgatggaggcactggcgtcaccgtttcggatatgactactatctgtgctattgatgattgcagtgacgattgggtggtcattactaccgtagatatgtcagacactttgcgtcactatgtgaaaacagggcttaaatgccttggtatctttatttgctgcgcagtcatatttattatgatatctgcggcagcggcggcggataacgactcgcagaacggaccgaagtttggaaaatatccaaaggtggacgaaaatacagggctttttactgcggaatataccgaaaacagcattatggataaaatggaaacttgtatctcaggctcgactatcgcatttattatcgtgaaaataacaaatctggagcttataaggctcaactatggcgaggagatagtggcggaagctgagcgaaaggtcgccgaaatactggtggagaaccgcaaggagggcgatatctgcggaattttcagggagggcgagtttgctctgtttgcagaccacacgaactttgaccttatgagagcctatggtaatgtgagggcttatgttaaagagcttaacgataagctgaaggaatgttgccttgacgatgacaggggctacataaaatgtgcagttggtgcgtcggtctaccctgaaacaagcgatgattatgatgaactttacgaaatggcagaaaaagcctgcgagaaagcagaacacagtgaggacgcaagagcggtgatatatgataaaaaagaagaagaggtgagccgcaattgagaacacgcattgtaaggtgtgcggctttgaccgcttcagcgatctgcacagcgactgtcatgacgagctgtgcattgtttgaaagaagaatggagcataaagtaaagaccgaggtgtccttctcgtggtggggcaaggacgcgcgtaacgagtatactctcgacgggcttaaagcctatcagaacagcaataaggacgttgtggtaagacctgagtatgcagactttgacggcttcaaaacacgaatggacgtggaatttttctctgacaccaccgcagatatcatgcagttaaactacagttggctctatgaatattctcccgacggcgaggacttttatgaccttaatgagctgtcggaatacataaatctttcagcatttgatgatgacagcctttcatatggcactataaacggcaagcttaacgccttgcctaccggtacgaactgtataaccttctactataataagaccatgtatgacagttatggtctgagcctgcctgaaaattggtctgaccttataaatgcggcagaggtcatgaagtcagacgaggtgtatcctgttgaaatgacgaaaaaggcggcttatctcagctctgtggcgtatgtggagcaggtaacgggaagaaaaatgttatctgacagcggtgagtttcagtatacctcggaggacgtaaggctcatgctcgccttttatcaggaaatgctaaataaaaaggtcacaaagcctgcgtgggatttcgataggaacgatcttgaaaaatgcctgacggcaggcgtggcttcctggatatcagacgcagagtattactgcgagcctgctcagaagtttggctttgacatcgttataggcgactatccaaagcataagcgggccgtgagcagcggttggtataaaaagcccactagcgtttatgccataaagaaaaataccaagtcccctgaggaagccgcaaagcttcttgactatcttgtgaacggtgaggaaatggctctcctgcagggcatgggaaagggcgtgcctgcatcaaaggcggcattggaagcccttgaagcgagggatatgcttgacgggatagagtataaagccaacgagaaaatggcaagctcagatgagcttgaaataatgtccccgaagcttgaagatcagggggtacttgacctttttataagcacctccgagtcgctctattatggcagggcggagatagaaaacgcttctgaaaatctgtataataagatgaaggaattatacaaatagttaaatatgcgaaacaaatagtgcaaattgtattcaaaaatgaatgagaagtgtacagagtacacaaaaataacgaaactgttaaataagtcttgacaatttatttgttttaagatataattaaggacgatgtaaggtgatacatcataaaacggtgtgtgacaaagtgtgtgacataatttcttgtgaaaatgtcaacatagtgttaccaatcgtcaaaatgaccgattgaaaattagtttttcgtcaagttgaacaaagttgagaaaaaaaccgaaaaactattgacattttggacaagatgatgtatactttaatcatggtgataaggagaacgcaaagaactctggaagccacttaattattgaaaagtagctgcttaaatcggcttgcagctcttttataaacaaatttatttaatttattatggagggattttctatgaagaaatctaacagaaaaggtttcacccttgtagagctcgtagttgttatcgctatcatcggtatccttgcagctatcctcgttcctacaatgatgaactatgtaaagaagtcaaagctcaagtcagctaactcaaacgctaaactcgttttcacaacagttaacaaccaggctgctgacctcgttgttgagggaaccgttgtaaatgattctaattctgttacaactgctgctgttattagcggttggagcagtgagtctgatgcgcttaagaaggctgtatatgatgctcttaaggacaatggtgatggagcaggtgcttgtgcatatagcattgatacttctggaaatgttgaatgggcacagtgggcaaatactgtaagtggtgctgctccaactggcgctgtaatggttggtcagtatccagatcctgaaacagatcctgatgctactcatgctatgggtacaaagttctaattagttgttgattttagttcatgtaaaagaaccgctcaaatgagcggttctttttttgtctgaaaatatataaaatagccaataggaatagattgcctttgtgcaaatggtaaaattgagtaataaagcttgccttttccttgacaaaatcgggtaaattttgtataatatacttgtcgaaatattaaatggggatcaatattttgatgaaagaattgagggaaagacatgaataaaaaaggctttactttggtggagcttgtggtggattgctcggcagtgcatgacgaatccaaaaagcttgaaaaagcagtccatgacgcacttagcgtcaatggcgacgatgcaggctatgccttttggatagcaggggaggacggcagatacaagcttgcacagtggtgtgatacaagttcgccaaggtctaaaggcattgtagggcagtatcgtgaccctgcgaacaaacctgacgatctccctgagaatttcagttggggcgtgaagttttagcacacttgacaatttgccgtgatttacattataaaagacctgttcaataagatcggcactcttgaagaattgaccgcaaaaaagctatactaaaaccaaccgccaaggactcacatcgccctcggcggtatttttctacccaaaataaaccccataatacctgcaagcctttatcataaaatcctcgctcacatcaaaatgctgcgcaagcagataaatactgtccagatttttctttatggctttgataagttcgcttttcggtatcagattttctatcgcccacttgtctgcacggtattcatgctgtgagatgttgtcagccgtggcgtatctgttgtaaaacgcaccctttacgcagtgacctatctcgtgagcagtgcgctccttcaaaagccttgcaggcgtctggctgtctatgccgatcgcacagccacctgcgccaaaaagcgatatcgccccgcactttggacaatcaataaaatctatagttatgttctctctactgcaaatatcatacaattcctgtatgttcgtcatctctcacttttcaccagcctttctgcgctttgcttcctctctgagcatgaccatttctgcatattgcttgacctcgtcaaacatttcgtccgtcactccaagcgtgccgttgaataatgcatatttcagcttcgtgtcaaaatcttcttccctgccagatataagatattgtacgctcactccaaatctgttcgctatctttgtagaattctctgcggaaagtcgttccgtcctgcctttgctcagctcagataaacagctcctcgttatagacagctccttgcacatctgcgataccgtcatatggttctcctcgcatagctcttttatccttttgtacatttcagtcatattttcttcctccaattgtgaccatttcacaaaagatacagaagtctgtatcaaatttgctgatagctattgacttttgcagaaacctgtagtatactgtatgtatcgttagtacagatatctgtataaaatctggctttgatataattataatacattttcctgtaaaagtcaagaggataaaccgccccctttttgacatctccgccccgagagatatacagaaaacggttatctgaaatgtcattgctttattttatttacagtatatcatactaactgtccaaatgtctgtacaaaaaggcgaaaggagaaaaatgtacgataatatagattattccgtagaggtaaatttcataaaaaggcttgcaccctcagcgagccgatataatttcagaagcggtggaagcagagttaatacagccgcactgcgaaagctttcacagtatcgcaaactaaggtggcaggagaggaagcttaaagacgatatctgcgaaatgtcctcacagcttgccgcagtgggggagcattgcggcagggtagcccacagaggtaaaaaacttactgacttgtggcttgaccttgcaaaggtgcagcttcgcttgagagaatgtgaggagcttgcggcaaaaatgccaaaacgctatcgtggcgtggtgaaaagccgctattttgacggctcaaagaagcacccacctgagtggggaagctccgccgcagagttcggctttccctttggaggagaagaactgcgcaggcgagtgacaaagtgccttaatgaaatatgcaattaataaaacaccttacacaaggtaaggtttaaatgcccgccacggcgaacatatagctttcccagcatatcatgcctatgggcggaaataaaaaaaatccgctaccataaatgatagcggatttggtgcaggtgcaagcaccaacaaagtaaaaataacaactcaactacacctagcggcgtaatagtaagatttaaaagaaagttgagcgtaaaatgcccgccacggcgagtggctggtgcgcctgacaggaatcgaacctgcgacctcaagagtcggagtcttgcgctctatccaactgagctacagacgcatataaggagcggaaatccgctccttgtttttttataaatgttttatctaagcttagctccgcatggcaagtcctgatccgggaaaataacgcttgccgcaccgtcaggtgtgtcagccgcacatatcatgccgtttgactcaactccgcaaagcttcacaggcttcagattggctacaataactaccttcttgccaataagatcttcaggcttgtaccatgccgcaatgcccgatactacctgcctgccgccaaaaccatcgtcaagctgtaagcaaagaagcttcttggatttctttaccttctcgcagtccttaacaagagcaactctcagatctacctttgcaaaatcatctatggttatctcgtcagctataggcgcaggctcaaatccatcgtcagccttttcctcaggctctgcattgctgcctattatcttgttaagctcctctatctccttgtcaacgtcaattcttgggaagatgatctcacccctgtgaactgtaacgtcagcaggaagtacaccaaacttgccagcgttctcgtatgtgatgtcgctctcagccgcacctatctgctcccatacctttggcattgttgtaggcataaagttgctgagaagcgttgatactatcctgatagtttcaagcagattgtaaagaactgtcgcaagtcttgcctttttgctctcgtccttgccaagtacccatggagctgtctcgtcaatgtacttgttagccctggatactaccttgaatatctcagccaaagcattgtttatctgagtcttgtccatgaactcgtcgacttttgctctaagctcctcagcctcagcaataagctcagcgtcaaaatcgccagcctctctgtcagcaggaagcgtgccgccaaaatatttgtcagccatagctacagttcttgaaacaagattgccaagaccatttgcaaggtcagagtttattctgtttatcattatctcgtttgagaatgagctgtctgcacctaaagccatttcacgaagaatgtggtatctgatagcgtcagcaccatatctctcaccaagaataaacgggtcaacaacgttgcccaaagacttggacatcttctgtccgttgaatgttatccagccgtgtacagcaagatgcttaggcagtggaagatcaagtgccataagcattgcaggccaaacgatagcgtggaatctcatgatatcctttgctaccatgtgaacgtcagcaggccagaacttgtcaaaatcattgtactgctcgttccagaaaccaagtgcagaaatatagttagaaagtgcgtctatccaaacgtaaacaacgtgcttgtcatcaaatgtaacaggaataccccacttgaaagtagttctcgatacacaaagatcctcaagaccgggcttgataaagttgtttacaagttcagtggctcttgtctttggctggagataatctgtctcagtgagaagcttctctatcctctcagcaaatggtgacatcttgaagaagtaagcctcctccttagcctctgttacctctctgtgacactcaggacaacagccgttctcatcaagctgtgactcagtccagaagctttcgcaaggcgtgcagtatttgcccttgtattcgcccttgtaaatgtagcccttgtcataaagagccttgaagatcttctgaacagtttcaatgtgataatcgtcagtggttctgatgtatctgtcatagctgatgttcatgtagctccaaagctttttgaaagtcttgactacctcatcaacatattccttaggtgtaacacccttttcagcagccttctgttcgattttcagaccatgctcgtcagtgcctgtgaggaacatgacatcatagccctgcatacgtctgtatctggcaatagaatcgcaggcaacagtggtgtagcagtgaccgatatgaggattaccggaagggtaatatatcggggtagtgatataaaacggttttttctccatataaaggacctccgtaaaagaatttgcataagcagcatttcttatattatactactttacagtggtttcgtcaagcggtaaagcgatttaagtgaggagtgaggagtgaggaatgagcatagctaaccaaagttgtgccccctgcaccgagcgtagcgagagataaaacgcaggcacaagcccggcgttagagggcttgcagggtcaagggacagagtcccttgtgggttcttagggcaaagccctgagcggagtatgaggcagagcctcattcggcgtaagccgacaaggtgcagattaaagtgtaaaaagcacacgagagccatatatcaaacaaaccctatatcggagtacaaaatctgcaccgcccaccctcgccctgagcaaatgtaaatccgcaaagagcgtagcgattttgcggcacaacaaacttcccctaacgatctgtaggggctggcgccctcgacagcccaccccccttgacatttcgcattattgtttatctcacaatccttgataatcccacaaacatcggtaggggcgaacatcgttcgcccgtgctcagaacttgcataaattctgaatcatagaggacaccacccgatttgtgctgatttaacaaataattcatacaactttcgtataaaaatgctataataaaaaggttaaagtatatattctaagaaaaagtaactctaaggtgggaatcgtaaaatggaagaagtaagagaaaataaaatgggaacgcagcccataggtgatctgctgttcaaaatgtccctgccgatcatgatatccatgctcgtgcaggctctctataatatcgtcgacagcatatttgttgccaaaataagcgaggacgcactcactgccgtgtcactggctttccctgtgcaaaatcttatgatagccctcggtgcaggcactggtgtcggtatcaacgcactgctgtcaaaatcacttggtgaaaagaacttcaaacaagccaacagcgccgccaataacggcattttcctctgccttgtgaacttcgttatcttcgtggtttttggtgcattttttaccgagatcttctatcgctcacaaacctcaagcaaaataattatcgaatatggcgaccagtacctaaccgtcatcagcctgctaagtatcggtcttttctgtcagatgaccatggaaaaactcttgcaggcaacaggtaaaactatctattcaatgtatactcagggaataggcgcagtgataaatattatcctcgacccttgctttatctttggcgtgggcttcttccctaagtggggcgtaacaggtgcggctgtggctacctgtatcggtcagttcaccgctgcagccttcggacttttcttcaatatgaagttcaacaaagagataaccataaaccttgtgaagtatagaccgcaggcaaagataatcaagaagatctacgctgtcggcctgccgtccatcataatgcagtctatctcttctatcatgacatacggcatgaataaaatacttatcggcttctcaaacaccgccgccgcagttttcggtgtgtatttcaagcttcagagcttcgttttcatgcctgttttcggacttaataacggtcttatccctatcgttgcctataactatggtgcaagaaagaaaaagcgtatcacaggtgcaataaaatacgccatgatatattctgtgtctatcatgatagtcggcactatcataatgcagattttccctgcacagcttctgaaactctttgacgcaagcgataatatgctaagcataggcgtaacagccctgcgtataatcagcacacacttcttcttcgcaggctttgatataatcataatttcatcattgcaggctcttggcaggggactttcctctatgctcgtttcatttacaagacagcttgttgtgcttcttcctgtggcgtatcttctttcccttacaggcaagcttgacgctatctggtgggcgttcccgatagccgaaatattctcgatcatggcgtcattgttcttccttagaagagcctacaacgctgaaataaaaccaatggcagactaactaggaggtatttttatgcggcttatttttatcagacacggcgaccccgattacgttcatgatacccttacagaaaagggcaagcgtgaagcagagcttcttgcacagcgtgtaaagaattgggacgtttcaaagttctacgtttctccccttggcagagcacagctcacagcggaatattccctgaagcttcgtggcgatacagccgaaacgctccaatggctgagagaatttaacggcataatacccacctctgacggaggacatcgtatcccatgggatatgtaccccaccgagtgggcggacaaagagatatactatgaccgcaataactggttcaaatccgattatatgcaaacaggcaatgttgaagaacagcttaaatgggtgcatgagggtattgataagcttcttgccgaccatggttatatccacgagaacggtatgttccgcattgaaaagcacagcgatgaaacccttgtgttcttctgtcacttcggcgtatcaatggtgatgataggacatatccttggtatttccaccatgaatatgtggcatggcttcaatatgcagcctacatctgtgacagtcctcggctgtgaggagcgtgagggcgactatggctttttcagatgccacgtcatgggctgtacaaagcaccttgcaggcggcaatgaacctatctccaacgcaggctacttcaccgacgtttttcaggattaaataaacccgtaagggtgactttttcgctcgcatattattgcatacaaaaatatcctctatccgctctgttatttcagggcggttattttattgtgcgaaaccttagtttaagataatataacagttaaagaaaacgttttcttctaaatatgactatcattagataacaacatattcataatttgtgaaaaagcacaacaaaagcttcgtgttttcgttgattttttagcttgctttatgtaaactaaatgcttttacccccttgactttattttgaaaagggcttataatatcccatagcttaaaagagtatgggtttcatatttttatatgtgcctaagagagcatgaagattagaagaataaaaggagagtgaaagaatatgttccagcttcaatggatatggcacaatctgaaaggctaccgaaaattctatgtaacagcccttgtgctgtctatcgtatgcaacgccttgtatcttaccacaccttatttcagcaaagagcttgtggataagtttctttcaagcaaggacgcactttttaatcttgagcatgaaagaaagctgttctggctgctgcttgcaggcatggtgggctttaccctgcttagaactatctgtcagtacacctgcaacatgacctatgaattatcatctcagggcatgatatacagaataaggacacaccttttcagacgtatcgaaaatcaggatatggagttttatgaccgcaaccgaacaggcgaccttatgacaaggctcacaggcgaccttgatatggtgcgtcatgcagtggcattcgtttttaaaggtatgcttgaatcatgttcgctgtttatagcctcatcagtttatttctttatggtaagctggaaaatggcacttcttctgctggctgttacaccgttcatattcggcgtggtggtgcttcttgataaaaaggcaaagccggtctacgttgacctccgtgagaagctgtcccaaatgaataccgacgctcaggagaacatctcaggcaacagagttgtaaaagccttcgcccgtgaggactatgagatggaaaagttccaaaaagccaataaagagtattctgatgccaacaaaaaagcgtcactgctgtggcttaaattcttcccttatatggaagctttcgcaaacgccttgtcagttgtaatgctccttggcggtggatttttccttataaaaggggaaataacaatgggcgagtatgttgctatctcaggacttatctggggcatcgcaaaccctgtcagaaaccttggtatctatgtgaacgatatgcaaaggttcatggcttctgctatgaaggtcattgagatatactatgcaagacctatcatcaccgaccgtgaagacgcagttgaccagacagaaaggcttcacggagatgtcgagttcaaggacgttacctttaagtttggcaagcatatagtccttgacaacgtgaacttcaagataaaagcaggtcagacagttgccataatgggcgaaacaggctcaggcaagacctcgcttataaatctcataccaagattttacgataccaactctggagaagttcttgtggacggtgtgaatgtaagaaagcgtaagctctcacagctccgctcacaaataggtatggcaactcaggacgtcctgcttttctctgataccatagacggcaatatcgcatacggcgactctgatatgtccgaagaggacgttaagcattatgcaaagcttgcggcggcaaacgagttcgttgagaaaatgcctgatggctatgaaactatcgtgggtgagcgtggcgtaggtctttcaggcggacaaaagcaaagactttccctcgcaagagccttagccataaagcctgccattcttatccttgacgataccacctccgccgtggatatggaaacagaaaagtatattcaggacagccttagaaacctcgacttcccatgtacaaagataataatagctcagcgtatctcctccacaaaggacgccgacgtgataataatcctcgatgacggcaagataaccgaaatgggtactcatgatgagcttatcgccaaaaagggatactattacgaggtgttcaagctgcagaacgatggcttcggaaaggaggcgttctgaatggcaagaaaccgttatgacgttgacgaagtccttgaaaccccatttgacttcgcccacctgaaacgctcctttgtgtatatcaaaaaatataagggcaaaatgataaccgcccttatgctgagcgtgttcgccgcaatatcaggacttctaggaccgctcatcacacagtatgcacttgataataccatacctcagaaaaatatgggacagctcgtcctgctaaccctcgcatttgtcggcactatagccgtgtccataacattctccactatccgttcaaggataatgacagttgttggtcaggatataatcttcgatatccgtaccgaccttttcaagcatttgcaggagcttccatttgagtattacgataaccgcccacacggcaaaattcttataagagttgtaaactatgtaaactccgtgtcggatatgctctcaaatggtatcatcaatgttatactcgagtgccttaatatgcttttcatcatgattttcatgttctttgtgaatgtgaagctgtcattggtggtgctttcgggtctgccgatatttgcagtcataatgatgatgataaagaaaagacagcgtaaagcatggcaggacgtttcaaacaaatcctcaaaccttaatgcctatttgcaggaaaacatcacaggcgcaagagtgacccagatattcacccgtgaggaagaaaacgcccagatattcgacagactttccgagaaatatcgtaaaagctggataaacgccgtgaaatattctaaccttgtttggcctgctaccgacaacgtttctactcttgtgagagccgcaatattcgtggtgggtctgctggttctgacccctgcggcagtgagccttggaactatcgttgccatgacgagctatgcttcaagcttttggcagcctatcatgaacctgtcaaacatcttcaataacttcatcaacaatatcgcctaccttgagcgtatctttgagacccttgacgagcctgccactatcgcagacaagccgaacgctcaggagatcggtgatatcacaggcgaggtaaaatttgacgacgttacattcagctatgagcagggcaaaacagttttggagcatatctcctttgacgttaagccgggcgaaagcgttgccctcgttggaccaacaggcgcaggaaaatctacagtagtttctctcctgtcaagattttatgacctggacagcggtaaaataaccatagacggcaaggatataagtcaggcgaccttgcattccctccgctcacaaatgggcataatgcttcaggacagctttattttcagcggcactatttacgataatatccgctacggcagacttgacgcaacggaagaagaaataagagaagccgcaaagatagtctgcgcagacgagttcataagcgaaatgaaagacggctatatgaccgaggtcaacgagcgtggctcaaagctttcaggcggacagaaacagcttatctcctttgcaagaacgctcctctccgacccgaaaatacttgtccttgacgaagcaacttcatcaatagacgcacgaacagaaaagctccttcagcagggacttcaaagacttcttgttggcagaacttcatttattatcgcacatagactttccactatcaaaaactgcgataagataatgtatatcgataacaaaggcattgccgagtgcggcactcatgaccagcttatcgcaaagaagggcgaatattacaagctttataccgcacagcatatggacgaataaaatagcaaaaaaacacgggcgaacactgcaccactgcaatgttcgcccatttgttatctcgctatttacaaaagtctattttatcacaatcttatccaacgtttcccccaccttgtcatggataacaaggtcgcaggagccgtccatggaagtcttgtcccgatttatcagcacaagattatccccctgaaaatatctcaccattccagccgctggataaactgtcagagaagtgcctgcaataataagcgtgtcgcactgagagatctctctcaccgcctccgtcacagttttatcatcaagcccctcctcataaagcacaacatcaggcttgattattccgccgcaggtgcatttcggaatgcctgtgctgtttaaaatatcctccgcagtgtagaattttccgcagtccatgcagtagttgcggtgaacgcttccgtgaagctccaaaacctttttgcttcctgccgtcgtgtgaagtccgtcaatattctgcgttatcaccgaagaaagtatgcctgccctctccatttccgccagcttgtaatgcgccttgttaggctttgccgtcagacaaagcattttgtcacggtaaaaatcataaaacgcctttgtgtgccgcataaaaaacgtgtggctgagtatctgctcagggggataatcatatttctgattgtaaagtccgtccaccgaccgaaaatcaggtatgccgctctccgttgatacccctgctcctccgaaaaatactatcctgtgtgacttgtctattatctgctgaagctccatttttatcactcctatgaaaaatgcggcctataccgaagcacagaccgcattgattattcacgatattagtcgatcttaacgatccagccaaactcgtctggtatcttgccccactgaatgcctgtcattgtatcataaagcatctgtgaaacagggccgatcttgttgttgtttatctccattaccttgtcgccccacttaagatgaccaacaggtgagataacagcagcagtacctgtgccgaatacctcgtcaagcttgccgttgtcgtaagcctcagcgatctcctcgatagagatctttctctcgcttaccttgtagcccttcttcttgcatatctcgatagcagactttcttgtgataccagggagaacagagccaagaagctgtggtgtaacaacttcgccgtcaataacgaagaagatgttcattgagccaacttcctcaacatactttctctcaacaccatcaagccaaagtacctgctcgtaatcctgctcgtgagcttcttcctgacccgcaagtgagatagcgtagttagcagcagtcttagcaaagcctgtaccgcctcttacggctcttacatacttgttctcaacatagatcttaacagggttaagaccggttgaatagtaagcgcctgaaggtgaaagaataatgatgaacagatagtggtcagcaggcttaacacctacatatgggtcaacagcgatgataaatggtctgatgtaaagggaagcaccctcagtgtgaggtacccagtcctgctccattttaacaagagttttcagagcgtagagcatatcctcttcgtttattttaggaattaccattctctcagcagagttgttcattctcttgaagttctcctgcggtctgaaaagctgaacagagccgtcagcagtacgataagccttaaggccttcaaatatctcctgaccgtagtgcaggcacatagcagcaggggagagtgaaaggtcgccgtaaggcacgatcctagcgtcatgccaaccctgacctgcgtcataattcataacaaacatatggtcagtaaaaatgtgaccgaaaccaagctttgtctcgtcagccggtttttcctttggagtagtggtacgttcgatcttgatatctaacatacagatccttctttcttaaattaatgatcggctcggcaagcgaacctctaccacatatattataatacttattgtgatctttttcaagaggttttgcaaaaaaaattccttgtcgcaggaaaaatatgcaggataacattttgaaaactgcatttttatacaactgtatgaaaactgttgagaaatcgtcataaaattgtctttatattgtaggaaatactccttgaaaaaaaggtgatagtgttgtataatagggtaaaataaatgtgaaacgattatattataataaggttatataaggaaaggtaatgttatgaacgatagagaaagaaaggataatgagcttggtatagatcttgatatgaaaggtcttaccctcgacagcgatgaagccgcaaaaccgcaggcgcagaaccgccctgtgagccatgaggatatggcaagaatgatcgctaaaaatatggcaatgcaggacggcggctttgacgagcctatcactcccgtaagaggagtttcagactttggcgaggaaactatcaagcctaaaaagcccaaaacaactgaaacaaacagtaaaaatgcaaagcctgcatcaaagcagacttcaaagagcggctcaaagaagggaaaaaagaagaaaaagaagtcctcgtcaggcaagactgttgcaatagcaatatgctcagttgttggcgttatgatagtcgccgcaggtggcttctatctgtggggcatgaattcgtataaggatagatttcttggaaatacatatataaacggcatcgaggtcagcggaaagaccaaggcggaagcctataagctcgtaagcgagcaggctgttatcccaaaagccatcaccgttacaaagaaagacggcacaacattttccataaagctgtctgaaataggctataacgataatactcaaaaccttatcacacagtattatactcagcaaaaccactattcatggttctcttctgccatgaagcgtacggatttcagctttgattctaagttcaagtacgataaggctaagcttgaaaaggtgctgaaaagaaaggtgcttgactcccaaagcacaaaagatcctgaggacgcctatatcaaaaaaggcgacgacaacagctatgttgtggtaaaagaaaccacgggcgacgctgtggaggaggataagatagacgagctttattcctatgtggaaaatcagattgacgacggtagctttgacgttgatatctcaaaggcagattgctataaaaagcctgccataacagcggatatgcttgaagagccctgcaagaagctcaataaccttaacgatatcgaaataacattcgattttatctacaccaccgaaactctcacgggtgatactatcatggattggataacctttgacgaggataacgccgaagccggctatacagttgatgaagataaggcaatggcatatgttgaagaccttgcagataagtatgatacctttggcaaggacagagagttcaagaccacaaagcgtggaactataactatctccgagggtcagggctgttacggctggtggatagaccagcaaaagacctgcgaccttatcgtagaccttgttgaaaagggcgagtctgctgaaactgagcctgtctactatgtaaaccctgactcagcctatgagtatacctgcaataaggattggcgtacagccgataaggattacggcaacacttatatcgaggtagaccttaccgcacagcatttgtggtattataaggacggcaagctcacaatggagtctgatatagtttcaggctatccaagcaagtcaagaaatacccctggcggtgtttataagctttggtataaggaaaagggcaagaccctcagaggatcagccgacggacagtcttacgcttcctatgttgactattggaacaacgtttccactatcggcataggacttcacgacgcatcatggcagaacggcaactttggcggtgagcgttataagtcaagcacatggggctcacacggctgtataaatatgcctttagataaagcaaaatacgtttatgaaaaaatagatatgggtactcctgtatttatgtattggtaagagataatagcaaggcaatacggacaactcgtattgcctttgcttttagtttcagttaggagaatttatgtacattacagatgaagacaacccacgcctgccatttctgcgtgataaaacttcaaagctcaccacctcgccgggctgttatataatgaaagacaaaatgaagaaaataatatatatcggcaaggcgaaaaatctccgcaaccgtgtgacatcttatttcagaaagtgtcaggatcacctgccaaaggtgtggaaaatggtgtcccacgtctatgactatgactttatcgtcaccgactctgagttcgaggcacttgtcttggagtgttctcttataaagcagtataccccgaaatataatatcctgctgaaagacgataagggctatagctatatcagggtcacaaatgaggactacccacgtttgcaagccgtattgcaaaaatacgatgacggagcagagtatataggaccttatacaagttcattcgcagtaaaacaagccgttatcgaagccaataaagtctttatgctccctacctgcacccgaaaatttccgcaggatttcagaaaacagcgtccctgccttaatatgcacatcaagcagtgtatgggcgtttgcacaggaaaattctccaaagaggagtataattctatagtccgtcaggcggtggactatatccgaaacggctcgtcagattcagttgaaagactcaccgaggaaatgaacaaagccgctgaggagcttgactttgagcttgccgcaaagcttcgtgaccgtatccaagccatacaaaaagccgctgaaagtcagaagataatcaatgacgatattcgtgacactgatataatcgccattgctcaaaatggcgaaatggcttgtgccagcgttataatgtatcgtgggggcagactttttgataaggcttcctatttccttggcgaaaaagacgacagcataaaaatgcgtgaagattttctcatgcagtattattcctccaaagacagtataccgaaagatatcctccttgacgaggatatcacaaacggcgagataatagagaaatttctccgccagaagtatgaccatgccgtgaatatctctactccgaaaagaggacagtttctacgccttaccacccttgccaaaagcaatgccaccgagtatctctccataaaagtcggcagaacgagccgtgagataaccgcccttgaggagcttgccaaagcattgggacttcccaagaccccgaaatatatcgagtgctacgatatatcaaacctcgcctctacaaatatggtggcaggcatggtggtctttgaaaacggcagaccatgtaagaagtattataaaaagttttctatcaaaacagttgcagagcaaaatgactatgcctgtatgcaggaggtcatagaacgtcgctttagaaactactttgagaaaacagacgagggcttttccattatgcccgaccttatcttgctcgacggtggaaacggccacgtcaatgccgttgagcctgtcttagagcgaatgggtgtcacctgcccattgttcggacttgtgaaagactccaagcaccgcacaagagcagtcgccacaggtggcggagaaataagccttgcaaagtgcagagcggcgttcaatcttgttaccgccattcaggacgaagtgcatagagtagccataacctatcaggcgcagaaacataaaaagaatgcccaccgacttgagataaccaaagtcaaaggcataggcgataaaaaagccgctaagctaataaccgagtataagaccaaagaggctctcaaaaaagccacagtagaggagcttgcaaagaccgcaggtgtaaatatagacaccgcaagagagcttaaagaaataatagacgaaatgtagggataacattgatagaaaataccaaagacatagacgaacttgaatttataaacagcttttcccattcaggcaagcccgttaaagacctatccagaataaaagacttgctttccgaccttggcgacccgcaggacagccttaaattcgttcatatcgcaggcacgaacggcaaaggttcaatggcgcagatgttcagcgaggtctttcagtgcgcagggctgaaaacaggtcttttcacctcgccttatataataagctataccgacaggataaaaataaacggcattgatatcccaaagcctgcccttgcgaaaatggcaaagcgtgtgaaagccgtcaccgatatgcactgcgaccgtgagaatttctctcagtttgaaataaccaccgccatagctttcctctattttgctgaggaaaactgcgatatagtcgttcttgaaacaggtcttgggggacttttagacagcaccaacgttataaaaactcctgtcctaacagttataggctcagttgatttcgaccataccgccattctgggcgacaccttggagaaaatagcctatcagaaagcaggcattataaaaccccactgcccatgcgttttgagtgcaggcaacgacatgaaagttatccgcaccgtcagagagcaggcggtgaaaaatctttctcagctcgttatccccgacatcaatcagctcaaacttataagctgtgacgttttcggctcaaagtttgagttcaaaggacagccctatgaagtcacaatgggcggcgcacatcaggtgctgaatgccatgagcgtcataagcggcatacgccttatcaacgataccctgaaaattccccaggataaaatttttgagggcatcaaaaaagcccagctccaaggcagagtgcagatactcagccgtgagccgcttttgatactggacggcgcacacaatcccgacggcttgtcagccttggcaggcgtattggagcattgtgaaaaacgcccatgctacgccgttatgggaatgtgcagggataaaaacatcaccgaggcagtaaagaaactcataccgtatgtagacaaattctacacagttgacggtttcagcgacagagccgaaactgcctctgaccttgccgacatcataaccaacgcaggcggcagggcagagcaaagtccaaagcctgcccttgaaatggcacgtcagctaataagcgagaatcctcacggagtgaatcttatatgcggttcgcttttcctatgtgcccaggtgcttaatgaaatgaaagatatataacagaaagggcgacccacccaaggtcgcccaattttttttacctttattccctaatagtcgccccgaccgctttcttccaaccacttatcagatcactgcgtttactctcgctcatagacggaataaactccctgaacttatccgaaacgccaacaagctcttccatactgccccaaagcccacagccaagccctgcaagatatgccgcacctgttgcggtggattccacgttataaggccttatgaccgaatgacccaatatatcagcctgaaattccataaggaaatcgttgctcgccgcaccaccgtcagcttttatgcttccgatagccccagcgtcctcctccatcgccctgagaacgtcataggtctgatagcacatagcttccaatgttgccctgactatgtggcatctgtttgttcctcttgtaagccctgttatcatgcccctggcttcgggcttccagtatggtgcgccaagtcccacgaatgcaggcacaaagtaaactccccctgcgtcctcaacgcttcttgcaagctcctcggtttctgccgctgtgcgtattatgcaaagctcgtcacgaagccattttaccgccgcacccgatataaataccgacccctccagagcataattcacctttccgcctatgccccaggcaatagtcgtgagcagcccatgacggctttccacaggcttttcacctgtgttcataagcagaaaaccgcctgtgccgtaggtgtttttcacatcgccctcacggaaacagcattgcccaaaaagtgccgcctgctgatctcctgcacaacctgcgatctttatcctgcttccgaaaatgttctcctcagtttcccccaagtcacccgaacattctttgacctcagggagcatacagctgggtatgcccaaaagtcccagtatctctctgtcccattcaagggtgtgaatgttgaaaagcatagtcctggaagcattggagtagtccgtaacgtgtacccttccccctgtcagattccatatgagccagcaatccacagtgccgaaaagtatctcccccttttctgcacgctcccttacgccctcaacattttcaagtatccactttatctttgtggcggagaaataagggtcgataagaagtcccgtcttgtccttgaaaaacttttgcaagccctgactttccattcgtgcgcagtcctcagaagtccttctgcattgccaaacgatagcgttataaacaggcttgccggtgttcttgtcccaaagtatcgtcgtttcacgctggttggcgatgccgatagccgccacgtcctccgctgttatcccagcctttgcaatgacctcacgagcagaactgagctgactttccagtatgtccatagggtcatgctccacccagccgttgccggggaatatctgcggatattctttctgtacgctcgcaaccttttcaccctttgcgttaaaaagcaccgctctggaggaagtcgttccctgatctaaagagagtatgtattctttcataaaatttctccttattgcaaaaaaggggcggaattcccaccccttataaatctgttatctaaatttctaacactgtttattttcctacaaaatttcgcatcacattataatgtaggggacggcgccctcgacgtcccgcttcctcgcccgattaattgccgaataaacttgtgttactcgcaaaatgctgacgttttcataaaccatgtagggaaacggtgcaatttctgctttgcagaaatgtgacgtcccgcttgcccgacgttttgtttacttattctttttcgttacaccacgttgcggatagtctgccatactttatatcgtcatcaaataagccccgtgtaaagcagtataagataaatgatcaacaaaagcgacagaacgccaagaagcttccaaataccctttatggcggacttttcctgctttttagctttaacaaattcctctatagcgtccggagtgtattctttgtgcatctggcttcctactgttggattgagcatatcattgatgttgatgttgcggtatttttcctcacgaagcttcttaggatcggtctccttggtgctgatgttatcatatgaagaattgagcaggctcttgtccattttcttcatgttgatagcgtccatagaaagctctgcttcctcaggtctgccaaggctgtcaccattgtcgtaaatatgctttgtgtcaacgctcttcataagctgattgtttgagcggttcgccctcagcatcttgataagagtgtcagtgtagaggttttcctcttcctcagcctcgtcagtaaggattatgtccgaggtgtcgtttatcgcctcgtcaactgtatcaataagggaagtaagtcccttgttcgccttcttgtatggctttttagccgcaggcttcggagcttccgccgcaggctgtggagcaggctggctgtacacaggtgctgaaactgtctgctgagcaggctgtgctgtctgaacaggcgttggcgcaggcgcaggctgtgaaactggcggaacatgagcagaaacaggctggcttgcaggtgcagagcctgaaatgccctcgtgtcccggaataaagatctttctctttcttataggtgcgtttatctcgccgggaatacctctctgagccatcggctttgtgttgaatacaggagcagactggatgtcctctgcaggcgtcggtgcaggtgcaggagctggctgtggctctggtataggctgtggctctggtgcaggctgtactgctacaggctcaggctgaacgggagctggaggcggaactaccttaagctcaggattttcctcaggctcgtcaggtataggctcgctgtcaggaccgtcctcgccaacgatagcgtcagcagaaatggagcttgcagccgcagagaaatcgttgctttcgatagcagagtcctcgtcgccctcaaagcttaccattttgcctgttgtaacatcatagtattcctcgccgtccttgacagcgatcttgagcttcggcgcaggctcgcccctcttaggcaggttagcctgtggaatgtcaatgtcagggaatacttcgtcaacgtccacctttgcgatcttaagtatctccattgcggatctgcacttcatagagcctcttaccatttccttgataggaagcagaattatatcgcagaatgtggcatagaaagacctcagcgcagacattgagccgtcaagcatatcctgcggaaaacgatggtcaaaatacttatcccattgctcagggcttgacattatcatcttgtctatgtactgacaaagtggtatccaaagctcaggctcttcaaaatctctgtcattggtgatgagccacatataacatctgaggaaacagtcatagcatgagatatctctgaggttgagcataacgtcatcaatgttcagggaagccgaaaatataggatcagagaatgcgaagcatctgtatccgttgctggcgatctttgcataagccgttttcagatccttttcagaacgggagaaaggcggcagaaaatcaaaatcataaggcgtttcataatcagccgtgtcacctttagccgccatatcaagcaactttttgtatgtgagcgtgacatcagcagtaggagtgtcaacggctatgccgagcaccctgaaaggattgcaggcgaaaagttccattgccgttatcccaagtgacggtcttgtcataaatagatcctcctccatgaatttacttcatatatacttaagcttttacccttcttattcgtgttatcttcttcacgatcgggtatttttgtgtatttttatgccaaaaatagttttctcaaactaatttgttttttgtttttaattaacaaaataaataacttaacaaatatagtatagcaaatattagtatagattacattaactaagcgtgaattttatatttatattatattaatacgaaacaaaatgcacaaaaagagtttaaaaaatcgtacaaaaagtaactgccaaaaggtttgcaattttggtgaaaatattgtataataaataagtataagatgtcaggcataaaaagccgatatcagatcatcatgccaataaaaagggggagatcttatgggtctgttcagcagaaaaagctccgagcccaaaacatcgacacagcctaaaaagcagcagataaatgctgatgatatatggaacacgcctgtgaagagagcaggcggagatacggcttttgtgaaggagtccagcagcgataaggtacacgccgagaagataaccgataccatagagccggaaactatccgcagcaagatggagcagcttgaaaaagagctggctgaaaagaaaaacgatcccgtaaagacctatgccgactacgacgtgaacccggtaggacaggctgagataaccgatgcccagagcgagtatgaaaagctttatgaggaggaacacgcaagatttgtagcttctcataaggaggatataagcgtggcgtccgttgagggtatcgactcaaagcttgaggagatatataggatacatgacgagaaagtggctcaggagaagcgtgatacaggcaatatcgaagccataagtgcagagaccacagccgcaaaggtggctgagcttccttatgcaaaaaagcctgaggactacgcagagtataaggatataaagggaatatccgtcgatgaggctcttgtggagggtcttggctctgttgaccacagcgaggacgacgacgctatcggctcagtatcggaagagtttttggcgcagaaggtgaaagaatttaacgaaaaatatggcagatgatcggggtaaaggcagtcattaggggtattgccagaataaattgaattggagagataaaattgaagatcaataccgataaccctatcataaagttttcaggcaaaggcaagccgtttcagtatgataagttgctttatgctacattaaatgagtatatacttgattataagaatgcaagacttgataagcttaccgatcaggacgcttctatatgccttgcgagaataataagaaaaatggaagtcaatgacgttcctgtccagcagtttttccatgaagagcttgaaaagtggagcgagcataccaactatgagaagatactcagactttgcgagcttatggcaaaggatatcttcggctgttttgataagaacagagatgacggcaacggcggcttctataaaacagacaggctctattgcgtaaataatgacggtgaaagagattatatcgtttgtgacgaggttgagaaaaagggacttttcaagaaagttccaactcctatcacattgtatttcaatgatcttatggagaaaaataaacgtggcgagctgccaaaatccaagtaaattttgtattaacagataataaggagagtattaacatggtaaatatagaaatggcaaacggaaagaatatcaagatcgagctttatcctgacgttgcgcctatcacagttgcaaattttgagaagcttgttaaagagggcttttatgacggactgatattccatagagttatctcaggctttatgatacagggcggcgacccaatgggaacaggcatgggcggtgcaaaagagaagataaagggcgagttccttgccaatggtgttcgtaacgacctcaagcatacaagaggcgttatctcaatggcacgttcagcaatgccaaattcagcaagctcacagttctttatcatgcatcaggacgctcctcatcttaacggtcagtatgcagcattcggcaaggtagtcgagggcatggacgttgttgacgagatcgcagcagttgacgtaaatttcaacgaaaagccgcttgtagatcaggtcatgaagaaagtaactattattgaggactaataaaaaggaaaatcatgggctgcggtctttatggcggcagcccttgtttacgtcaaaaacaatatcaggagagtaaataatggatttcaaaaaagtaacagtgggattttttgcagcggtcatggcaatgacctcagtgtgtttcgctgatcccgaaacgcctgtgacaaccgatgtgccagccacagatcctgtaccggaaacgaccactaccgctcagcctcagcgggaggacactgaaacgactacaactaccacagctcagacatgggaaaccaccacatggggaactaccacatcttattcctatgttcaggacactccgacttctacgccgacagttgtaaagcttgtggtcagcgaggtaaaggataaaaagtttacagcgaaaataaatatccagagcgaccaccttatctcaaatgcctctatctccgtgggctatgacgatagccttgtagagtttgaaaagtgtgaaaccaatgataaagcagggggcatggcagttgacaatgcctttgcaggtaagtttgtatataactatgtgaacgcagacggcacagactttgacggtgattatgcgaccctccatttcaaagtcgcagacgaaaagctcacctcaacagtgctttatctaacagtaaattcccttgatgacgaaaacctcaatgccatatcaaatcaggtagagaacggtatcgtcaagtatcaggacgctgcagatgttcagcaggacgacagcgattatatcgaaatagacgttgactattcaaagtaccctatcgcaccagaggatataggacttacagatgttgacagcgtaacagtagccaacggcgaagtgcttatattcgaggacggcaagttccagaccctcagcacaggcgaaacaaagatagatattgtttataaggacggctcagtagggcattttaaaatagtgataaaagaacctgaagccgtgaagcttgaaagctcagaagcagaagcgacctcaaaagccgcaagtcctgcgtcggaagaaaagagcggttcatcaatgggcgttattattggcgtggtctgcgttttgtgcttagctcttattgccgctgagtatcttatgatagtgaaaaacaaaacagtaggcgacaataagtcagccaacaaggataatgataaagatatccacgatacagatgaaagcgacgataccaatttgtccgagcctgacgaacctgacgaaaatgaagagcaggaagaaactgataatacagacgatacagacacagaagaataaacaaaaagcggtgcagagaattgaactctgacaccgctttgttttcttatttagctattattagacaattccttaagctctcgaccctctttaagcaggtcatgcaacctttgagcgtcattatttgcaatagcatcacgatactccgttaatcttgcgattatatgctctatctcgtccaccagtggaccacggttcataaggaaaagctccgtccacatatcttcgttgagctttgccactctcgtaaggtctttgaaagaacctgctgaaaaacctgcctgctttaaaagactagggctttttacataggaacttgatacaacgtgagcaagctgagaagtgaacgcaataacgctgtcatgctcttcaacgtttgatacaacgacctttgcaaaaccgatattatatgcaagccttgatatctcctgcacaaccctcataggagttctgtcagtaggcgtcattataaagcttgctttttcaaaaagattgtccaccgagtatgcaaagcccgaaaattcacgtcctgccatagggtgacagccgaggaagtttacgccgttttcaatgcaaacgccctctacagctctgactatctcgccctttactccacaagtgtcaagaacgataccgcctttcttgaacttgcctgcgttctcagtgatgaattttatggtagcctcagggtgaagtcccacgataacaacgtcacagcctgcaaggtcgtcaatggtcatttcaccgtcgatagcctcctgcgccagcgcccctgctatcgttcccctgtcaatatctataccgaaacagctctcatgagtgttcttttttattgccttggcaagcgaaccgcctataagtccaagtccaactatacaaatcttcattgtctgtcatgctccctttgcttttacgcttttaagcttttatgtaataaagtataccactaaaatcacactttgtcaagagccatgcacacccaattattcaccgcaaagctctgcaatagcattagcgtacatattcagatttattttgaaagtttccatggaaatatgctcgtcagctccgtgcatattgttgttttcctcagaaaattctgcaccgaacgcaacaccgccctttgtgttgtgaacgtaggttattcctccctcagcgatacattttcccttttcgcccttgaccttttcgtatacccttaacaaagtctgaacgaactcactgttttcgtccacataatgtggctccatgccgtcaagctcgtccaccttgaatcccttgctttcaagtgccgaagttatgataccgcttatctcagcgagcgtcttgtcaatagggaagcgtatgtcgataccgccatgaagcctgccaccctcagttttaaggatagtcagcgcacaggtcatctcgcctgatacatcgtctgaaaaaccaagattgcatgactttccgttgcattctccgtgtgggaaaagctcagccaacccaccaaggagagcattttcatttttgtattctgccacaaattttgtcaccgcattgtcgccgttttcaggtcttgacccgtgtgacgattttcctctgatgaccttttcactgccgtcggcaaacttcacaatgcacttgtccgggatagcatttataacgcttccgccctttatctcagctatcttatcatctgaaaattcagcagagaatgtaagatgcaccatgcccttttcgcagttgagcacaggaaaagagccgtcgggggtgaacaccatttcagggaaaggctgtttgctttcataatattccatgtcctcacagccaccctcttcattgccaccgaaaataacacggaagttcttttttataggaatgttaagctctttgatcgcctttacagcccacagcactgcaacgctcggacctttgtcgtcaattgttcctctgccgaaaagctttccgtcagctttagtcagtttgaaaggcggatagctccagccctcgcctgcaggaacagtgtcaagatgtgaaagcacagcaagcttacattccccgttttggtaaaaatcaccgtgaacagcatagccgtcaaagtcctttgttgtcatgccgagcttttcaagataagcctttccccagtcaagagccttgcgagaaccctcgccaaatggcttaacatgggcgtttatgtcgcctacgctctcgatagaaataatctcgtctaggtcacgtaggatctcctccatgtgcttgtcaaaatattctgcaaattgtttctgatacatatttattcctgcctttcaagtgtgcaaatcattatttccgagggattattaagcctgaatttaccaagccccgccgtaacagcaagctttgccaatccctgttcagcgttaagttcgtaaatcccctttgtgtatcgtgggaagaatttccgttcgggagaaagtattccgccaataaaaggcaatcttataactcccccgtgacagtgacccgaaaacgtcacatctgctccccagtccgcataagcacggaacgccaatggcgtgtgcgaaagcaaaaagttacactcgctcctgtcaggctcgcctaaaagctttgtaagctcgtcctttgtaatctgcggcaggtcgtgatgtgaaaaatcttcgttgcggtaaaatctttggggaagctgagtgccgtatatattgatgtgatcctcgcctatttttatctgctccatgttgtttctcagaatgtgtactccacattcggtgagtttcaaagcaagggcttcggcattgtccatgttgtcagtttcatggttaccgaaaatataataggtcggtgcaatatgttttagccttttcataagggcaagcttcggtatcatgtccgtttcatcacggctgtaaagatcacctgcaaagagaataaagtcaggctcggcggcaatacaggaatttaccagattgttgaaattgtccccgtaacgcttcttgtgaagatctgcaagaagaagtatctttttaccaacaaaattctcaggaagctttgataccttcagttcgtatttgttcacccttagctgtctgtttgaaataagcatataaccgcccagaaatgcggcggcagcaaaaagcggcagcttgtatgacattttattacctcattcctacttgcaaagatattttttcagatcgtccattgcccattttgcgtggttgtagccgtaatcgtagagccttctcagctttacagggtcgccctcagtcctgcctactccgaaggtggtctttggtgtgaaaacaaagactttcccctccgctttaagctccataagctctgcgatacatttgttgtatctctcggctcttgtggcaagggcttcggcaaactcagggtgcttgtgataatatttcatggcaagttttgtggcaggctcctgtgtcttaacatagccttttggtcgggtcagcacaacgatattcttgtcacagcctgcttttattgcctgcatatatggtattgaatctgatataccgccgtccatatatttttctccgtttatctctatctcagggaaaagcagaggaagcgcacaggttgctctaagcaaattccagtgggtgtcatcttttggcacgtccatgtactcagccttgccgttttttacgtttgtaacaactgcacaaaatctgcccttgaagtttctgtaggcttcataatcaaagggaagctcaacattaggcacaacattgtaggcataatcaaggttatagtagcatcggtttttcgggtcgataagatgtcttgcacccatgtatttctttgttcccataaactcagtggcaagacggagatttcttcctatttgccctgagcagtaggaaacgccgaatgctgctcctgccgaaacgcctataacataatcggctattattttatcctccagcagagcgtccattattccgcaggaatagaccgttctgctggctccaccctctaaagtaagtccaagcatgatattacctctgtttctgaaaagaggacggcttgaccgtccccaattttattttatatctgtatcctttaaaattatgcagaaaacgggcgaacgatgttcgcccccacagtttttatcttacggcttcagatgttgtatctgccatgctgttatccaaagctgaattgtcaagaactgtttctgtgaactctctgccgtcgtcggtaagagcctttttcaagtcatccatagcgttctttgttgcgttgtcgtctgttatccttacgataacattgtcgctcataagcttcactgtggaaacaagacttttaagatctaccacacgctcatcgattatataagtgcttcctgaaaccttgatgtcataaaattcctttggcactgctgttgttgtggtagtaacggaagcttcattggaggaagcacttacgtccttgccgtcccctgagccttcgccttttccaccgcctagtccaagtccaagatactgcattataagaataagcgccgcaatgataatgacgatcagcatgataccaagaagctttttcttctttttctttttctgcttttgtctttgtttttcaaggtcactgcggtagagcttttcaacatcgttctgaatactcatttttattgtcctttctatttggaagtgtttatgtatgtaaagtaaacattttcgtatttgtctgacacagcctgcacagcgttttccactattctcatgttacgataaagcacagcgtcaccgtcatagaccactgccgcaagcatgacttcaccgtctgccgcaccgagtccttcaaaaagagatatgagcctgcctgagatgtcttcatcaggggtcacggtcataatatcctcatcatttcgggaaatatacagcttgtcagtgccgttttcatttcgcatatcaagtgagataagcatacccttagtgaagccgtcaagcgcctgctgattttttgcggcattgctgttaatgttctcagcctttttataggattcatctatctgcttttgcatatcctcacggagcttttcaagctcgtcagcggacttttgcttctgctcctcaagctgttgagtgacagcctgcacctgagcttttgcgttctctttctgactatcggcagatgcggaaacatcggtcatgacccagaaaagcattatcatgataacatcgagcagggaagtcagctcaaggactatgcccttatttttcctgaaaccattcatggctgttcaccgctttgggaatgttcagcgttgtttctttcaagatagagctgaacatttttttcgttatcctctatttttgcagagattatgccgtcaagaaatttgaagattatagcaaaaacaagtccccaaaaagtggaggtcaaagcgccatagaaattatcctgaacgtttgtcatatcgcccaccataccgaggagggagataacagtgccgaggatacccaagagagggaaaatccctgtgagatttacgaacagagaataaaggcttcctgtgcggttgcgcatagaaacgatatctgtttcacgaatgcccgaaatatcgctgtcagcctgacggcgggaagcacctgagtcgggaacgaagatgttaagatgaagcttgttgtagagaacatcagccgattttttagtgaaataaaagacgagggcggtcgcgactgcaaccaagaaaattatcatgtcgaagccgaaaaagttcataaaaattacggaaaagagttttttcatggataagaccccctatagagataatgatagcacattttgaggtaaattgcaagatgtgggggcggatttttagtgaggaggggaggaatgtgaaatgaggaatgaggaatgaggagtgaggaatgaggaatgagcatagcagaccaaagtaaattgcaagcataaagtaaaataaagcaccgagcgaagcaagagataaagcgcacgctcaagcccggcgctagagggcttgtggggtctaggggcaaagcccctagcggagtatgaggcagagcctcattcggcgcaagccgacaaggtgcagatttaatgaaaaatagcatatagaagtcagatattagatgaaagtgatatcggagaataaaatctgcaccgcctttctagccctaagcgcaatgtagatacgcaaagagcggagcgattttgcggaggaataatctatcaataaaaattgtaggggctggcgccctcgacagcccgctatttcttacccattgaattatcggggaatatcacaataatgtacctcgaaaataatttggcatcaaagatacaacaatcacagcattacacctccgagtgggacgtcgggggcgccgtcccctacaaatgcgttgccataggtttcgtgttttagctgtatttatattcaattttcaagttacattcggggtgtgacattgggcattaagcccttggttgcgtatacacaaaatccacaacgcacactcacgttttgacacaagtactctacagcctgttccagaatctctcatcgtattcactaagtcgcagggcttgtacgtgcccgcaagtatcaaaacgctttctacttatacacggaaagtaccctttttgttgcataaaaaatgcaacaattgcagaaatgttgccaaattaaaatataaatcatttgtttgcacaaatttgtgccactgaatttgtgcatattggcatggtgtgaataaatctgtaaatgctgtaaaaaataaatgcagattttcaggaggtgatcttatgagaacaatgagaaatctgcttgcgaaaaaagccatggtgacggtgctggcggtgggagtttcgctggcggcggtgaatgccttttggggcggttcggacagtgcgctctctcagcttgggtctagcggcagtgaggtgagggctattcaggaacgccttaaagaacgtggtttgttcaacgattctgtgacgggatactacggcgaaaagaccaaagccgctgtgataaaatttcagaaacagcaggggataagtcagacgggaacggcaggtccgcagacgcttcgggcgctgggcatttctatcggctctgtgccgtcggctacggaacagaatatcaatcttttggcgaggataatctctgccgaggccaggggagagccttatgtgggacaggtggctgtgggtgcggtgatactcaaccgcatcgagcacccgtctttccctgacacgctttcgggggtaatttaccaaaacggcgcttttacggcggtggtggacggacagttcaacgagcctgttgccgcttcagcttacaatgctgcccgtgacgctttgaacggctgggatcctaccaacggctgtgtttactactacaatcctgctaagacttcaaacgcttatatgcacgcaaagcctacggtgacggttattggaagccataggttttgtatgtgaaacaaaagccgccctgcgcagtgcagagcggttttgtgctatttatgtacgaaaaagtaatcgctgccgtttagggatattggtatggaatagaggatatcgtcggaaaaatagctggtgatgtagcctgctatatcggcgagcttttcggtgtcggaaatgtctatggcataggcgtctacatacgaggtcttgcctgttatggctattcttacatcatttatatggaaaacgtcttttacttcttcgagtatctctctggggcttctgtagcctggggtgacttctgctttgccgccgagggttattgtgactatcgacatatcaacgttacagctttgcagaagttcttccatttccttgatgttgtgttcgtaaagcactgttacctcacatctgttgccttggtcataaatgccgcaggaggtgaaagttgggcggtaacccatttcttccaggtcgcacaaaagatttgatactttatacgggtttgttataggcgtatcgctgacgggaagttcgcctgtcggctctgggtaggcggtgtggacgtccacaaggtctatatttacgccgtatgcttggaggtaggcttttgtgcaggtgacgtcattttcggtgtttactgttacatcaaggtaggtttcatggttttcggcggatattatgccaaagtctgcggctcttgaatttagtgcggagagtattacgttaagatcgtctgtgttttcaaggtcggtgaggcgttcggtaaaggtcggtatctctatatctgccacttcatatgtgccaagctcgtcttcggtgagctgtttatcggtctgttcgtcagagtcggtctgtgaactgtcattgtggatataagttctttgctcaggaactggacctttactcacaaacaggttgacttcttgccctgcttgtatttcttcccctgcggcaggctcggtattcatgacagtttcggcggcgacagtatcgctatatctatcacgtcttacgggcgtgccgcctgcctgtgcgataagcttttcggcttcggcataggtcttgttggtaacttccggcactgtgataggctgtggggtctggggcggctgtgttgtggtatcggtggaggctgttgagggggcaggggtggtggcgtcgatatcgggctttaaaagtccgctgaatgcgaatgctcccactgctatggcggcgcaggctgctgctgcggctatgccgacggattttcttctaagctttataggctggggttttgtttctgtgtgtgcgctgtccgctgagttggtgataaaggctttattgtctattttttgcaggatagcatcaagattttcagacttgctttcgctgtgggactttttcattatatctgtcattttcattgctttgttcctccttttcacagtatgtttttttcagcttgtcaagggtgcggtatagtcttgattttacggtggactgggacaagcctaggcatgatgcggttttcttgatagtatagccgtactgataatgcagtacgaaaatgcggtaggtggtatcgtcggagcttttgagatagctcatcacctgttcatagtcgaaaaagtcggcgttttcaagggtagcaagggctttttcgtcggggatattcaggtcggtgatatcctcgaatgtggctttgggctgttgtctgtaatggtctgcaacataatgcttggctatacgcaggacgtaatgcctgacgttttttattttcccatcagtggtgataagggagcggtaaaaatcaagatacacgctttggagtgcgtcctctataagatctctggtgggaagctttgaggtaagatagcggtttatataatcgtatgtatcattataagcctgcacgaatgtatcttttagttctgttcccatggtttttcctcctttctttttttgctctgtgagctttcaccctaatagtcgggaattttgctgaaaaagtctcagctttgtgaaaagttttttgtaaagaaaaaggacggcagaagccgtcctgataaaaacgctgtgtttagtctacagaataatatttctgaagtcttgttttgaatatctcacagatgatatttgcagctactcctgctgtgaatacagatacgaaaagtatcagaaatacttttgttgctttgctcatgctatcttcctcctgtaattctgtgacgctgtttttacagcccttttccttaggtctattatactataatcttgctctgattgcaagcggtttgtgaaaaaatacggctttttataaaaatatttgcaaaaatcaaagcattgtgttataatatctctatgtgttatatttttatgtaatgaggaaattttaaatggcagaaacaggcaaacaaagcagctataaaaagctgttttcaaatactctggtgttcgctataggctcgttcagctcaaaagtccttgtgctgttgcttgtgcctatttacaccaactatcttactacggctgagctgggcgttacggacgttctcactcagatagctaactggataatacctcttgtgaccatgactatcacggaggctataatcagatttggtcttgacaaggcttatgacaaggtaaaggtctttactcttggcaatcttatatgcttctttggtctggcggtgttcggtattttgctgcctattgtgtcgctgacgggcattgctgacaagtatattggcggatacagcttgatactatatatatatgtattcacatcaagcatgaagtcgctgtattcaactttcgtgcgtgcaatggagcaggtgaagctgtttgcttttaacggcatactgaccacgttctttacgctgttttggacggctatgttttacatggtgcttcctgagggatttctcggtcatggcacgggtatcgagaagtatcttctcgccaccattctttctgaccttatatcggtggtatttctcacgttcaagtcaaagctttggagatatataaacttcaaggatatcgacagggagcttttgcaggtaatgcttcaatactctgtgcctcttatccctgctcagcttttgtggctcataacaaacagctcggattcatttatgactacccactatcttggctcggactacaacggcgtgctgtcggcggcttacaagatacctaaccttgtgtcaacggtatatcttatgttcggtcaggcttggaatatgtcggctatcactgaggacgattctgatgacagagattcgttctatgagaatgtttttgacttcaatcagagccttttgtatattcttgtggcaggctgtttgcttattgttcagcctgtgactaacttctggataggcgcagatttccgtgactgcgtaaaatactcgcctatcatcatatatgcgaccatttattcatgcttcaccacttttatggggtctatttatcttgcttcaaagcagacgaagaggtcactttttacgagccttgtttcaggtgtgataaacgtggggctgaacgttatcctcatacctaggataggactttacggtccgcctatatccacggttgcggcttacatgacggttttcatcattagagccatagactcgagaaagctagtgccgttcaggatagatatgaaaaagatgatagtgaacaacatcgttatccttgtgatgatgttcatttgcctttttgaaactgaccttatgcaccacctgcctttgtatgctatcgtgacactgcttttctttgcggtctttatactcaaccgaaaggctgtggagagcatattctacaaggtgcttcctgcaaggatagcttcacattttgtgagccttagcactgcaaagctttgcgcagttataggcggcttggctgtatttgtgctcatagacttgctcacaaggggcattattgtgtatgctttgcttttggcaggctttgtctttgcaatatacaaaaacaagaacaggcttatgtatatctttatggtgcttatgccgctgagtctagttttcaggcacggaatggtatgggcagcggtggcatttctgatactggcggtggctgttattatcaaaaaccgcaggccagcagatgttttcattggcattgcggcacttgatttactgcttggtgcggcggcaggactttggttcggcgtgcttgcggcggcggtgcagacacttgtatgcggctttatattccgcagacagatatgggataagcttattgaatgggcatataaaaagcggtagagatactgcgttttatagataaaggggctatgctcctattacaccaatggaggtttttatcatggcagaattgaaatttgagatcacagagcgtataggcgtactttctgaaaacgctaagggctggacaaaggagcttaacaaggtttcctggaacgagagagagcctaaatatgacctgagagaatggaatccagaccacagcagaatgggcaagggtatcactcttactgacgaagaagtggaaactctcaaggctattctcaacggtgaggagatagaggacgatatcaacgaggctgacattctttaaaaaattgtaaatgttcggtaaacagttaaatgataatcaattgttaatcatgagtttaaaaatgtttgctataatttccgagaagaacaattaaacggcggagttgtgcgttatttcatgcatggctgccgccggaagcttgcacataaaaggcgtttcgtatcagtacttaaaggacacggaacgctttgaacgtacagggcaagtaataatatattcggagggaattatagttatatggaacagcatggcattagcaagcttgatctcaagaggcgcaaccgtatgcaggtcctcaagatactcaagcagagaggccctacttcccgtatcgacattgcgggaactttagagcttacaagagccgctgttacgatcataacaaatgaaatgatcgagcaggggataatacaggaaataggcgaatacaagcacgttacagaaaaagctccgagaggcagaaaaaagatacttatcgacataaatcaccactacaagttcgttataggcgtaacggtagaggaggatatcgtaagcgttggtctgtcaactctggcaggtgcagttctcgataagagaaacctggctatcaacgaaaagacggactacagcactatttttgatttcactgagaagtctataaacgaggtactgggcgacaactgccttgacaagaactctattctcggcataggtttcggtatattcccgactatgtattcaagacttggtatcagtgttgaagatggcgagcctgattatgctaagctaaaggctgcaataagagagaaaactgagcttccgctggtttttgacaactctgtaaagggtacggctatggcaaatatcgacttccttaaaacaaaggatataaacagacacaacatagcctttttgcagtatggcaacactatgcactttgttgtgacgaatcttaacgatccgatcgtttcatatgataacagaactaacttcgtggataaaatgataatcaacccttattctgacaggacttgtccttgcggaagaaggggctgtgttgagagtgaactcactccatcggctactatgtcaaagcttaaggaagtattttctgctgaaaagacgccttttctctatgaggcggcaaggggaagctttgagaatgtcaatcaggatatgataacgatggcatacgagaaagacgacaaggctgtaaaagagatacttaacggcgagcttacgctgttggcggtgcttctaaacaacttgtatttttctaccaatccacagaagatagtgcttcatcagttcaaattccagaatgaaaaggcgttccagaaattaaaggacgctgtgacagagataggcggagcgcttgtttcaagcaagatcgagctttctattattgaggacaaacacagattcctgtcaggctgtgcgcttgcaataagagaattgttctttaacaggggcggatttgatacatcttctaataattaagagcatcagagcagggctttgccctgctttttcttatatgtatagtataaactgaacaacatagtgaaaaatatctaaattatcgggtagaaaatgtataaaatagagaaacgatgaaaaagctattgacaaatgtcgctgtagatgataaaatatataagtcgcttgacgagagcgatgaatgtgaataagatgatgacgatgaacgctttttgaaagagttcaaacgaattcataaagaattcacaaagaaaagtcttgacaaagcttagctaatatgatataatagataagctgatttaagacagcacattagaaaacacgaaaaagtattttttcatcaaatttattataccacaaaaaagactgctttcctacccttttaagggtggttgcagtctttttttattgcgcgtttttttacagcgccttttaaatttatgtataaaaaatttttagctaaagtcggaggagacttttttcagctttcaataaaccatttcacattatctggatattcaaagtcttgcaacatacttaaacaatgtctataaattgaagtatctatttcttgtttgatcataacattataatcagaattatttgcacgtatgtattctttagaatatgctgttgttaactttgcgaaaaaagtatatacttcgagaaaaatggttttgtccgagaataatttatcaagtttttcattaatttcatcaaaagttttatttttaaatgaaacacccataaagctaagcaaataatagggaattggatgccttttatcattattctttttttgattttctgcttttaaatacataaagaaaaggcgaatcatattgtcaatagttaaatattcttcaatattaagcgagaaatttttataaactggactattgggttttaaaacattgcttccctttttgtaagcttcaaatccgtcatgaataaaagccaatattattttaagaagtttttcaagaggaatttcagaagaggtaaaatttttgtaattaatatcaaaaaattcaaataagtctttactctttgttttaattattgcatttttagctggattatcatattctgttttaaatttatttttatcacttggcttaacaagtaataaaagacctctagttttaaactcgctttgaatattgagaaaataattgtgctttgaagcgaaagctttgtcactaatagcgttttgactatttgtgtacctgacaatattaacgtcaaggttaggatgtttttgttttgtatcagcatcaaagacgaatacttttacgagaacgaatgcctttgaaaattcggaaaacagcttatcttgtggacaatgagacaaaacctcagcaatagagtttacggtttgacaaccatttacaatttgagggttgtcaagtttaaatccataaatattttttccatctttgtcaacatctgtgcctttgatagtttcacatttttcacaaataatagttataccattgttgtagtaaaagaagttagctctgtcaactgaatcttttaatgttttaataattccattatttattccttgcgttccaagatattcacgaatattttcttcaaataattcataatttttttcaattgcctgtttatatatttcatatatgtcaactacattgacaagaacatatcttaaatctatcatccactccaattcatagtcatcaggacgaacatctagagatgtagccgctcttcttgtaggcaatttagctgaaaaatgttttttctctgtaaatctgtccccaaagtaaatcctttgtatatcacttaaagtagagtattttgcataaatgctcgcttctatacgaggatcatcatttttatcaaaattaaatttatctattaatgtatcaatatcttcacttgtatagtcgttggtaacataaaaatgtaaccaaattttatattcactatctgatatggctctatcaaaaattttttgcaattcaggagactttctgtattctcctttcaaaagaattcttagtggtgaatacagaaaatcagaaacattgtctcgtggaacgggagtattttctgagtcatatttattctgaataaggaaaagctcttttgtatcttcgtagtgtacccaacaatctattcctttatccttaatgtcagtgacgttgtttggaatgagttcctcatctaaactatataatcgactgagaacccaataattaaaggcatattcgtcttttagtattttatcgtctatatatgagaactgactttggattaaagcaatatcatcagcaatttgctttttaaaattattttccataataaatactcctatcattataaagttatctatatattatcacattaagttaattttgtcaatacagaaattggcacattatagagtgctttaaatgttatatatcaaatttcacagcctttttcacactcactttcattattcaaataattttacaaaattacaaatacccccttgacacttctcccgttctgcactataatactacacaagagaacttttttagcgttgtgcatacgttaaaatgagcataataaagctcagaaaataagcttttttgtgagatgtgccgcaaaagtgtcctgttatttgttaaagtgtagacaaacggcgcataatatgatataatgtagggtgagaaatgagcggtttaaaacaggcggtcagaaacaccgccaagatcataatgttcaaaggagtatatcccctttgctataaagtgtcaagccttagacctttgagaaaaaacaaggtcatctttgccgagataagaagcggtacgctgacggatagcttccgctatatctatgaggaggtaaagaccagaggacttgatccgcaggtctattacgtccataataataagggcggaatgggctatctgctgagatatttgaagcttacttggctaatgggaaacgtgggttgcgtgttgcttaacgatacctgtaatctgttcggcgcttttaagttcagaaaagacacaaaggtcattcaaacatggcattcctgcggagctttcaaaaagtggggagaaagtatcaccgacctctctttcggcgagtcgctggaagaattgagaaagttccctgcccatacaagctatacactttgtaccgtcagcagtaaagagtgcatatgggctttcaaggaagctttcggctttgaccttgataataatagcgtgcaggcaataggcgtatctcgtaccgactttttctttaaagaggaaaatcgtgtgaaagcctttgaaaatctctataaaaattgcccgaacgcacagtataaaaaagtcctgctctatgccccgacctatcgtggggacgctgataaggcttatatccccgaaaagttggatataaaagcccttaaagagaatttcggcagcgagtgggtgcttcttgtaaaaagacacggatttgttaaaaaggagtgggatatccccgaggattgtcaggacttcgcctttgacataacggaacatatgcctatcgaggatcttctttttactgccgatatgtgcataaccgattattcttcgcttatttttgaatattcgctctttgaaagacctatgatattctacgcttttgaccttgatgagttctatgactatagaggcttttattatccctatgactatagcttcctcccgggaccaatagttaagaccaatgaggagcttataaacgccataaagcagggaaaagccgaccctactgtcatttctgatttcagagaaagatttatgggcgcttgcgatggccgttctaccgaaaggatagccgattatattatgtcacaaaacagcgaatactaagtaggggtgaacagcgttcgcccgttgactgccgaaaccttatcggcgtatcacaatgatttatttgtcagatacattattataatataaatatcagtaaggagtttgtctatgatttacggtgcaatgctcgcagggggatcaggtacaagagttaaaagctcgaaaataccaaagcagtttatcgagatcggaggtaagccgatcataatctatacccttgaaaatatgctcaaggtaaagagatttgattatatctatatcgccgtccataaggactatgaggactatatgaacgagcaggtgaaaaagaatattcctgaaagcgaaaaggtaagggtgatcctcggcggcaaggaaagaatggatactataaataatgtcaccaccgctatcacaaatgataacggaattcatgatgacgatgttatcgttatccacgatgccgtaagaccttttgttacagagaagatactcaacgattccatagattgtgccgcagaatacggtgcttgcgtctgtggacttccatgtgcagatactatcctccattcaaagggaggagagtatgttgaagacatccctgtcagaagcgagctttacagcggacaagctcccgatagtttccgccttgcccactttatccaaatgcaggataacctcactgaggagcagaaaaaagtcatcacaggcacttcgcagatatgcacaatgaataaccagcctatccaccttatagagggcgacgctattaatttcaagataacaacagacagcgacctgcttattgtcagaacgctgcttggcggtaaatagaaaggactttttttatgaaaagcttaataaacatacccgaaaagatgaaagcacttgtgctttatggcgtgggcgacctgagagtaaccgaggtagacgtgccaaagcttgaaaaaggcaccgtattgctgaaaataaaggcgtgcggaatttgttcaagcgatatgccaagatgctttgtaacaggaacttaccacttcccgaccatacccggtcatgagttttcaggtcagatagttgcagttggcgatgacgttgacgaaagccttctcggcaaacgttcctgcgtgttccctatgctcccttgcaagcattgtaaagcctgcaaaatggaggaatatgcacaatgctcaggctatagctatttcggttcaagacaggacggcgcatgggctgagtacctcgttgttccggtatggaacttagttccgttcgacgataccctcgattataaaactgcagcgctctgcgagcctgccgctgtttcaatgcacgctgtaaatatcggtgacatcaaagaaggtcagaacgttgttatcataggcacaggtacaataggctttatgatagccctctttgcaaaagagagaacaaagaccggtaaggtggttatcgcaggtcgttcaaagaataagcttgagtatgcaaagaagctgggctttgacgttgttgatacaagcgttgacgatctccctgcacaggtgaagaagataataggtatcgacggagcagacgtaacatttgaagctgtcggctcaaacgaagctatcgcttccgctatcgagtcaacaggcgctcttggcagtatcgttctcgttggcaacccgtcaacagaccttatcctgcctaagaatatctattggtcaatactgagaaagcagataacagtcaaaggctcatggaattccagctataacagcagagtgaacgattggaagaaagcccttgaagttttcgagcatagcgacgtaaactttgccgatcttatcacacatacattcacaatagaggagaacgaaaaggcattctccgctatcagaaacacaggcgagttcaccttaaaggtaatgttcacatttgacgattaaacagtctgctgtttgtaaatttgagtaaaaattttgtagtcgcttttcaagacctgaaatgaaagttgagagggatagataaaagcggcggaaagtaaggaatagttttaaatggataatatgactcccgaatttgaagagatatacgggaacagaagaaagactattgagagattaaaagagagaaacaaaaaattcgcagagcttacaagagtagagttcaagagagttatcctccatatcgagggcgagcttgtgggctttgaaaaagacgagcttgaaaacttgtcagcaagatttgtcacacatgatagaacttgtatgttccctgcccagcattttgaagtaagcggaactcattttcatctgacagtgaatataatgtccgccaataacgaagctcctatcgccacaggcgactatgaccttaaaatattcacaaagtataagggcatgaataaaccgcagatatcaacagatacagtggattatgtcctcagtggcagtacgcttctcaagctcacctatgataacgatggcagatgcctgtcaaaacaggtgcttacgaatgagtatccttgtatcatatccgataaagtggaaactatagaggacgatacaaaggcgaaccctatgaacttcaagctcagacgaggcgcagaaaaccttttctatgccgagtctgcaagcgatatggatacactcgaatataagcttgccgtcacctataaagagcctaagccttcccagaccttgccaaagcgtattgagaagaagcttcaaaaccgtaagaagcttatcataagagatgtttacggcttaaagatatggtgctttaaaaaggcgttctcgttctttaagcattttgctaagaaaaacggggatattatcctctttgccagcggttcgagagccgagataggcggaaacgaaaaggtcatctatgaccgcatgatagaaagaggacttgacagcaagtataagttcagatttgacttcaaagcaagtatcactgtcaataggtcgatacctgctatgataaggttcgtctactatcttgcaacctccgatatcattcttatagatgattattaccctgacatctaccttgtggattatcctaagaacgtcaaggtgcttcaggtttggcacgcctgcggagcgttcaagtcattgggctttgaaagattgggcaagccgggcgcacctccgttcaatacaagggtgcataagtgctatacccacgttcctgtaagctcctatcattctgcgctccaccatgcagagggcttcgctatcgacgaaaagaagttctatcctgtgggtatcccaagaacggatatcttctttgatgacgaatataaagctaaaacaagagagcagatgctggaagttttccctgagtgcaaaactgcaaaaacagtttatatgtatgcgccgaccttcagaggaaataacgcaaataatgctcatttcccatttgataagcttgaccttacagcatggggcaaatttcttgatgaaacggattccgttcttatcgtaaagctccacccgtttgtaaaaaggcgtatcgaaatacctgacgagtatgctcacagaatacttgacgcctccgactacagagaggtaaatgatattctatttatagttgacgtgcttatcacagactacagctctatcatatatgagatgtcactgcttaaaaagccaatgcttttctttgctttcgaccaaaagtattatgaagcaacaagagatttctatgagccgtatgaggagcttgttcctggtaagatcgttcacgattttgatgagcttatgaccgctctcagagataaggattacgagtttgaaaaaatggagggcttcataaagaagaacttcaaatatacagacggcaagtccaccgacagagtaatagaccagcttatcatgggcattgagcctgaagataacagcataagataaaaaagatgaatagaaacaggaggatcagtatggacaatggtatgatatcagtctcaatgatgtgcgtccatctgggacagataaaggaatatcttgacgcttttaagcgcaacaatatcgaatatctccatatagacgtaatggacggctcatttgtgccgaatttcacgctttatcctgattatgtaaaacagctccgtgatctaacggatatcccatttgattttcatttcatgatagaaaagcctgaggaaaggctccagtggtttgatatcagagagggcgattatgcggcagtgcattatgaaagcacaaagcatatcgcaaagtgcctgcaatatctccgttctatcggtgcaaagcctatcctggctatcaatcccggcacacctatctgcgtggtagaggaagccgtagacttcatagacggtgtgcttgtcatgacagtaaaccctggctttgcaggacagaagcttgtgcctaacacggtggataaggcaagacgtcttagaaagtggcttgacgaaaacggccacgaggacatcatcatagaaactgacggcaatatgtcaaacgagaactgccgcaagctttacgaagcaggtgcaagaatgtttgttgcaggaacatcgagccttgttaagccgcaggtagagggtatagacgaaaggatagccgaaaaccgcaaaaatatttgtcctttgggataaaaaatgaaaaatgcagccgctctgtatatattgtgcagggcggttttttacattgtttatgagaatacgaaaaagcggtgcagagtttccactccgacaccgctttgcttatatctttactttatttttctctataaagtccacattctctatcatgggaatatatcactcccaccgcctgcaaaaacgaatatattatcacgcttcccacgaacttcattccacgcttcttcaagtctgcagagatcctatctgaccactcgttggtagttttatcgcactcatacaatatttctccgtcagtaaacctgcaaagataatcataaaagctcccctgctccttcacaatatcccgaaatattcttgcattagaaatactcgccctaattttcagcttatttcgcacaatagaactgtcagagcaaagctctgctatcttctcttcgtcatatccacagaccttatcaaggtcaaattcatcataagctctgcggaaattctcacgcttgttcagtatgcactcccacgaaagcccagcctgaaaagactccagcacaagcatctcaaacaaatagctgtcatcagtcctgagaacgccccattccttgtcatgatattccacatactttggatttttaaggtcgcaccatttgcacctgttcatataagcttcgtaccctcgttgtcaatgtgaaattcctttacctgccagcctttaagccctgcgttgtcaagagaaaatttcatcttgcctgcgaaatattgattgctctcgtccacaatagccatgatagttggacctgcaccgcttatgtatgccgcatatgcaccgtgagtgtacgcaatgtcaaaaacgtccttgcagtggggtataagcgccattctgtaaggctggtgaagcctgtcatcaactgccgttttcagattttcaaacttgcccgtaagaagcgaagccgagaaaagcgccgcacgggaaaggttgtaaactgcgtccttgtgtgaaacttccttaggcagacaagctctcgcttcctcagttttcagctcaaaatcaggtattatcgccacgaatttcagctttgtgaaaacctcctgctttacccagtgtacctttcttccgtcaaatactgccgtcacgattccgcccagcagtgcaggcgcagtgttgtcagggtgaccctctatctgtgccgcaaggtcaacaagatcgtcctttgtgaggggatccccgagcattttgttcgctcccacaagtcctgcgattatgcaggcagaggacgagccaagtcccctcgccataggaatattgctcgtctgtataagcctaagtccctccagcttttttccgcacaccgcaaaaaggtctttggcagaaatgtaaatgaggtttctctcgtccgtaggaatgtcaagcccgtccgccgctgtaatgtctatcttgtcgcactcctccatttcaatgtagttgtagtaagtgagcgcaagacccagtgcgtcaaaaccggcgccaaggttagccgacgtggcaggtatctgtatttttatcatggtgaaaactcctttatatgtaaaaatgtacgaataagcgcagttaaaattgtattttacatcaattgacaattagtcaatgctatgctatcctttagttaaagaaaggggggcgagcaaatgaatagaaaaataattatcgctctgtgtgcgttgtgtctgtgtgtattttgttcatgcagtaaaaacgaagaacagaacaactcgtccgaaaaaccgaccgaaacaacagcggtgacaacagtttcaacaacgaccaccaccccaaccacctcagagcttgtggcagacactccgccgccgtatatgtactatgagggcaaaacatatacctcactttacaaagccgaagaaactcttatgtcaacagacgataagatgaccgaaaggctgaacggctatgagttcgtaggaaacacccacgaattttttaacgttggtgatatgaagtcagattttgatgtgacttcactgcctgataatgccaaggtctatcatgaccctgacaaagcagacgacagcgacccgtttataattgcctttgaagaaaacggacaaaccactctctattgcatgaatttgctcagtgaataacatactgtaaaaaacgcaattgatttctttgagggggacttattatgaaaaagaaaacagcagttattattctggcatttctggcagtatgtctttgctcgtgttcaaaaagcaaaaatgacagcggaatagactccgaatatgttaaaacagagagtgttgtaactgaggagagcacagaggaaacaacagaggtcagaggagctgatatgtgtccattgtatatgtattatgagggcgatctgtatatccctgcggtcaatcctgaagacagactgatctttgatacagccgagttaaaagactataagtatgttggaaaaacaacacaatgcagtgattgcagtggcttaacagagaattttagggtcaccattcttcgtgataatgcaaaggtctattataatcagaatgaacctttggacggcaagccttttgctctgatgtctattaatgagaacggcactgtttggatagcatatctcaaactaaatgatcgtgattaaatatgtaaagcggcggagttttgatccgccgcttcttgttttttatcagtatatccttatcttgcttgcgatctcagcggagtgtgaaaggatagtcaggttagcgtcaatgtcagcctctttcatgttcggcgtgataaacgcaagctcgttttctgtcctgccagaacgctctatatacatgagctttccgaacatctcagaaatagaagacttgagagcctcagcattttcagcctttatgcgaacatacattgaaacgtccatgtccttgtatggtgcaacaaagttcttgtcatcacaatcttcccatgtaagagcaagcactctgtgatgatgcttcagacaatcgataatgtcgcctactaccgctgaagctgtaggaagcttgcctgcaccctgtccgtagaacataacgtcgccaacgccgtcgcctgttacgctgatagcattgtatacatcgtcaacagacgcaagaagatttgactttggcacaagtcttggacaaacgatagcactcactctgccgtcatcaagcttctttacagaacctataagctttataacatatcctgcgtttgcagcatattcaacatcatcaagtgtgatctttgttatgcctgagcagtgtaccatttcaggataaatgtgcttgccgtatgcaagtgagccaagtatacagatctttctgcaagcgtcctcgccctcaacgtcagccgtagggtcagcctcagcataaccaagcttctgagccattttaagagcatcatcaaatgacatctgctcttttatcatctttgtaagaatgaagtttgttgtgccattgaggatacctgatatctgaagtatctcgtttcctgccagacacttgttaagcggtctgatgataggtataccgccgccaacgcttgcctcgaacagatagttgcagttgtgttcccttgctattttaagaagctctgcacccttttccgcaactagcgccttgtttgatgtaacaacgctcttgccgtgttcaagaagcttctttgtgtagtcataagcgaaagtcgttccgcctactacctcggctactacttctacctcggcatcattgagaatgatgttgaagtcttttatcattttgtctgcaaatggagaatcagggaaatccctcagatcaagaatgtacttgatgtcacattccttgccgaccttttttgagatagattcacggtttttcataaaaagctctaccgtaccagagcctacaacgccataaccgataactgctactttacacataaaaaatcctcattcctaataaattatatattgttaaaatcttattttacccttactctcccgatattatcttgacttccacaacgccgtgaactttagaaagctcctccgtaagcacgttggtgctaagtgcgtcatgctcaaatcttaccgagaatgtcaccgtcgccaccgagtcgatagggatattctggtttatggtcagaatattcgtgttcagctcgtaaagccgtgatataatggaggagagcactcccttttcatctctcagtatgcagtataccgaaacgatgttgtttgtgagctgttcttcataattgaatacggagtccttgtatttgtagtatgcgctcctcgatatccccaccttgcggcaggcttccgatgaagtggaaacttcgccccttgccctcatgcgctttgcggcaagcacctttagcacaatgtcaggaagcacctcagagcttacgataacaagtttgttttgcccgttctccaattttagtccacctccaaagtacagatgtgtgcatgataaatacaagtttaccacttttgtccccttttgtcaagtgacctgaccgcagatattcaactaatttttcaaattcagggtaaaataaaatgtgtattctgactaaaatcattacacatagagcaatttgtccaaagaaaagtcatatagatagtgcaaaatgtataaaaagtatggctttgtaccccttcaaacttgctatttaagacaaaaaggtgtacaattaatgttatgaaactatcctgcctgaaaggggagaataatatggatatgatagcagaaatactgcaaacagataaagccgctgcaggcaagcttgaaaaagcagatatggaaagcggcgaactgctggagcgcacagtgaaagaagcgcaggagctgaaagaaaacgccctgaaagaagccgaagcctataaagcgcagaaagccaaagaggtcacagagcgtataaataccgaaagcgaaaagataacttccgcacagaacgagaaaacaacggttctcgataaaatatttgaagaaaaacatactcagtgggagaatgagatatttgataatatcatctctccgaagtagagcaaaaattctccgtgaaaggggctgaaaaatatgcttgacagctggtctgccaacggaacagtggcgaaaataaaatatatccacggcagaatgtttactaaagagaactatcatgaaatgctcatgcgaagaacagtccctgaagccgcagactatcttgcacattcagccagatataaagacgctttccgtgacgttgaccctaataccgtccatagaggctttgtggaggcgcttctccaaagagagaatttcaatacctatatgcgcctgtgcagatttcaggagcttgataaactgcctttttatgacttccttataaaaagcaaggagatagaatgtattctgtccatgataaacaatataaattcagggcttgataattcttaccttaacgactttcccggctatgtcataaaacattcaaaggtgagccttcttgaaatgagccgagccgagaactatgaacagcttcttaaaatactaagaaatacaccgtattataagatactggtgaaaataccgcctttggaggacggctcagcggattataccgagtgcgagctaaggctgagaacagcctattataccgagcttttaaataccgcaaagcatgatttttccgaaatgcaaagcaaacagctctcagaaatgataagccgagagatagattgccttaacataataaacgcctaccgtatgaaagccttttttggctactcctccgaggagataaaaaaacggcagataagaataaaaacaggcacaggctcagttaaaagacttgataagtattatgagcttgaaagccccgaagatatgctcgaatgggtgaaaagatcaaagtattcaaagggttgcaaacagacctctgaatatatcgaaagtatagtccgaagttcacagtttgcctatctttcccatatactggctcaaagcactgccgcaccagtttcactctatgcctttatgaaactgtgcagtacggaagccttgaacatcgtgcatataatcgaagcgataagatataatgccgacccctcggcagttgaaaaggatcttatcatcaccgcctgagcggtaaattctcaggaaaggagataatgtgattggctatagaaaaaatgtcccttgtgaatatagcaggtcttatggacgagcttgacgccaccctgaaaaggtgctgtgaaagcggctgttttcatatcgagcctgcgggcaattctcccgacagcgcaatgaagcccctcagcgagaaaaacgagtatgaccgacctctgaaagagcttgcccagctttccgcacagcttggtataactctaaaggaaactgattttaccgactgcgacctgtcagctccgcaggattttaactccctgtttgaaaagtataatatccctttcagcgagcttaatacaaagcggctggagcttactcagcgtatctcagagcttggaggggcggtcagacaaatagaccacctgaaaggtatgcacagcgactttcagcagcttttctcaatgaagtatgtttccgtccgtatcggaaagctgccagtggataacctgccgaagcttgactattataacgagaatttcttctttgtcccctttgaaacgggaaaaagcttctgctggggaatgtatttcgtccctgaacgtgataaacagcgtgttgatgatatcttccactcaatgtattttgaaaggatacggataccgtcctatgtatcaggcgacgcagacgaagccttggaaaagctgaaacaaactatagacgcagatacagttgagaatgcaaagataaacgagcagataaacgagcttgccgcaaaagcagagcctgaactgcaaaaagctttttcaaaactaaggtttatccacgatacctttgacctgcggcgaaatgccgccgcactaaacgataagttttatcttaaaggctttatccccgaaaaggaaaaagaccgctttgataagcttttcgaggatatgcgttcagtgtcagtggtctatctcccacctgacgcagacgcctcctgcgaaccgcctacagtgcttaaaaacaactttttgacccgacctttcacaatgcttgtggaaatgtatggtctgcctgagtataaaggctataacccgacagccttcgtggcaataacctatactctgcttttcggcataatgttcggcgacttgggacaaggacttcttatcgtccttggcggacttgccttaaagaaaaagctgggtgctaaaataagcggtcttgtcacacgccttggcatatcaagtatgatattcggtactctctatggctcgttcttcggttatgaagagcttttagaccccgtgtttgagaatataggacttgacttcctgcccctaaaggttttcaagcaaacgaactttatcctcataactgccgttgccataggtgtggcacttattgttatctcaatgatactcaatatctatatcggctttaaaaataaggattacgaaaaagccattttcggctgtaacggcattgcaggacttgtgttctacagctccgttgcggcaggacttgttggaacgctcatattcgatgtaaaagtcatgtccactccgttcgtcatcttccttatcgtaataccattggtgtgcatattctgccgaacacctttctctatcgccgtgaagtataaacagtggcgcttgtccgaggacgaggaaaaaatgaccgtgggcaactttatcgttgaaaatttctttgaaatgttcgagttcctgctcagctatgtttcaaatactatgtcatttctccgtgtgggcggatttgtcctctctcacgcaggcatgatgctggtggtaatgacccttatggaaatgtgttccgccgccgcacagccattcgtgcttgtgcttggcaacctgtttgtaatggtaatggagggcatgatagttgccattcagataatcagacttgagttttatgagatattctcccgcttctatgagggcggcggaaaaccattcgagcctgttgttgtaaaatttactgcacaaacggagtaacagctcatttgcaatattaattttagagcgttaaatcgcaaacaagcgggacgtcgagggcgccgtcccctacaaatgaggtaacaccatttgtaggggcgaacatcgttcggtcactcgctgtgacgggcattttaccccgaccattatccatacccgtacaatgtaattcgtaaaatctaaagtaaaaataatttttttggaggaataaactatgcttatctatttcctgctcccacttatagcagtcgcacttctttgtgtaccattcattttcaccgcaaagaaaataaagaacggaagatcgccaaagggtgcttttatcggtaatctctgtacatttgcaggcataatgctctgcgctcttatcgtccctgtaggtaattttgtttcagccgcaagcgaggagggcgttaaggccgccctttcaacaggcgcaggccttggctaccttgcagcagcccttgccgttggactttcctgcgtaggttcaggcatagccgttgccgcaggcgctccagccgctatcggtgcgacctccgaagaccctaagaactttgtaaaggctcttatcttcgttgttcttggcgaaggtatcgccctctatggacttcttatcgctatccttataatctcaaacgtaggcactgcattgggcatttaacatgagattttatcttatcagcgataatatagatacccaaatgggcatgagactttcaggtatcgagggcgttgtggtgcatacctccgaggaggtgtcaaacgcacttgataaggctatggaaatgaaggacgttggcgttgtgcttatgacagagcttgcagtcaagcagtgcagagaaaaggtctatgactataagctcacaagagaaacgcccctcatagttgaaataccagaccgccatgccacatcaaagatatctgataccatttcccactatctcgcagaagcagtgggaataaagctgtgattttgataggagtttagtaatggaaaatcagacgataaaacttgaacgcttcaagcaggctgtctttgaggacgctgaaaaacaggcaaagctcataaccgaatccgctgataaacagcgtgaaaacgagcttgctcaggcgaaaatagaagcacaaagccttgcagactcaaaaaaagccgccgcagataagaccgaggaggcaagagccataagggaaatatcttcaaaacagcttgaagctaaaagaaacgtgctttgccatagagaaaagcttatagacagcgtttttgacaacgtaaaaagcaggcttgcgactttcaaagcaagcagagattataagtcttggctaaaagaaaaagccgaaaaatgcaaacagacctatcccgagcataagggcgttatctacctctcacctgaggatatgaaatacgcctctgaccttgcagactttgaagtaaaaagccgagattccatagagcttggcggtatgctcatggtctatgaggatattggtatagcacttgattatacctttgattcagcatttgaggggcagcgttcagcctttactgaaaaagccgagcttgtgcttgggtaataaggagttttttatggataaaatatattcggtaaacggacctgtagtaaaggttgcagatacgaaaagctttgccatgcaggaaatggtctatgtgggcaaaaagcgtcttatcggcgaggtcataagagtgcagtccgattttaccaccattcaggtctatgagggcacaacagggcttatgcctgacgagcctgttacctcaacaggcgcaccaatgtccgcaaccctcggtcccggtataataaataacatcttcgacggcatagaaagacctctcaaaaagcttgaagaagtctcaggcgcatttatcgctgacggtgcagacgtaagctcgcttgatacagagaaaaagtatcccgttacaatgacagtgaaaacaggggataagctttccgcaggggatatttattgcacctgccccgaaacgccacttatcacacataagtgtatgctttcccctctgtcaaaaggcggagaggtcatatggactgccgaaaacggcgactatacaataaatgacgttgtggcaaaaataaaagcccctaacggtgcagtagaggagcttaccctctgccagaaatggcctatcagaacatcaagaccatgcaaaaaccgcctgcctattacaaagccgttggtaacaggtcagcgtatcgttgatactattctgcctgttgcaaagggcggaacagccgctatccctgggggcttcggcacaggcaagaccatgacccagcaccagcttgcaaaatggtgtgacgcagatataatcgtctatataggctgtggcgagcgtggaaacgaaatgacgcaggtgcttgaggagttctcagagcttatcgacccgaaaacacaaagaccgctcaccgacagaacagtgcttatcgcaaatacctcaaatatgcctgtcgccgcccgtgaagcctctatctatacgggcataaccctcgctgagtattaccgtgatatgggttatcatatcgcaattatggcagactctacttcacgttgggcagaagctctccgtgagatatcaggcagacttgaagaaatgcctgccgaggaaggttttcctgcctatctgccgtcacgaatttccgagttctatgagcgtgcaggctatgttgaaactctgggaggcaaggaaggctctgttactataatcggagcagtttcgccccaaggctctgacttttccgagcctgtcacacagaacacaaagcggtttgtacgttgcttctgggcacttgataaatccctcgcctatgcaagacattatcctgcaataaactggaacacaagctattccgagtatacagaagaccttgcagattattataataaaaacgtcaatgagaacttcatgaaagtcagacaggagatatcaaatatcctcgttgaggaaaatacccttatggagatagttaagctcatgggtacagacgtcctccctgacgatcaaaagcttcttatcgaaaccgcaagagccgtaagagtaggctttttacagcaaaacgcctatcataaggacgatacctacgtcccccttgataagcagtaccgcatgatgaaacttatcacagatttctatgcccttgcaaagaaatcactttcacagggcgtgaacgttgataaaataataggctgcggctggatagaaaagcttatcaaagtcaagtatgatataccgaacgataaaatagagctttttgacgaatacgaaaagaatatgaaagccgatatggaggctttgacaggaggtgcaggagcgtgaacgtaaaatatatcggccttagcgaaataaacggaccgctcgttgcacttgaccatgtaagcggcatttcctatgacgaaatggcagaaataaaacttgatgacggcacacgccgccttgcaagagttgtagaggtggaaaaagacagagccgttttgcaggttttcgagggaacaaaaggactttcccttgttaataccaccacaagctttcagggcaagcctatggagcttgcattgtctaccgaaatgctgggcaggatattcagcggagcaggcaagcctatcgacggtctgggggagatcttccccgaaaaataccgtgacataaacggctcgccccttaaccccgtttcaagaacatatcctcgaaactatataaacacaggaatatcctccatagacgcccttactacccttataagaggtcagaaactccctatcttctcaggttcgggactttcccataataagctcgccgtgcagatagtaaggcaagcgaaaatcgccgacgaaaacggacaggatttcgcaatagttttcggagcaatgggcgtaaaaaacgacgttgcagattatttcaaacgctgtttcgaggaaacaggcgttttgcaaagggtcgcaatgtttttgaatctttcaaacgaccctatcatagagcgtatcctcactccaagatgcgccctcacttgtgccgaatatcttgcctttgagcatgatatgcacattctcgttatcctcacagatatgacttcctatgccgaagccttgcgagagttctcatcatcaaagggcgagataccgggaagaaaaggctatccgggctatctctattccgaccttgcctctatctatgaaagagcaggcattgtaaagggtgcaaaaggctctgttacgcagataccgatactcaccatgccgaatgacgatatcacccaccctgtccctgaccttacaggctatataaccgaggggcagattgttcttgacagaaacctcgaccaaacaggcgtttatcctgctgtttctatcctgccgagcctttcaagacttatgaaagacggcataggcgagggctatacaagggaagaccaccaaatggtgtcaaaccagctttttgcagcctatgcaaaggtgcaggacgcaagaagccttgcctctgttatcggtgaggaggagctttccgataccgataaagcctatctgaaattcggtacgctttttgagaagcattttatcgaccaaggctttgacgtgaaccgttccatagacgaaactctcgacctaggctggagcttgctctccaccctgccgaaatcagagcttgaccgtgttgacgaagaacatctggagcattattacagtgccgaaaaagctaaggcactttttgcagaggactaaaattcagtgccgcacaaataattatgtaggggcgaacattgttcgcccgttattccacaatattgcggttatttatgatattgccgtcactcacaatattgttgtttgcgattttgaaattatttgcaacatcactattccaatgctgaataaaacggctcacaaagaaaaaatcgggcgaacaatgttcgcccctactggactttatttatatacagtgatataatggaaagagggtgtgaccaatggctgaacagcaggtctttgccacaaagggaaatcttatactttataaaaaggctctgaagcttgccgcattgggctatgagcttctggacagaaaaagaaatatccttataagagagcttatgagccttgttgacaaagcaggggagcttagaggaagcattgaggacacctacaaggaagcctacagtgcactccagcttgcaaatatctccatgggtcttgttacaccttatgcaaattgtatccctgttgaaacaggcgttgagataagcacaagaagcgtcatgggcgttgagctgccaaaggtcacccttaaagaacgccctctgaaagtcacatacggcttttctcagaccgattctcagcttgacagagcctatcttgcctttgaaaaggtaaaacagaccacagcagtcctcgcagaggtggaaaacagtatctacagactgtccgtagccataaaaaagacacagcgcagagcaaacgccctgcaaaacataatcattccaagaaatgaacacatagtgaaattcattactgactctcttgaagaaaaggacagagaggagttctcacgaatgaaagtaataaaggcggcaaagctaaagtcggcaaaatgatatttgtaatggcgcagcgtaatttctgcaatgttattgtaggggttggcgccctcgacagcccgcttttcaacgttgttatgtttattgtgggggcggtcactcgccgtgacgggcatttcacgctgtgcatttattaatgcaacacctttgtactgcacaaataaattgtaggggcgacatgaggtcgcacatccagtcgccagcttgcagcattataaaaacatgaaaggaaagataaaaatggaatatatcaaaaaagtattcagaagctattggatattgtctatattctgcgtagtgctgggcattgcgctcataatcgaccctaatttcttcaccgccgccataggctatgttattggtggacttttcaccgcattcggtgcagtggagcttataagatacttcgccatgggcagagacgaccagagctattcttcaagccttgtgagagggatcatcctcgccgccataggcattttcattatcataagacctgattttatcccgaaagtcattgccgttgtctgcggactttatatgctcataagcggcatcgtgaacattcaggactcccttaaccttagacgtgcaggtgtagaaagctggaacgtaagctgtatctcagcctctgttaccactctcgttggtatacttctcctctttgaccctcttattttaggcgaaaccgcaatgatagtccttggtatcgctctgctcgtttcaggtgtgacgaatatcttcggctgttttaccgcaggctcaaagctcaaaaaggtaaataagcttatgaaaaaagaactcaaagacagacctgataaggatcattatatagatatttaggatattatcgtaggggcgacctggggtcgcccactttttttctctattttagcagtttgatgtatttctttacaaaaatatgtgcattttattgacatgggatgtgatttcacaagtttcaacaaatatttttgcgtcgatttgtaaaagtctataaaaattaaaaaaagccttgacaaatgaggtcaaaaggtatatactcataactgtaaacagcaaaggcgctgtgaaccacttaggttcgcagtgccttttttatttctttagactataatttataataggaggaattcaatatggcaaacgttcctgaatatttcggctcagacgtattcaatgaatcagtgatgaaagaaagacttccaaaggctacatacaaggctttgaagaagactatcgacaacggcgatccacttgatatcgaggttgcaaacatcgttgctaacgcaatgaaggattgggcagttgaaaagggctgcacacattacactcactggttccagccaatgacaggtcttacagcagaaaagctcgacagctttatctcaccaactgaggacggtcacgttatcatggagttctcaggcaaggagcttgttaagggcgaacctgacgcttcttctttcccttcaggcggattgagagcaacattcgaggcaagaggctatacagcctgggacccaacttcatacgcattcattaaggaaaaagcactttgtattcctactgctttctgttcatacaatggcgaagcgcttgataagaaaactccgcttctccgttcaatggaagctatcaataagtcagctctcagaattctgaagttgttcggctcagacgcaacaagagttacatcaaacgttggtcctgagcaggaatacttccttgtagacagagagatgtatgcaaagagagaggatcttatccttgcaggcagatctctttacggcgcacctgctccaaagggtcaggaacttgaagatcactatttcggtactatcaagacaagagttcaggcttacatgaaagatcttgacgagcagctctggaggcttggtatttacgctaaaacaaagcataacgaggtagcgcctgctcagcacgagcttgctcctatctatggcacaacaaatatcgcgaccgaccacaaccagctcacaatggagatcatgaagagaacagctagaaagcacggcttcaagtgcctgcttcatgagaagccatttgctggcatcaacggttccggtaagcataacaactggtctatctcaacaaacacaggtgtaaacctcctcgaccctggtaaaacacctgctgagaacgctcagttcctcctattccttacagcagttatcaaggctgtaaatgattatcaggatatcctgagagcttcagttgcttctgctggtaacgaccatagacttggcgctaacgaagctcctccggctattatttctatcttccttggcgacgagcttacaggcgttctcgatgctatcgtaaacggcgttaagtatgaggacaagagagttgagatggagatcggtgttgacgttctgccacacttccctaaggatacaacagatcgtaacagaacttcaccatttgcattcacaggcaataagtttgagttcagaatgcctggttcaaagctttcagtagcaggtcctaacacagttcttaacactatcgttgctgacgttctcgatcagtttgctgacgagcttgaaaaggctgacaacttccaggacgctcttgacgatcttatcaagagaactatcaaggaaaatcagaacatcatcttcaacggcaatggttattcagacgagtggcctgttgaagcagaaaagagaggacttcttaaccttaagtcaactcctgaagctgttcctgcattccttgcacaaaagaatgttgacgtattctctaagtacggtgtttatacagaagctgagcttcagtcaagagttgagatcctcctcgacgagtattgcaagacgctcaatatcgaggctcttacaatgatcgacatggctaagaaggagatccttcctgctgccgctaagtatatcaaggatatcgcaaagactgctgagcttgcaaagagctgcggtgctgaaactgtatttgaggaagaaaccgttaaggaaatctcagctctcgtaactgagatgtacaaggcacttggcacactggaagctgatgtacagaaagtacacgctatcgaggacacacaggaaatggcaaacttcttccacgatactatctttgcagatatgggcgctcttagagttccggctgataagatcgaaacactggtaggcaaggattactggccttatccaacatacagcgacctgctgttctacgttaagtaagggacaattcaaattttcaatataacacggactttataacaaactaaccacagatctactactttgttcccctacagctacaataatatacagaatgcacaatgaagtgtatgacagaccgagccgaatggctttggtcgtcatacacttttttgtattttaggaggaaaaagatatgacaaacactgtaacagtattggctgaaagcacaggcttcagtgccgtcaatactatatgggtactgttgggagctgcacttgtattctttatgcaggcaggcttcgcaatggttgaaacgggcttcacccgtgcgaaaaacgcaggtaacataatcatgaaaaacctgatggacttctgtatcggaactccgctgttctggctctttggtttcggtataatgtttggcgacggaaagttcatcggagcttacaagggaattgcagattcaacatatgcctcagctgctccagacggagtgcctttctttgcattccttatcttccagacagttttctgtgcaacagcagcaactatcgtttctggagctatggcagaaagaacaaagttcatttcttattgtatctattcagcaattataagccttctggtctatcctatcgaggctcactggatctggggcggcggctggctcgcagacctcggcttccatgatttcgcaggttcgacttgcgttcatatggcaggcggcgttgcagcattcgttggcgcagctatccttggtcctcgtatcggtaagtatgacaagaacggcaaggcaaaggctatcccaggtcactcgcttacacttggcgcacttggctgctttatcctttggttctgctggttcggtttcaacggtgcgtcaacaacttcaatggaaggcgacgctatcccgcttgcaggtaaggttttcgtaacaacaaaccttgcagcagcagttgcaacgatcacaacaatgatttttacttggatcaagtacaagaagcctgatgtttcaatgacacttaacgcttcacttgcaggtctggtagctatcacagctccatgcgacacagtttcaccagtatcagcagctataatcggtatcgttgcaggtatccttgtagttgtaggtgtagagtttatagatcaggtactcaagatagatgacccagttggtgcttgcggagttcatatgctcaacggtatgtggggtactatcgcagtgggtcttttctcagacggtacttgcggtgaaaagggactcttcacaggcggtggagcacatctccttggtatccagcttctcggtatggtatcagttatcgcttgggtagctatcacaatgactatcgtattccagatcatcaagcacacgatcggtcttagagcttccgagcaggaagagatccttggtcttgacgttacagagcatggtcttgtatcttcttacgctgacttcgcaccagcaatgtcacaggcaatgctcagctatacaaaggacgacgcaaagagcgttgtaaaggtagacaagtcaacagagcctgtagttcctgttgagaaggccatcaaggtagaatcttatgcaacagacgcaccgtctgctgacggcacacctaaaatgacaaaggtcgctatcatctgcaagcagcagaagctcaacgatcttatcacagctttggaggacatcgacgtaacaggtgttacagtaacgaacgttcttggctgcggaatgcaaaaaggacagcctgagtattaccgtggcgcagttgttgaaacaaatctgctgccaaaggtaaaggtcgaggtcgttatttgcaaggtaccaacaagagcagttatagatgctgcaaaggcagccctttatacaggtcatatcggagatggaaagatctttgtatacaacattgagaacgtagtaaagatcagaacgaatgaagagggttatgacgcacttcaggacgattaagccttaaagatgacaggtgactacccaataaaattgcccccatcccacttataaattatagcttggaacccgtggtcgagtaattcggctgcgggtttcaagttttgtggagaagttcaaggcattatgaatagatagacaaaagggacattgccgaacgttggcaatgtcccttcgtaaattatcagaaaagtgatagctgctcagataaataaaaagcgtgttccatatgttgctttgcctctgcttcaagtatttcgacatttgagagtggaaggttcttgaaacgaagctgatagaccatatcaaagaagctcgttacagccgcagttccaagatgcgtaagacagatcagctgtatatggaaatgtcttgctatgcggaacataggctcaagaaggtgaggcgaagagatcggtccgaatggattatcaaggatcagtacgccgcttgttgaatttagattgtttgtaaggcttcttgtgtaattcataacggatacgatcagagaaaataaaacaacaaattgttctccgccagagtttgctttcagagcgtcctgccatgaacgatagcggcagttctgaatatttttatcgatcttaaatacattgataggaatgttctcattgccaatgtagcaattcaagaggcgtctgatatcaagatgatcgttatgagttttcgttgctgttgtattttcagacagatgcttttggacttgttcagttatgaaatgatcgatccttttataaggctgatcgctgtctggatcaatctcaggcaaaactatctgtatcatatgtttttttacgttaccgatctgtacgaccgatctaccagacagtgtttttagattatcatataaacgtccggcacgctgtttgcaatgatctacaagttgctttctgctgtcttcaacatctttaagctgaacggcaagctgagcgatacgatcctgataacgcttgatatcgctttctgttcgttcataaagtgtaaagtatttatctcccttgatatgatcgtcgtcgatcactgatagaatgccgtccagtgttcccataaacaaagtatgtgtatttctgaatggctcaagttcacggctatggtatttctttgctttgccctctgcttgtgtcagctgatcgatgcaatgctttattgtatcgatcaagttatcagtatcctgcgggatctctgatattttaggagtatactctgtaaaatcaagcttgagatattttttgaatctatcaatgcatatccattttatattcaaaccgttcaatttctttttgcattcttcactttctcgctcagctgcttctaatttattttcacattcttttatacggcgttcaaaatcagaaccaacctcagatcgtggcaaaagctctgcattgagttctgctagctttttcttagcatgttccagatcgtttttcactttggtatgatagattgatgcttgagaatgttgcttataagcctgcgatcttgcttcttttgccagatcaagctgttgttcagtgtcattataggcgttggcagaatattctgtgcttttgtattctgttggttctatatggaatcttttgatatcattttctttatgaacgatgctttcttgcacctgttccagtcgcttctgcagcgttttgcgattagctgaattattctcaagataaagtcggtattcctcgagcatgaccgaatgatcctctgtaaatatttctgctttcggtgtgtctttcagctcatgcgacagtttttgatgatcggtcagcttattctggaggtcacggagaagaatatcattatcctgtatactcttattcagttgtttttctttctgatgcattccatctatttgttcagagatctctctgcaaatagtttccgattctgtgatcttttcgctaacgctctcatattgtgagatgattttacaaatacgctcaaattcggatcgtttattttcaatatgggattttgatatttgacttttttcgcttatttgacgattttcctttgctcgtgctttgatctcgctcttttgcttctcaagaaccgagagcttagtttgtatctcctgaagcttttctttaagcttccctatgcctgcctgtaattgctgctcatgatctgcggcgtatgtaaattgtgatagtatgctgcgttctgattcccattccaatatctgatgctgtagattatctttatctgcttgtgtttcgccaagtcttttctgtatattttctttataagtaaatgcgtcctgaaaatattctttatcatatgcagaaataaaccgttcaggctcgttccaatctccatcagccatatccgcaagttcagagcgtgaatatactggaacaacagccgataaccaagaatctggcgattgtgacagcaatttgaccttctccttttcagaatcaacgatcacagaataagcaacgagaggattgacggtaaggatatcttctcgtatttttgcattttgtaaatttaggtactgctcgcctgtttgataagcgatacctgattcctgcaaaaagcttacagctgttttggagaggtgaagctgacctgcatttatacatcgtagctgctcgcctagcaattcagcacagcgttccgtttgccgaagctgttctcttagctttgcaagtatttgctcaaggcttgataacggctcatcagtaaataatctgtctttagaaattgataaatgctctaagactttaataactgcatcatatgcttgctgatattctttcaattctgcttcctgctgctttaaattggctttacattcctcttgtgttcggtgaagctcgcccatctgattatcctgagcgtcacgttcctgttcaagccggctctcctcaagcaggcactttttgatattctcctcagcaagcctgagctgctcatcatagtccgcacgaatgctctcagcgtctttcttagaaaagcttccgtcaagcataatagtcatatgcaaagcaagtgttgccagagccttgttgatctgatcaagcaaactctttttttgaccgatatcttgatttaagcggtcattcttgtcattatgctgcttattaaggcgtgagatctctttctttatggaatccaaagcttcagacagttcttttttagctgcttccttctgctttaatttgccctcagtttgccttatcagctctgttgttagcaaagacagtgaatattttaaagaaagtatatgggaatcctgcgttccttggtcaagctctctgatctgtgcagtcaatgccttctcatcattttgctgtttaagcagctccttatactctttggcagcattcagggccttgactttatgttcaagcctgttatactgactttcggcatcatcttttttctgtttacattctgcaagccatatggttgatttatcaaaatcagcctgtgaaagataaacagcttttgatgcttcttcggttttgatgtgcttctgttttgtctttaagtcggatattgctttttcaagctgttgttgtctttctttgttcagcttgatttgatgctgaagtgtaaatgaatgatcagccaattggtgtatagactgtatcttctgatcttctgcgttccacatatcctttattagctgaagcataccctgcagcttatctgtaaaatccctgatctgcgactttaagagtagatttttctcctgcccggcatagctgaccgcatagttgataaacatttcttcaagggatcttgttgacgtatcgttgctcggcataacaccaggaataataaatttgtcaagtaatctgtcgctcgttttatattcctcaaagaactttgtaatgccgccttctactgcattgatcggcacaagaatgttttcccattcggtatagaaaataccgaattcctctaaacgcttctgataacggcgcaatgaatcggaaggatagtattcgacccttctgttttgcagatatttgcgaagctcgtcaaaagagatcgggcggatatgactgcctgtgcgctgtgaaagagggagactgataagatcgagcttgtcgcctgctcttgtgtaatcatgtatgaaagtataataacgaatggtcttgctctcattttcgtcatctgctgtggtgcttgcagccagtgcgatccctgtgagcagactgttatgtgatccgtccaatgcccactcaatcaagacaaacgcatgatccgtgcccttctgaaaataatcgctgatattacgattctgaacttttgccttcgggcaaataggctggagcaacaactgaacgataacagacttgcctccgccgttatccagattaaaaagagtatctattggttttccttcagcgttctcagtgcagaaaatctcgtcgggtatcagctttgcaccattgttgaacctgaaatttacaattcgtatcttacggatcgctggcatctggttttcctccttcaagaatagagtgtatttcagtaatgcgggtctgagataaataatacggcataagatcattcagcttgaccgttggtttccatacaccgtcagcgtcatacagcaattcctcatcacgaaactttctgatgatcttcatgaaacagccatgtttggtatctacagagttggattcatcaccacgctttgcgagccagttgtcagcaaggtgcagaaaatctatgctgtactgtgctgaagcattttttaaggattctccttcagagcgtacctgctcacaatgctttgtgaactcggaaagaaaatctgattctttgatgtaatatcttgtttgcagtgtgtttccttttccgccgtaaagctcatgtaaaagaaagatcgccatataattcagcaaataaagctcttcaagcttttcattgccaacgctgcggcggaaatcattgttatcctgcgaaaataattcgttgtttggatctggcaaaagataaagtctgccgttcgttttgtaaagagtgaaatcaagctcctgttccatgatcgcaagttcagaagcaatttcaggatcattataatattcataatacgcaggggactgctcacgggtaatgtaaccattttccataagctttgcaaatagtttcagactttcaggcctcatcttctcacctcgatcttaaaatcattcatctcgatatgtccgcctttatgatcagataaagttataacatcatcgagtttatatatcattatcgactccatttgtaccgattcttcaggaagctcgctcagacaataagagagatcaaattctcccacgggaacgattatgtcatgctgtgccgaacgccagcctgcgatatctatttctccaagtccatagagcttcagcatgacgtcaggcaatgctttttcctgcatttgttcatgcagctgcgttttagatacagtgtcaagatattcgctaaaattaaagaccgccctgttttcggcaaaagacagcagtcctcttattatctcaacatatctttcgtttctgatatctgccacattttcagcagtgtcatcacttgtgatatctataccgtcatctctgctgacctctcttaaagaattttgccgtctgtaaaaaagatcaataccaaacagatgcggaaattctggacgataaagcggtgcaaataattttcccacatctttagaatcttttaattgcattttctgcaatgggagcagtaactcctgttcaatgtcaaagtgacccgcctgcaaataagagaagctatcatctaaaagatcagcatatagttcagatagtgtgaatttctggttaaatactcggctttgctcgcttattacagtatcaatgttttcaaggatctcatgtatctctttttcggtctgacatatttggcggtcttcttttatttcagcgactgcgaatgcctgcaattttgccgatacaaggctgcggatatcgctgagctgtttgttttcgttctcaaaggaatctctgacctgatcgacgatatcttcgtattcatcgatcgatacctcagagatattgatcctacaccgaagcatgaagtcgtccattcttgttttcagatttctgactctgctaactaattcacggctttcacgaagtgctttgccatagttgccacgcttaataaactcttgtaacttgaatcggcttacagaaaagtccaattcgctgtcgatctctttggttctgaaaagaaactcataggcttcatttgtcagaacatagcttccgctttgctgctcgaataagatcagagagccctgttcatggaatttttcgtcatgactatcgaacgtttcaaatcttcgcacttttcctccgctttgcagtacatctgttacgatataatctgtcagggtctttgcctcctccggctcatatccataaatatcggctaattcacgcagaaatactgtgatatcctgcttggtacagcgttcgccatagcgaagtgtattgtccatgataaagaccattaccataagtatgagattatcggttttatcatcatcattatgcaatatttcacggatctctgtgggtttgcttctttgtagccagtatttgatgagattcacgaatcgcatacgtttttcaaaatcttgtaataattctttggaacctgctgagatcattattttacctcatattatctgccagtacgggatatgagagtatctcctgtggcaatcgtttattatcctcgattatttgtgtgatctgcttttgctcataatcagaaaacaagggcaatatccctgacatttcgggaatgatgcgtcttccgtcgctgctgtcagggagccttatgcttcgactcagttccagcattttctgatatgcaggaacgaacaattcaatatgaagctcttttgcttccttgcaaagacgaataaaaatgtcaaaaccagctctgtcaatatctccgcaatacagaaatcttgtttcatcggctcctaaatattgtgcgtaggaacgaaatttttcttttcctgtaatgtcattcccctgaccaaagatcactccgtcgatcttagtatcaaatatcgagcaggctccggagctatacattaagcgtcttatattgaaccagatatccttgttttcgcaaataagcaatgtcattctgtttttacgaacgggaatataatcggaaaagcactgttccggtgtttcgtaaaatttaagcacatcgccagtgatgcccattctttctaatagtcttaaatggtcgtctaattttttctcgtcaccaaatatagaaaaggaacgttcacgtcgggacatcatatcactgcccttgtcatacgtcagccattcacttaatcgaagtaaaaaagccttattttttacaaactgtattcgattgcgaagaagatattcattttttgtcagccttggatggagagcatcgatctcataacgtgatatttgctgtggcttttctatagagatcgtatatctcatatacagtggtattttcagattgccatttgttccactgcttttgacaggagtcaaaatgccctgctcagtaagctcgctgatctgttgggctaactgttcatgatcttgacatattcggtttagctcctccagtgagatccgttttcgagtatgatcctgcagagctttatataacggattattgtttttgctcatactttgccacctctgttctgaattaataacaacatatacatattgtaacatgatttagtcaaaaaaacaagttattattaacaaaaatggtgtgctatatggttttatacgttattataaagtaaagggcagatacctcgataatgaagtatctgccctttgtgattcataactgtaataaaggatctactttggttaatgcgaattattcttctgtttctgtggtcttgatgtgaagctcttcaagctgctttgcatctactgtggacggacaagcactcataagctcgctggcgttctgtacctttgggaacgctattacatctctaaggctgtcggcgttgcagattatcatggaaagtctgtcaagtcctatgcccatgccgccatgcggtggtgcggcataacgataggcgtctacgaggaagccgaactttgcttctatctcttcgtctgtcatgcccagtgcttcaaacattttctgctgaagctcaaagtctgttattctcattgagcctgatgaaagctctgtgccgttgaggacaagatcccacgcctttgcacggacgtttgcagggtcggtgtcaagatagtcaagacactcctccattggcattgtgaatgggtggtgcgctgctacccatgtgtcgttctcgtcatcatactcaaagaatggcatttctgttatccatacaaaattgaacttgccctctgggataacgccaagacgctttccgcagataagtctgagtgcgcccaaagttggaagaactaccttgttcttgtctgcacagatgaggataaggtcgcccttttctgctccaacggctgcgtttatcttctcaaggtcaccctcgccaaggaacttcttgaatgagcagtttggctcgtctgcccagcggatatatgcaagaccctttgctcctattccttttgcgtggtcaacgagcttgtcgatctcttttcttgtgtatgttgccgcaccgcccttgacgtttattgcacgaactgagccgcctgcctcgatagctgacttgaataccacaaagtcgatatccttaacggtgtctgtgatatcctgtatctccatgccgaaacgtgtatcaggcttgtcagagccgtaacggctcatagcgtctgcaaatgtaagtcttggcagtgggagcgttacctctacaccgagtatctctttgaatagcttttcgatatagccctcaatacaagcctgaatatcctcttgatcgacaaaggacatctcaaggtctatctgtgtgaactcaggctgtctgtcagctctgagatcctcgtcacggaaacatcttgcaagctggatatacctgtcataacctgatatcataaggagctgcttgtatatctgtggtgactgtggaagtgcatagaacttgcctgcgtgaactcttgaaggaacgaggtaatctcttgcgccctcaggggtggacttcatcatcataggtgtttctatttcaaggaaaccattgtcatagaaatactctcttgttatctgagcgatcttatgacgggtgatgatattcttctgaagctttggatttctaaggtcaaggtagcggtatttgagcttcagctcatcgtttaccttatctgagtttgttacctcaaatggcgttgtttcagcctttgagagaattctcaggtctgttacggcaacttctatcttgcctgtttttagcttttcgtttacgctctcacgaggacgtaccataccctttgccatgaggacatactcgccttttacaagctgagccttttcaaaaacggctctgtctgtttcatcattgaatgcaagctgtacaagtccagttctgtcacggagattgatgaagataaggttgcccatatctcttactctgtcggcaaagccgcatacaacgacttcctgctcggtttcaggcacttcgccgcagtaatgggtcctgcgtaagcccttcattgtatcaagtttcattttacattacttccttttctgttttttttgttggtctgttgataaggccgtcaatatgttcatatagatcggctttaattgttgcacccataggcgcaagtataaaatctataccttcacggcgtgattgctttgcggcaggaacaaagtcgctgtcgccagctataagtattatctggtcaacctgctttttgaacgaaagagaagatatgtcaattccaacacgcatatcaacgcccttttgttccaaattaagtttaaggtcattgtctgtaaggtcacttattgttatctgtccatttacaagttttttgaaagcttctggctttatgttgtaatgaagtgaattttcagaaagccgtcccattcttagtgcaacctttcttttgcttttaagttccttgaaaaattcgttagtccacttgtattcatcagattttgcaaggtcaacgcttctctttgtaagtggattataaacatttttttcaacaggtgggcaatcatagtaaaaaatacgatataaatatcgctgttcatgctgattatgcaagagcttcatacaataatcgtatagttcatcagctcgttcctttggcgatttttcaccccaaaagtaatatgctcttttgcgataaaagccgccgtcaactaatattgcagttgatatttcacgctttacagtaattatatcatcagctttcatttttgaagatcctttctgaaaataaaaaactcctagcctcgtaaaaccccttatggtggggcaactactactaggagtgcactttcaacaagttgtataaattcttttacactcttagtatactaatatacagtgtatatattgtgatgagattgtgaataaatcctgaatattatttttcgctttcgtctgttttgctgacggcaggcgggaagctgtcgagataggctctgacgaacttcttcttgttgtcccagaacatgaggaacaatcccacgagccatattgcggcaaagcatactgcgcctgttttctcttccagtgccacaagcataagggtgaggaaaagcacaagcaccgtccatatgacgcccacaacataggcatagataggctttctgaacttgccatatatcctagagccgttgggggtcttttctaccttgccataaaagcctgttgagcctccgtcacgttttttagcggtatggtggaatatctgaaagctttcggcgtctgtgcggtagccataaaaaatggtatcgtcacggtggtttttcatgaacttgctttgggagagaatgtttatggtgggtctatgctcgataaggtcgccgtcaagctttctgagaactcttttgggcgaaagtgaggtctccacctcataggtcacgggtcttattgcaagcattatttatcttcctttttatcgggataatcagcagggtcaaagaccttgtcgtttatctttatctgtccgcctgtgtgggtgttgcagagcataccatagatagtgccgcattttgtacacctgaactggtggaaaagcttttcagcataccacttgttgtcgttatccattatcttatcaagtgggcaggtctgataggtcatttcaacttcccctgccagcagcattcttgcaagagaacctatgcagagcatatattcctgcggagtgtgtatttctaccagaggtattttctcgcactgttcacatctcattgcttagttctcctttccgataaatttctctatatcagcgtcgatatccttgaacatatccgccataagtgcgtttgaaaagttctcggcaatggtgttgtcaagcctgatatctgtctgctcgcctgttgccatgtttttgagctttgcaacgcctgattctatctcgttgtcgccaagcaccataacgaactttgcacctgttttgtttgcatacttcatctgagcgttaagtcctttgcctataaggtcatattctacgaaacagccctcttctctaagctcggaggctatgcccattgcctttttaagggcgtcctcgcccattggtacgatataaaggtcgcaggtctttggctccatatagtcgcagccctgagcgtccattaccatgagaagtctttcaagaccaagaccgaaaccgagggcaggggttggctttccgccaagctgctcgataagtccgtcataacgtccgccaccgcagactgtgccctgtgcgcctatctcatcggtgatgaactcgaaaactgttcttgtatagtagtcaagacctcttactatcttagggttgatgtcaaactcgatacccattacggagaggtactcctgaagcttctcaaagtgttctttgcaatcatcacagagataatcgaggataacaggtgcgtccttgccaagctcctgacagtgtttgactttacaatcaagtattctcattggatttttgtcaagtctgtcccgacaggtctcgcaaagctggtcttttcttgcggcaaaatactctttcagagccttgcgatattctgcacggcaggttggacagcctatggagttgatattgagcttgatgtttctgagtcctgctctgtcaagaacgctttttgcaagagatattacctctgcgtctgctcttgggctttcagatcccaccatttcacagccaaactggtggaactctctgagtctgcctttctgtgtattctcgtgtctgaaacatgagagaatataatagaccttctgcggcagaccctcgttgaggatgccgttttcaagaactgctctcattgcgcctgatgttacctccgggcggagtgtgaactttgagtcgcctgctgcggaaactgaatacatctctttctgaacaacgtctgttgtttcgccaacagaacgcacgaaaagtcctgtttcctcaaaagttggtactcttatttctttgaagccgtatatttcggcagcttcggaaactatcttctctacagtgtgccacttatagacctttgagggaacgatgtcctctgtgccttttggctttttaactatcaatgccatataataacgatcctttctgtattttgtcttgaacttttgaataccgatatcgtttaaatagctgtgatatcgggacgttgttaataaacgggcgaacactgttcaccactacattaaagagccttggtgctgtaattacaacgtttcaaatttcaaaatcgtcaataaaacctttttttatataataaccgaatttaagacattcgtcaagtgctgttgtgctgcctttttcggtcattgaccaattatttcgctgtgtactgccacggctggcaggacaggggataattttctgtgtgaaaaagtgctgtgcaagcatggcggcacgccgcatatgataagcggtggtgacgactatgatgcttttgcagtttggaaaatgctctttaacaagcttggctgcgttttgcagattttccacggtatcaagagagtgtgtttccacagttatggcggaggtcggtatgccgcatttttcagcggcgatgagcatggctttatattctgccatgtcaccaagggaagtcttttgcacttttccgccgcaaaatatgagatgtggggcttttccctcgtgaaaaagctttgccgcaaggggaacacgatagtcgcaggctttgcggcttcccagaactattataacgtcggcagtttcgcctttatagtcaagaccctcgaaaagaagcttgtctactatttcgggggtgatgttttcttttgttagctggctggctttcattgttataccgcctttgctttttggtgtgctgagaaaaggtattcgagagtgagtgaagaacgaaaaagcgggatgtcgcatttctgtgaagcagaaattgagccgctcccctacgagtggtggacaaaaaaataaagccgtcccctaataagggacgacttttaccgtgataccaccctaattatccgaacatcttcgtgccggatcactctaacgctttaacgcagctatacgtccgctcttgaacaaacggaagctccaaggtgtccttcttcctgccctttgtgtgaaccctctcaccaacggctctcgctgaaacataagaacggaatactctccctttcatcgcttttgtatatgaaatttcaattatatctttgtaggattaacgatatctctccagtcaagatcgcctcgctcaagtgcgtggataagcgcttcggcagtggcaatgtttgtggctaccggaatgttgtgtacatcgcaaagtctgaggagattcatatcattaggttcgtgtggcttcactgagataggatctctgaaaaacagaagcaggtctatctcgttacaggatattctcgctgcgatctgctggtcgccgccctgtgagccactgagataacgctgaacgttaaggcctgttgcttcggctaccatttttcccgtagtacctgtggcacaaagattgtgcttgctgagtacaccgcaataggcgatacagaactgtaccatgagttccttttttgtgtcatgagcaataagtgcaatattcaatggaaaccccccgtttatatattagtgtattaatgaacaaataagtttcgttatataaaacagccgcactatgcgcagataccctcacgcacacggctgataatatactcagaccttgatggagaggggtatatgctcgccctttattcttcttgaaatagcagagaatgcaaggaagcccatagagcttgatgaaagcggcgcaccctttcctgttgcaagagggatagcactgtcctcagggataacacccagaagctgaacgccgactgtgtcgatgatagcgtcaaggtcgtccatttcgtcaaactcgaatattctcttgtttgccttgttgataacaagtctttgcttctgatttcctctcttatagaactcatctgacatcattctagcatctcttacacaaacagggtcaggagttgtaactataagaataaggtcggaattagtaactatatcaaatacagaaccgttgatacctgcagaggtgtcaatgattatgtattcaaaatactttctcatttcctgtgtgatcttttcgatatcctcagccttgagctgaacgaacgggtcggacggagcacagagaacgctcaggtttgaagcaagcttaacagttgttgttgccttgtatacgtcgcaagtaccctcaagaacgtcacctagatcgtatgtaatattaccctgcataccaagcatgatatccatacatctcagaccaaagtcaagctcaattataagtgtacggtttccctgcttagcaagggcataaccgagacaggcgcttatagaagatttgcctgttccgcctttaccggaagtaactgcaataatttttgacataaaactcattgctcctttcatatatcaatcctgcggctgaccgcagaacgcatcagcaataatagcttgccccttcacagccgtgaaaaggcagatttaagaaaacgtttcagtaccctccgcaggcaatgcggagaagcatagcgttacctaataatattgtaccacatattttgaaattgtcaaagacatttgtacaaaaaaatacaaaatcgttaattcacattaattttcacttttatttttgttaattttgcacaatgccatatcagtgctacagagtttgtaataataaatcatagcaaaccgataaatttattatacgataatattattaatgctataaaaattatttttgaaaattatataacaaaataaaaaatcggacaggtagttataattttggggacaacacatataaatgtacaaactttgaaataagaaagcgaggaaaagggtatgtttatcaagacaataaaagtaaaaaagccaacatttgcggtgattggggcggttcttacggcgttggcactgttggcggtgataatagtgacagtggtgagaatatcgtcgcctgcggtgtacgagatgaaaagcgaagcacaaagacaggcgtttttgaaagaaatgggctgggaggtgtctgacgaatacgatgaatgcaaggcggtgaccataccgaaagaattcaatgaggtgtatgaaaagtataataagcttcagaagcagcagggctttgacttggaggactataaagggaaaaccgctgaggtgtatacatatgctgtgaagaattatgggaaaaagaagcaggaggtcagggctaatcttatcgtctgtgagggacagcttgtgggaggagatgtatgctcagcggagctggacggatttatgcaggggctgaggaaaaagtaggcgtctgagcgtggaacgtcggctttatgaataagggtaaactaatgcttcataggtcgaaaaaaacgatacaaatagtaataaaacgcctgtggagcatatctgcaggcgtttgcttttggtcaagttttttcgcatatttgacttttggcggtatcgtatgctataatctttataagaaaattgtcagaaaggcttttgctatgagacttgataaatttgtttcttcacagcgtaatgatatttcccgaagcatggtgagagagctttgcagaaaaggtcaggtgactgtaaacggaaaggtcgccaaggcggctgatgctaaggtcagcgaaaacgatattgttgctgtaaagggcgtggagatatgctataaaaagtttgtctacataatgatgaacaagccgcagggcgtggtttgctccactcgtgacggagagtcgaaaactgtccttgagctagtacctcctgagatgttcagggagggacttttccctgcgggcaggctcgataaggatactgagggctttgtgcttctcactgatgacggagccctcgcccacagaatgttgtcccctaagacccatgttccgaaaacctatttcgtcagacttcgtgacccttggcaggaaaattatgttcaggcattcgccgagggcatgactatcgacggcggagagaaatgtctgcctgcggaattttccgcaagtgtgaactgtcccgatgaatgtaccgttgtgcttcatgagggtaagtatcatcaggtcaagagaatgtttgaaaagctgggaaataaagttgtttttcttaagcggataaagatcggagaactgcctttagatccggacctgcctcttggaagctgtttagaaataatgcacaaagatgttgaaagattattgacagcgaaatcgtttaaatgtaagtaattacctattctatgtgaattttcgtcaatattcataatgagatataataaagtttagtaaaaaaaactcttgcgggtatgttaaaaatttgttatgataaaagcatagctaattaggatattagtaaaattcaaatagggaggtccttttttaatggcaagtgtatcattaagggaaatttataagaagtatgcaggcggcgttatcgctgtttcagacttcaacattgagatcaaggataaggagtttatcatcctcgtaggtccttctggttgtggtaagtctacaacacttagaatgatcgcaggtcttgaagagatcagtgaaggtgagctttacatcggcgacagacttgtaaacgacatcgctcctaaggatagagatatcgcaatggtattccagaactacgctctgtatcctcacatgacagtatttgagaacatggcattcggtctgaagctcagaaaggtaccaaaggacgagatcgcaagaaaggtagaggaagcagcaagaatacttgacatcgctcaccttcttgacagaaagccaaaggctctctccggtggtcagagacagcgtgtagccctcggtagagctatcgttcgtgagccacaggtattccttcttgacgagcctctttcaaacctcgatgctaaactgagagcacagatgagaactgagatctctaagctccataagaagctcggtactacattcatctatgtaactcatgaccagacagaggctatgacaatgggtgaccgtatcgtagttatgaaggacggttacattcagcagatcgacacaccaacaaatctttacaacgatccagtaaaccagttcgttgcaggattcattggttcaccacagatgaacttcatcgacgctaagcttctcaaggtagacggcaagtatgttgttgagttcggttctgaggatacaaagacaacaagaggcgttaagtatcaggtaacagttccagagtctaaggtagatcctgaagttcttgagccactggttgatcaggaagttgttcttggtgttcgtccagagtgtatccacgatgagcctgcattcctcgctcaggctacaacaggcgttatcaacacaactgttgaagtaactgaaatgatgggtgctgaaacatatctgtacctcaactgcgagggtatccagcttacagctagagtttcacctcgttctgacgttcgtccacaggatgagcttaaggtcgctatcgatcctaacagaatccatatcttcgataaggaaactgagaaggcagttcttaactaataagaatttttatcatattgatataaccaaaaagtacggctttgtccgtactttttgtgttatatgcggtatgaaaccgatttcgttatcatagattagaaaggtacaaataatgaatacaaaaaaaatgttggcagtgcttgtgagtgttgctatgtgcggagcagcttttgcaggctgcggaaataatgcggacagctcaaaggctgaaagcaaagcggagtcttcaagctcgcaggtcgaaaaaatgcctgaaactgacgaggagtggacgcaggctatgtatgacaaggctatggtgtcatacggcaacacttctatgatgcagaatgttataaagaaagcacagtcaggcgaaaaggtcactgtggcgtatcttggcggctctatcactgagggtatttctgccggtgcagacggctgttatgctaagctcacttatgattattttgcacagaaattcggtacgggggataacgtccagtatgtgaacgcaggtcttagcggtacgccgtctaagcttggaatactcaggctcgacagagatgtgttggcttatgagcctgacatatgctttatcgaatttgcagtaaatgacggcactgagactgactatcagaacgcttacgagtccatagtcagaacgcttttgcagaagaatatcactcctgttctgctgttctcggtgacagaaaacgaccattctgctcaggattatatgaagcagataggcgagttttatcacctgccgatgatatcatactgtgacgcactaagatatcttttcgcaaacaacagaatgacttggaaagatttctctgacgatcagtcacaccctaacactgagggtcacaagcttgtggcttcaatggtggactactattttgacactgttatggacgttgcgccagagggcgattatgttatgcccacagacactgttttctctccgcgagaggtggacgctcatatgtatgagggcgacagccttacgccaacaagccttggaagttggaaggaaggctctactatcgcaagcttcacaaatggctggacttacgacaacaccggagataacagccctatcgtattcgacttcaaggacaaaaaattcttgtacatgatatacaaagaggtgaagcagggcgagttcggcaagcttcatgttaaggtaacagcagacggagaggtgtatgacgaaagcgattacgataccataagcccgtcaggctggggaaatgctcagatacagaatatcgccatgatgcctgaagcaactaactataccgttgaaatatcaatggcggcaggcgatgaggataagcatggagaagtgcttgcctttggctatactgaatagctgtttgaaattttagcaaaaataataaggcagatggtttttttaagcggctgtgggaacggcttgctctggaaagccgtctgcctgtttttttgtgtatttatgtggcgttatgtacaaataagatgacttcgatttgtgagtgtatacaagaatttgaattaatacgcaaataaagaaattatcccctgttcattttcaatttatttatattttggtgctataatgacttgtgtaaagatacataagtggaaaatgtctttgtatatttgatcttatatgaaaatatgaacatgtatggcagatagcggaaaggtgatatatatgataaaaatgaaaagaatatttgcggcggcttctgccgttgtaatggcggcgggagtgttcgcttcctgcggaaatgcagacagctcttcaaaggctgaaaatgtcggaagctcccacgttacggaaaaaggcgagatgcgtgatatttcttctatggaccttgtgaaagaaatgaatttgtgctggaatttgggcaactcccttgacgtgtgcaacgccgaccgtgacggtgacggtcaggtggacgaaaattcagagaaagttgacgaaaccctgtggggaaatgtgaaaactactcccgaaattttcgaccagctcaaaaaggacggcttcaacgcagtgagaatacctatcacatggcgtgaccacctgtctgacgattacaccatagacgaggactggatgaacagagttgaagaagtcgttgattatgcttatgacagagatttctatgttatcataaacgttcatcatgacggtggcggtgaccctgacttcggtgcatggataagaacggaagccgaggctgattacgaaaacttttcaaaaaagtataacaagatctggacgcagatagcaaagaggtttgagaactattctgataagcttattttcgagtccatgaatgaggtgggctttgacgatatgggaacaaatcaggcttacgaactgctcaacaagataaatcaggactttgttgaccttataagaaaacagggcggaaacaatccgaaaaggcatcttttgatagcaggctattggacggacgtggaaaagacttgctcaaagcttttcaaaatgcctgacgaccctgaaaataggtgcatagtttcggtgcattattatacgccttgggagttctgcgtttgcacaaatcagtataactggggaactgagcctgagataaaaacaatggtcaataacgtgaataagcttaaaactacatttgtggataatggcatacctgttattgtgggagagtatggaaactgcaaaggcaatgacgaggtggacagagtgttttttgacgagtactttacgaagctcacacatgacattggcataccggcattcttgtgggacgacggcggagtgtttgatagaactgatctcacttggcaggaagacggactgctggacgctttgcatagagcggtgagcggcgaggagtatattgtagaacgcattaagtgagggttataagtgaggagtgaggaatgaggaatgggcatagctgaccagagtaaagaccaagcatgaagtaaaattcagaaccgagcgtagcgagcaaaaggaccaggggcacgcccctggtcagggtcaaggggtgaaaccccttgtgggtacagggcaaagccctgtcagagcttgaggcagagcctcaataggcgtagcctacaagcggtgcagaaaaaagttaaaaagcatataaaggtaaagaacaaaacaaagcggtgtcggagcaaaaactctgcaccgctttgtttctatcccatagcgcaattgtaggggacggcgccctcgacgtcccgcttcggggagttgcgaggtttgagcttccataaaccatgtgggtgaactaaacgggcgaacactgttcgcccctgcattgttcgtgcgttgtttcgcaaattgttgtcaacaataagataacaaaagttgtgtcattgtcacagaaattcgtgaaatcagggcggattaactgcatttttgcgtattgcaaaaatcaaaaataaatgttataatcagttgtgtatcactattttcagaaaggcaggcggataatgtggcggaaaagataagcgaaaaaatacaaaagaaaaaaccgaaaaaacttataaatatgatattctcacagaaaaccactattatcctgcttcttgcattgcagcttattttcatttttatcatcttccaaagcttcgctgtgcattatgcctatctgcatatcgttttttctactgtggctatcgtgcttgctatctatatccttaacagcagcgagaaccctgcctataaattggcgtggatagtaccccttgttatcgtgcctatctttacggtggtgctttatatattactcaaaaatcagttttcaacaagaaaggtcagaaacctttatgctaagaaatccgccaatacaagacctttccttaaaacaaatgaacagataatgagctatctccatgaaagtgagcctgatttttataagcttgcaaactatgtggataagtcggggggctaccctgtctgcggtaatacggaggtcacttattttccccttggcgaagataagtataaggctatgcttgaggagcttcagaaagctcaggagtttatctttatggagtattttattatcgacgacggtgaaatgtggcgtgagatagttaagatacttcttgaaaaagctaaggcaggcgtggaggtaagacttctttatgacggcatgggctctcagttcactttacctttcagatataagaaaaagcttaccgaccaaggggtaaaatgccttgttttcaatcctttccgccctatgctttctactatacagaataatcgtgaccatagaaaaattcttgttatcgacggcaacgtggctttcaacgggggcgttaatatcgccgacgagtatataaaccgcaaggagcgtttcggtcattggaaagataccgcagttatgctaaagggcgacggcgtttggaattttaccatgatgtttctgcaaatgtgggaggtcatctcaggtgataaaactgagtataatatgtaccgcccaactgtaaaaaacgttgtgaacaacggctatgttatcccctacggtgactcccctctcgatgacgagaatgtgggcgagcttgtctatatgggtatgataaacaatgccaaggattatatctatatctctaccccgtatcttattcctgacaacgaaatgctcaccgtcctgggctatgcggcaaaaagcggtgttgatgttaggataatcactcctgagatacctgataaatggtatgtgagcgttataacaaggtctttctacagagatcttgaaacgctgggtgtgaaagtctatgagtataaaggcggctttaaccacgccaaaatgttcctctcggacgataagtcagccgtggtgggcacgataaatctcgactacagaagtttgtatctccattttgagtgcgcaacttatatgtacaaaacaaattgtataaaggatataaaagcggactttgacgatatgtttgaaaaccgctgtcataggataactcatgacgatataaataaccgcagcttctggtcaaggttcatgtcggtcattctcaggaccattgcgcctcttttgtaaaaatgtattttacgaggtatcaggggaaaaataagcctatctttgcttttgcatagcttggagggcttttatgatacttctgaataaattgttttcgaccaaaaaatctgcaaagggcagagtggactatcctctcttgcttctcggtgcggtcatatatggcgtgagcgttgggctggttttaagccctaacgaaattgcccccggaggtgcttcggggcttgctgtcatgttgtcaagatttctgcctcttggcgtcggctcgcttacaatggcgataaatcttcctttgttggcggttagcctttatgtgttcggctggcgtttccttttgggaactgttgtagctattgcagtttcaggtctgactgcggatatgtgtacgctttttacaccactcacaaatgatattttcctcagcgcaatagcaggtggtattctgttgggcgcaggctgtgggatagtttttcgttcagggggaacaacaggcggaactgatatcgctgcaaagcttatcaaaaggaaaaagccctacatggcggcaggacagatctttatgcttgcagacggtgtgatatgtgtgctcagcggttttgttttcggcagtatcgacaacgcactgtattcgttctttacactgtgggtgttctcaaaaacgctggatatgatactctacggcggcgacagaggaaagcttgcgctgataataagccctgccgcagataagatactccataggcttcttaatgagggcaacttggggtgtacggtcataaaagcccgaacgggatacacgggagaggacagagatcttatactttgcgcagtgagaaaacgcaggataacggatgttcgcaggatagcatcggaaactgacgaaaaggctttcgtgcttgtgggtgacgtgagtgagataataggcgagggcttcaggctctctgatgaatacttctgaaaggacattacaatggacataaaagattttaagggacacattttcgacttggacggcactctgacaagatcaaatcacgtttggtcaaagatagacgaggattttctcggcaagcgtgggataaaagtgcctgaggactatttcaagcaggtgtctgcaatgaatttcgagcaggcggctgtttatacaaacgatagattttctctgggtgagaacattcagaatataatgaaggaatggttcgatatggcggtgtatgagtatacgaacgttatcgagctttgcggaaacgcaggggagtatgtgcgaaagcttaaggaacagggcaggaagatagcattggcgaccgcttcaactgaggagctttataagcctgtactaaagagaaacggcattttggatcaatttgattgcttcgtgtctacagagcaggtggagaggggaaagggctttcctgatgtttatgagctggcagctgaaaaacttgggcttgaagtaaaggcttgcgtggtctatgaggatatagtcgagggcataaagggagcgaaagcaggcgggttctttgctgtggcttgcttaaatgaccattactcgcatgactgggacgagatgagagagatcgctgatgagatcgtggagaatggggagtttccggtttaatgaggaatgaggaattaggaatgaggaatgaggaatgggcatagctgaccatagctgtgccccagcaccgagcgtagcgagagataaaacgcaggctcaagcccggcgttagagggcttgtgggttcttagggccaagccctaagcgaagcttgaggcagagcctcaatcggcgtaagccgaccaagcggtgcagatttaattagaaaaagcacgcaaaagtctgatatcaaataaaggtaatatcggagcaaaaatctgcaccgcctaccctatccctaagtaaatgtaaatccgcaaagagcgtagcgattttgcggcatggcaaatttgcccgaagaagctgtaggggctggcgccctcgacagcccgtttctggaagcggcaaggtttgaatttatacaacccatgtgggcgaccaaaggtcgctcctacaaaaaaatcatcgccgcaaggcgataccataattcctcattcctcactcctcactcgacaaacgataaaatttacaaaaaattaataaaattccttgacaaatgattgacaaagaagaacgcagatgttataattgtagtacctctttatgaggtctatttttttgcgctctttttttgagcgtgaaaaagcataagttacctcagggctgtgtgacagcttgcgtgaaaacgtatgagggaggcagacgtaccctgaatgttcttgcggggtataaatttcgtcaggaggtgccgaaatgagagtaaaaattacacttgcttgtactgagtgtaagcagagaaactacaacactaagaagaacaagaagaatgaccctgacagacttgaaatgaacaagtattgcaagttctgtaagaaacacactcttcacaaagagactaagtaatattgaaaggagctatttctaatggctaaaaaaacagatgttactaagtcttcaaaaaaggataccggcaaggatcagaagaaaaagggcggagtaagaaaatatttcagagagcttaaagctgaaatgaaaaaggtcgtttggcctacaagacagcaggtgactaagaatacgggagttgttctctcggtaatggtcgttatggctctgttccttttcggcgttgattcaggtctgggtgcagctatcaaggctatccttaaaatcggcggctaagccgtcacagcggttttgacaacatcaatatggaggtaagaaacatgtcagaagaagcaaagtggtatgttgttcacacttattcaggttatgagaataaggtaaaaagcaatattgaaaaggttgttgaaaaccgaaaccttcaggatctgatccctgaggtaatgatcccaatggaggaagttaccgaagtaaagggcaataagatcgataagggcgacagaaagctttttccaagctatgtgcttgtaaaaatggtgcttacagacgattcatggtatatcgttagaaataccagaggcgttacgggcttcgttggtcctgcgtcaaagcctgttccgctgaccgataaagaggttgcagcgctgggtgttgacacacagagaagcgctaacgttcaggtcggcttcaaggaaggcgacaacgttgttgtaacagcaggttcattcgagggcttcacaggagttgtggagaaattcgatatggaagcacagacggcagacgtcagagtatctatgctgggcagagaaacaactgttactatgccgctgacacagataaagtctgaggaataaggaaaaaggcggtaaaactccgcaaacattcgtgaaaatggaagcaaagccgtcaatgacggttcggatatacggcttccggaaacgtgggagagcgtatggcgctcgccttaccacttaattatggaggtgcgaacaaatggcacagaaggtagtaggctatattaagcttcagattccagcaggaaaggcaactcctgcaccaccggttggtccagctcttggtcagcacggtgtaaacatcatggcgttcacaaaggattttaacgagagaactaagaacgatatcggtcttatcatcccagttgttatcacagtttacgcagacagatcattcacattcatcaccaagactcctccggcagcagttctcatcaagaaggcttgcaagatcgagtcaggttccggtgttcctaacaagactaaggtcgcaactatcacaaaagagcagcttcagaagatcgctgagcagaagatgcctgacctgaacgcagcaaacatcgagagtgctatgagcatgatcgctggtacatgccgttcaatgggcgttgtagttgaggactaatcaatcgtactgtgcattcgtgcacggcaatggtgggaggaattttccgctaaccgactagatatccactgtcggtattaccacttaatgaggaggaaatattaatgaaacatggcaagaagtatgttgacagcttcaaggctatcgacaaggctaagcaatatgacgctcctgaggctctggaacttgcagctaagggtgctaaggcaaagttcgatgaaactatcgagcttcacattcgtctgggcgttgactcaagacacgctgatcagcaggtaagaggtgctgttgtacttccaaacggaactggtaagactgtaagagtttgcgtattctgtaaggaagacaagtacgaggctgctaaggcagcaggcgctgactatgttggcggcatggatctcgttgagaagatcacaaaggaaaactggatggatttcgacgttgtagttgcttcacctgacatgatgggtgttgtaggacgtcttggtaagatcctcggacctagaggacttatgccaaacccaaaggcaggaactgttactccagacgtagctaaggctgttacagaggctaaggctggtaagatcgagtatcgtcttgataagacaaacatcattcactgccctatcggtaaggcttcattcggtgttgagaagctcgagcagaacttcaacacacttatcaacgctgttgtaaaggctaagccagccgctgctaagggtcagtaccttaagagcgtagttgtagcttctacaatgggccctggtatcaagatcagcactgctaagtacggcaactaatctgataacagataaatattgaatttttaagggacttgtgctaaatgcataagtcccttttttatatattcccacaatttgaaccacccatgttcaaatatttgcattatcaagaaaaattaacaaaataatttttaaagtaatcgttttaccctgttgcattattttttctatgtgttataatatcaattgagccgtaaggttcagatttttgcaaggagtgataattatcaatatcttttataatgaaaaagataaggctttcaagctgagagccaataatacagactatatgatgaaggtctgcgaggagggctacctcgctcacgtttactatggaaataaagtccctgacgaagatctgacgtatcttctccgtcttgacgaaagcccttttacccctgccactaacgaccgtgacagagcaagctttatggatactctgccttttgaatatccatgcttcggtcttggtgattacagagagtctgctttcaaaataatggacgctaacggtatgtcgacctgcgacctgagatatgtttctcataaaatgtatgagggcaaaccaaagctcgagggtctgcctgctactttcgctactgaggaaagcggttgttcaactctcgagataacaatgtatgataagtatgctgatatcgaagtcgttcttatctacacagctttccataagcttgacgttatcacacgttccgctgttatcacaaacaagagcgaaaagccgttcaagataacaagagccctttcagcttgcgttgattttgatacagacaaaatggatatgattacactcaacggctcatgggctagagaaagagctgttgaaagatgcagacttcaccatggtaaacagcttgttgattcctgcaggggcgaatcatcacatcagaacaatccgttcgttgctctttgcgacaataacgctgacgaggataagggcgaggttttcggcttcaactttgtttactctggaaacttctatgctcaggcagaagttactcagcataagaaaactcgtttcattatgggtataaatcctcttgacttccagtggcttttggaaaagggtgaaagcttcacctgccctgaggtagtaatggtgcactctgacgagggtataggcaaaatgtcaagaactttccatgacctctatagaaataaccttatcagaggcgagtataaggataaaagacgtccgatactcattaacaactgggaagctacttactttaatttcgataccgacaagcttatagatatcgctaaggaagcttcaaagcttggtatagaaatgctcgttatggacgacggctggttcggtcatagagattctgataactcatcactgggcgattggtttgtttatgaaaagaaactcaagggcggtcttaaatatcttgttgacgaggtaaataagcttggcatgaagttcggcatttggttcgagcctgaaatgatatcccctgactctgaactttataaggctcacccagactgggctatccagataaagggcagacctctgacactttgcagagagcagtatgttcttgactattcaagaaaagaagtcagagatcatgtttacggcatgatgaagaagattctcgacagtgcgaatatcgagtacatcaagtgggatatgaacagacagcttacagaggtcggctcggctaccctgcctgctgaaagacagagagagctttggcacagatatgttctcggtgtttatgaccttatggacagacttactacagattatcctcatatcctgctggagaactgctcaggcggcggagcaagatttgatcctggtatgctttactacagcccacagatatggtgctctgacgatacagacgctatagaaagactgaagatacagcacggcacttcaatgtgctatccatgcttagcaatgggtgcgcacgtttccgattgccctaatcatactgtcggcagaaacactccttttaagacaagaggtcacgttgccatggtgggtacgttcggctatgagcttgacgtaacaaggataccgcaggaggacagggacgctatccctgcacagatagaggagttcaacaagttcaacaagcttgtaagaacaggcgaccactacagaataggcaatatgtttgaggacaacacatgggacgcttgggagttcgttgcaaaggacaagagcgaagctctctttgaattcgttcaggtgcttggcagaccaaacgaaagatcaagacgtatcaagctcaagggtcttgaagctgacgcttactattatgaggagaatgagcctgacaaaaagatatcaggtgcggcacttatgaatgcaggtatcaacatcgcaaagatgtggaacggcgacggactttacggcgacttctgctcaaagatacttcattttataaaggtgtaagagcaaagcgtttatcaaagttgtggtaagtttagataaatacacaaaagactattgacaatttgaagatattgtagtacaatagttgtgaaataagttcaaattttaaaggtggagttcttccacctttaaataacacagagatgtaaacgaatacaacttgtaaggagaatttttatgaggttaaaaaagctaatggcagtggcttgtgccgccgcccttacagtgacagctttcgcaggctgctcaaaaaagaacgattcctccagcggctctgacagcaagggcgacgctaagaaggagtattacaacgctcagcctgttgacactggctgggagtggggaaatgtcgagatagttgacggtggttttatccctgacgtcatctataaccctactgaggaggggcttatctacgccagaacagatatgggcggcgcttataagtataataaggatactcagcgctgggagtgcataacagattgctttggtggcgacgattggaactataacggaacagagagccttgcaactgaccctgttgagccaaacagagtttatcttgcggctggtacatactccacaaacaacggtgcaatatttgcttctgacgattacggcaagaactggactatctgcgaaatgcctttcggcatgggcggtaacgaggtcggaagaggctgtggtgaaagacttcaggtagaccctaacgataactctatactttacttcggctcaagagctgacggactttggaagtccacagactatggcgcaacatggaacgaggtcacttcattccctacaaagggcggatatactgaagacggatattctatcggacttacattcgtggcattcgataaatcaagctctgaaaagggtcaggcaacaaagacaataatcgttggctcagcaggaacacagggggattatctctatcgttctgatgacgcaggcgaaacctggacagctatccctaatccaaagtctgaggctacaggcgacaagaccgagaagctcaagccttgtcagggcgagatatcttctgacggatatctctattcaacatggtcttataaggtaggaccaaacggtgcttctgacggagcagttcagaagtataatcttaaaacaggcgagtggacagagataactcctgagagatcttatacttgcggttacaatggtatctcagtaaaccctaacgaccctaacatgatagtatgcacaactcttgacctttgggcatattacgacaaccttttcgtttcctatgacggaggcgaaacttggaacggcatttggggcagtgacgagaacggcaaagaggtaaacaactttaatctcgatataagcaatgctccttggctggattggcagggacagctcaagccgggctggtggatgacaggtgttgctatcaacccgttcaacccagatgaggttctttacacaacaggtgcaactatcttcggcacatcaaatctttcaaagataaaggacgagcctgttgacataagcgtaaaggcaatgggcattgaaatgacagctatctttgacttcgtttcacctctcgataatggcgagggtactcctgaactttattctacaatgggtgacctttatggcttccgtcatgatgatgtaacaaaagctccgcaggagcattatggcgacttcaaggcgacctctatagattgtgcggcacaggattataagatagtagtaagagcgacagacgatggtgacggctcggtttactattcaacagacgcagccgaaacatggcaggcagtggaaacactcccggagggtgttgagaagaaagcaggcggcacagctaagctttccgctgacggcaagaccattttctatcagagcggcacaacaggcgttgctgcggcagtaacaagcgattttggcaaaacatggactacctgcgagggacttcctgccggtgcagttattgaaacagataaggtaaatcctgataagttctacggctcatatgacggaacgttctatatgagtacagacggtggaaagactttcagccctatcgcaaatatgctcgtttcagcaacatcaataaaagcttgtcctgataaagagggcgacctttggatacctgtaggtgcgggcggagtttactatcttgactcatcaacaggcactctcgctcctacatctcaggacgttacactgtgcgatgctattggcattggcaaagctgaaaaggacggcgactacatggcactctacatgatgggcgaggcaaacggcgacggctacggaatctaccagtccaccgacaagggcgtaacatggaagcgtatcaatgatgacacacagaagtggggcaacgttagaaagataatcagcggcgaccctaaggtatacggcagagtttatgtaggcactgacggacgtggtatcattatgggaaacgttaagcagtaatacattataatatagcgaaaaagagcggtgcagatagtgccgctctgtttttgtctttgcccgaatgtcaggcgtttccgcatcttgcataagtgaataaaatcggaagtgcaaatttgtgtattgttatgataaatcttaaaatcatcttagcaaaattacaaatgcttgcatttagtgcggatttttgttattatgttactgtaagaccagatcagaagatacagacaacagaaaggggtgcttaatatgaacgatgcaaataaagaaacaaacgcagcttatgaagggccgaaaaagaaggtgtatgtgaaactgttggtattccttgtgctgataactgtgatagttgtcgttttaggggcaaagttcgtgtcgttttattacaaaactcacggcattggaggacgctatttttataagggctgtgatgcggaggtagtccaccaactgcccgaaggccttaccgacgaggatatctctaatgcggtgataatggttaaatatgataacggctttgatcacgaatatacgaccgccggcgaaagcgacttctttgttgaaacacactatttattaggtgtgcagaatatcgacaataaaaattgcaaggtctatctgctgagcgattgtgggcattataaggacagcgtgttgcaaagcggcagtcttgtggtgaaaatgatagattttgaaaagcagaaaggtcaatgggtgggtgattatctgtgggagccgagaggcggagcaatgtatgaaggctcgatcagggaaactatcccctctgagctggccgatattatattcagcgatgaggaaacagagatcaaaaagaagatcatcgctgaaacggaagaaaaggtcaaggtgtactataatactgacaaagtggcgtaatataaactttgtataacatgatacagcaaaatgggacgtcgaggacgctgtcccctataccattcctcttgtaagggcgacctgtgatcgcccgttctttttgcgatagcaaaattattgcgataaatagtagcattttaccctgctaaagccccgaaaaaccgacttttataacgaatatgaataaaatgtagcggcaaatgatactcatagtgaaatttgtgcaatgtgcatataaacgcgttgagaagtaggtgaaaattctatattgtaatttgtctgtaaccgcttgcaaatggcttgaaagtagtgtataataatacttgcgtgactgcacagtgtatttaatgtacacgatgatgatatgcgatgaagcggaaggttgctgacagttggtcaggtaatttccgtggagtatgtccgattttaaaccgggcgactgttaataccgaacacagtatgtgcttatgcttcttgcgatagcggataaggtctgctttagcgtgagtatgtgtgatgctgtgtgcgctgttttctgagtccgaaagccttgtgggtttcggaattttttatgagaatggcagggaacacacggcagagtgtaaatgggtatcaacagaaagcttttaaagctcgaacctgtcaattgcgtaagcgattggcacgcctcgatcatttacgcaattgactaaggcttgagtgaaagaaagctgccccctaaacttttttaatttgcacaaggaggcgatttaagtggcagtcaatgaaaagatcagaatcaagatcaagggttatgagcatgcggttgtagacgcagctgcagcaaagatcgttgaggctgttaagcgttcaggcgcacaggtttcaggtcctatcccacttcctacagacaaagaggtaatcacgatcctcagagctgtacacaagtacaaggatagccgtgagcagttcgagatgagaactcacaagagacttatcgatgttctgagacctacaaaggaaacaacagcagctcttgaaaatcttgaacttcctgcaggcgttaacattgttatggagatcaagtaatctccaaatgagatcgcgtgcgatctcaaaaaacatttaacacgcaggtcacgtcggacaagtccgaccaataaccacataggaggaaaacataatgcaaaagggaatcatcggtaagaaaatcggtatgacacagattttcgatgaagcaggaaaagtaattcctgtaacagttgttgaagctggtccttgcgttgtcgttcagaagaagacagttgagaatgacggctatgaggctgttcagctgggctatggcgacatcagagcgaagagagtaaacaagcctcttcagggtcacttcaagaaggctgacgttgcaatgaagagaactcttaaggagttcagacttgctgacacatcagctcttaatgttggagatatcgtaaaggctgacacatttgctgcaggcgacatcgttgatgtcagcggtacaagcaagggtcacggattctccggtacgatcaagcgtcacaacaactcaagacttaaggaaactcacggtacaggtcctgtacacagacatgcaggttctatgggtgcttgttcatcaccttcaaggatcttcaagggcaagggtatgcctggtcagtacggtaacgtaaaggtaactgtacagaatcttgagatcgtcaaggtagacgcagaaaacaatcttatcgcaatcaagggcgcaattcctggaccaaagaacggtacagttacaatttgcgactgcgttaagaaggcttagtggaaggaggaatcataatgtcacagatttcagtatttgatatgacaggcaaaaaggttgccgacactgagcttaacgatgctattttcggtatcgagccaaacaaggctatcatgcacgctatggttgtaaattatcttgctaaccagagacagggcacacagtcaactcttacaagaacagaagtaagaggcggtggtagaaagccatggagacagaagggaacaggtcacgcaagacagggttctatcagagctccacagtgggtacacggtggtgttgctctcggtcctaagccaagagattacagctattcacttaataaaaaggaaagaagactcggtatgaagtctgcactttcaacaaaggtcgttgacgagaatctcgtagttgttgattcgatcaagctcgagagctacaagacaaaggcagttgttgagatgctcaaggcacttggtgctgagggtaaggctctcatcgttacagcagagtctgacaagactgttgtcaagagtgcagccaacattcctggcgttaagacagctactgtaaatactctcagtgtttacgacattctgaactatgataagtttatcgtttcttcagaggctgtaaagaagattgaggaggtttacgcataatgagaactgctcaagatataattttaaagccagttatcactgaagactctatggacagacttcaggctaacagatacactttcaaggtcgctaaggacgctaacaagatcgagatcgctaaggcagttgaagagcttttcaacgtaaaggtagctaaggtaaacacgatcagcgttaagggtaagcagaagagaatgggaagaagcgtaggctacagaccagactggaaaaaagcgatcgttactcttgagggtgacaagacaatcgaattcttcgagggcttgttctaaatcctctaaaagaggtgcagcgtaaggctgcattgctccgaagaacttcatgaataccgagaagccttcggaaaggtcttgcgaggcggcgaggaccgctcatcatttcaccgcaggacgtaagtatggaagggcgcttggcgtgaaaacgctttgaccttttcgcaaaactcagataaggagtgaatttcaaatggcaataaagagctacaagcctacaacagccggcagaagaggtatgacagttaccgattattccgagctttcaaaggttgctccatgtaagtctctgcttgagccactcaagaagaactcaggtagaaacagctacggtagaatcactgttcgtcacagaggcggcggagtaagaagaaaataccgtgtaattgattttaagagaaacaaactcgatatgaacgcaacagttcttactatcgagtacgatccaaaccgttcagcattcattgctcttgtagagtatgaggacggcgagaagagatacatcatcgcaccttatggtcttaaggttggtgacgttatcagagcaggcgcagacgcagacatcaagcctggtaatgcacttgcaatgataaacattcctgttggtactttcatccacaacatcgagctttatcctggtaagggcgcacagctcgttcgttcagcaggaaacatggctcagctcatgggtaaggaagataactacgcacttgtaagacttccttcaggcgagatgagaaaggtccctgtaaactgcatggctacaatcggtcaggtaggaaacatcgaccatgagaacgtaaatatcggtaaggcaggtagaaagcgccatatgggctggagacctaccgttagaggttctgtaatgaacccatgcgatcacccacacggtggtggtgagggtcgtgctccagttggtagaccaactccagttacaccttggggtaagcctacaatgggatacaagacccgtgctaagcatcatcgctccgataagtttatcgtaaaacgcagaaacggtaagtaatgctgaaaggaggcagatgatcaatgggtagaagtgtcaagaagggaccatacgtacaggaggtcctttacaagagagttaaggcaatgaacgatgcaggcgagaagaaggtgctcaagacatggagcagagcttctacaatattccctgaattcgttggtcacacattcgcagttcacgacggacgtaagcacgttcctgtatatgtaacagaggacatggttggtcacaagctgggagagttcgctccaacaagaacattcaagggtcatgcaggttcaaagacctcaaacaacggtaagtagtgcggaaggaggaatacaaatggaagcaaaagcaattctgagaaatgctcgtattgctcctcgtaaggtacagatcgttctcgatctgatcagaggaaaagactatgatgttgcaatggcaacagtaaagcatacaccaaaggctgcaagtgaatatcttgagaagcttctgaagtccgccgctcacaacgctgagaacaaccataacatggataagaacaacctttacgttgcagagtgctatgtttgtccaggaccgataatgaagagaatcatgccaagagcacaaggcagagcatatagaatccttaagagaacatcacacgttacgatcgttcttaaggaaaaggaataagctgaaagaggaggtaaactatgggacagaaagtaaatccacacggacttcgtgtcggtgtgattaagaattgggactcccgctggtttgcagaaaagggtacttttggcgatacactggttgaggattacaacgttcgtaactttattcttaaagagctgaatacaagatcaaagaatccagcagataagtgcgtatacgccggcgttccaaaagtagagatcgaaagatttgccgataaggacggcggtcagaaggtaagaatccacatccactgtgcaaagcctggtatcgtaataggcagaggcggcgcagagatcgaaaagctccgtgcaaacgttgaaaagatgatcggcaagagcgttgctatcaacatcgttgaggtaaagcagcctgacatcaatgcacagctcgttgcagaaaagatcgcacacgatcttgaagatagaatctcattcagaagagcaatgaagcagtctatcggcagagcaatgaagctcggcgctaagggtatcaaggttagatgcggcggccgtcttggcggtgcagagatcgctagagcagaaacataccacgagggtacaattccacttcagacgatcagagctgacatcgactatggtacagctgaggcacacacaacttacggtaggatcggcgttaaggtatggatatacagaggcgaggttcttaagggcgaagttgctgcttcagacaagagagagtcaaacgacagaagacgccagaacagaaatggtaagcgtgacttcaataaggctaaaaaagagggaggtaacaagtaatgctgcttccaaagagagttaagttcagaaaacagcaccgcggccgtatgacaggaaaggctatgagaggtaacacagtttctcacggtgagtatggtcttcaggctcttcagcctgcttggatcacatcaaatcagatcgaagctgcccgtatcgcaatgacaagatacatcaagcgtggcggtcaggtttggatcaagatcttcccagataagcctgcaacaagaaagcctcttggaactcgaatgggtaaaggtaagggcgcacctgagtattgggtagccgttgttaagccaggcagagtaatgttcgagatcgcaggagtacctgaagagacagctagagaagcaatgcgtcttgcaatgcacaagctgcctatcaagtgtaagttcgttaaaagagatactcaagaaacgggtggtgagcaataatgaaggctaatgaaatcaaggatatgacagtcgacgagctcaacagcaaactcgctgagctcaagcaggagctttttaaccttcgtttccagcacgctgtaaatcagttggagaatcctaagagacttcaggctgtgaagaaggatattgctcgtgtaaagacattcattcgtaagcaagagtccaatgttcagtaattttcgaagggaggattaactgtgagcgaagagagaaatttgagaaaaaccagagttggcgttgtagtttccaacaagatggataagactatcgtagttgctatcaaggataacgtacagcatccactttacaagaagatcatcaagagaacagttaagcttaaggcacatgacgaaaacaatgtctgcaatataggcgacaaggttgaagttatggaaacaagacctctgtcaaaggacaagagatggcgtcttgttaacgttcttgagaaggctaagtaattaaaacgcaatagtgcaggtggcagataacttctgccgaccgcacgttaaattctgaaaggaggaacgcactgtgatacaaatgcagacttacctgaaggtagcagataactccggagcaaaggagcttatgtgcatcagggtactcggcggaacacgcagaaagtatgcaaacatcggtgacgttgtagtttgttctgttaaaaaggcaacaccaggcggagttgttaaaaagggcgacgttgttaaagcagtaatcgttcgttcagctaagggtcttcgtcgtgcagacggcacatatatccgttttgacgaaaacgcagctgttattatcaaagaagacaagaacccaagaggtactcgtatatttggaccagtagctaaggagctcagagagaaggattatatgaagatcctttcacttgctccggaagttctttaattggaggtgtcgtaacaatgaataaggtacacgtaaaaacaggcgacaccgtcgttatcctctccggtaaggacaagggtaagaagggcaaggtcctggaagtttcccctaaggagggaaaggtaatcgttgagggtcttaacattgctacaaagcacgttaagccaagacgtcagggcgagcagggcggcatagttgaggctgaggctgcaatgtacgcttcaaaggtacaggcagtttgccctaagtgcggcaagccaacaagagtcgctcataagttccttgaggacggtactaaagttagagtctgcaagaacgcagactgcggcgaagaattttaattaggaggatattacgatggctagacttaaagaatattatgttagcgacgtagctcctgctatgatgaagaaattcgaatacgctaacgttatgcagatcccaaagcttgataaggtagttatcaacgtgggctgcggcgcagataaggataacaagaaggttatcgatgctatcatgactgatctggctgctatcacaggacagaagccgatcgtttgtaaggcaaagaagtccgttgctaacttcaagctcagagacggacagatcatcggtgttaaggtaacactgagagctgagaaaatgtatgaattcgttgacagacttttcaacgtagcatttcctcgtgtaagagatttcagaggtatcaaccctaactctttcgacggcagaggcaactactctactggtcttaaggagcagctgatcttccctgagatcgaatacgataagatagataaggttcgtggtatggatatcaactttatcacaactgcaaaaactgatgaagaggcaaaggagctgctttcacttatgggtgctccatttgctgataagtaagaggaggataaaaaatggctaagaaggctatgatcaacaaacagcaggctacgcctaaatattccactcgtgcttacaacagatgtaagatctgcggaagacctcacgcttatctgagaaagttcggcgtttgccgtatctgtttcagagagttggctcacgagggtaagattccgggagttaagaaggctagttggtaaaaggaggttaacacgcatgcaaattactgatacaatagcggatcttcttacaagaatccgtaacgcaagtactgcgaagcacgcaacagttgacgttcctgcatctaatatgaagaagtcgatcacacagatcctcgtagacgaaggatacgttaaggacttcaagatcattgaagacggtaagcagggtatcattagaattactcttaaatatgacgagaacagaaatccagtcatcacaggactcagaagagtatcaaagcctggtctgagaatttacgcaagctgcgaggatatgccaaaggttataaagggtcttggcattgctatcgtatctacttcaaagggcgttatcacagacaagaaggctagagagctgaatgtcggcggagaagttctcgcattcatctggtaaggaggactaagttatgtcaagaataggtattaagccaattagtgttcctgcaggtgtagaggttactgttgcagacggaaacgtagttacagtaaagggtcctaagggttcactcacaaaagagttccacaaggatatgataataaagtgtgcagacggcgtgatcacagtagagcgtccttcagaggataagctccacaagtcactgcacggtctgacaagaacactcgtacacaacatggtagagggtgttacagagggtttcgcaaagaagcttgagatcgttggtgtaggttacagagcgcagaagcagggtaagaaccttgttatgaaccttggtttttctcatcaggtaatcgtacctgaaacagatactatcaagatcgatgtacctgacgcaaaccacatcgtaatttcaggttgcgacaagcaggaagtaggtcagtttgcttgtgagatccgtgagaagcgtccaccagagccttataagggtaaaggtattcgttacgaaggcgagtatgttatccgtaaggaaggtaaggctggtaagggcagcaagaagtaataaaaggagagaattactatggttaaaaagcttgacaaggctaaggcaagagcaaaaagacatcagagagtccgcaacaagatcaacggaacagctgattgtcctcgcctcaacgtattccgctcctctaagcatatttatgcacaggttatcgacgacgtaaacggcgtaacactttgcagcgcttcctcaatgtccaaggactttgaaggcaacggcggcaacaaggaaggcgctcgtaaggtcggcgaaatgatcgctcaggcggctaaggcaaagggcatcgagaatgtcgtattcgacagaggcggctacctttaccacggacgtgttcaggagttggcagacggagcccgtgaaggcggacttaagttctaaagaggagggtaaacattggctttaatagatgcttcaaacatggaacttactgaaaaggtcgttgcaattaacagagtatcaaagactgttaagggcggccgtataatgaagttctcagtcctcgtagtagtaggcgacggaaacggagtagtaggtttcggaatcggtaaatcaggagaagttcctgacgcaatcagaaaggcaatccaggacgccaagaagaaccttatcagaatttcacttaagggaacaacgatcccacacgaaattatcggtaagttcggtgcaggcgaggttcttctcaagcctgcagcaccaggtactggagttatcgcaggcggcacagtaagagccgttgtagaagctgctggaattaaggatatcagagctaagcagctccgttcaaacaatccttacaatgcagtaagagctacaataagcggtcttgctaacatcagaagcgctgaaacagtagcagctctcagaggcaagacagttaaagaaattacaggctaaggaggataacagttatggcaataaacatcgaactgataaagagccttaacggaagaagcgataagcaggtcgctaccgctaattcactgggtctcagaaaaatcggggataagacttgtcagcctgacaatcctcagacaaagggaaaggtaaaggttatctcccatcttattaaagtaactgaagcataaggaggtgcaatctgaatgaaactgcacgaattatcacctgttgcaggctccgtaaaggagagcaagcgcaagggcagaggtcacggttctggtaacggaaagaccgcaggcaagggacacaagggtcagaaggctcgttccggcggcggaataagaccgggctttgaaggcggacagacaatgctcgcaagaagaatccctaagcgtggattcaacaatattttcgcaacaaagtatgttatcgtaaatgtatctgatcttgatagatttgttgacggcacagttgttgatactgagcttcttaaagcttcaggcatcatcaagaaggaacttgacggcgtcaagatcctcggaaacggcgaattaactaaaaaccttaccgttaaggctgctaagttctcagcagctgctaaggaaaagattgaaaaggcaggcgggaaggttgaggtgatgtaattgtgatagagacatttcgtaatgcctggagagttccggaattaagaaaaaaacttctatttacttttttcatcatcatcatctacagagtcggcggtacagttcctgtgccttaccttgactcagtcgcattgtcagcatggtttgaacagagtgcttcgtcaggtgactttttcagctatctgaacgttctgtcaggaggtaacttttcaaaagctactctcttggcgctctccgtttcaccttatatcaatgcacaaattatcattcagcttctgacctacgctctcccaccgctggaaagactccagaaggaaggtcctgagggtagaaagaaacttaacaagataacaaaatatgcgtcacttgctattgctatcttccaggcgtgggcttattacctcaccatgaagaaagcgggtgcttgtgtttacacagagggctttagcaagatattcgcagagatagttattatcgcttgctttacagcaggtgcgtcactgacgatctggcttggtgacgagataaacgagaagggtatcggaaacggtatctcaatgctcctgttcgcaggtatcattgcaagaggtccttcagcagttatcggtctgttcgattacatgaagacaggcgaggctaagaacatcattctcgtaattgctatccttgttgtgttcgttctgatgataggctttatcatcttcatgaacgaggctgaaagaagaataccgatacagtacgcaaagagagtagtcggcagaaaacagtacggcggtcagaatacttttattccgatcaagatcgcaatgagcggcgttatgcctatcatctttgcaatggctttcatgtcactgccttcaacactcaaaatgttcattgaaccaaagagcggaagcttctacgatcacttccttcactggttcgagtacactcatccgttctacgcttgtctgtactttgtgctgataatcggcttcaactatttctatgtttcaatgcagtataacccacttgagatcgcaaacaacctcagacagaacaacggcggtatccctggtatcagacctggtagaccaacttccgattatcttaagaaggttctgtcaaagataacattggtaggagctgtgttcctcggaataatcgctatcttccctattatcttcacttcgatcacaaagatgaatattgcaatgggcggtacttcgatacttatcgttgtatcagttgctcttgaaactgcaagaactatggaatctcaaatgatgatgcgtcatcataagggcttccttgaataaaccataggctttacgtttgagataaaaaggagttaaaaatgaatatcattcttttaggtgctcccggtgcgggaaaaggaactcaggctgaggttatctgcaaggctctgaacattcctactatttctacaggtaatatgctcagagctgctgttaaggctggcactgagtacggtctcaaggctaaggctgctatggacgcaggcgaccttgtatcagacgatatcgtaattggtatccttaaggacaggatcgctgagcctgacgctcagaacggtttcattctggacggtttcccaagaacagttcctcaggctgaggctcttgacgctatgggcgttaagatagacaaggtcatagagatatatgttcctgacgagactattcagcagagactttcaggcagaagagtttgcctcgactgtggtgctacttaccacacagctttcaagccttcaaaggtagagggcgtgtgcgatgtttgcggaaagccgatcgttatccgtaaggacgacgagcctgcaacagttatcagcagacttcagacatatcacaaatcaaccgctcctcttaaagattactacggtaagcagggcaagctcgttactgttgagggacaggataaggtagaggacacttcaaagcttgttctcgaagctgttaaggcatagatccgaggcgtttttaatgatatgcgttaaatccaataaagagatcgagaaaatgcagaaggcgggcgcaataaccgccggagcattgatcgctgcgggcgaggctatcagaccgggtatgactacctacgagcttgataaagtcgttcacagatatatcacttctcatggtgcaaagccaagcttccttggctacggcggatttccaggctcagcctgcatttccgtcaacgatgagataatccacggtatccccggtccacgcaagctttgcgagggcgacatagtttcagtagacgttggtgcttacattgacggctatcacggagattcctgcaagacctttgctgtaggcaagatttcccctgaggcagaggctctgatgaagtccaccgaagaaagtctgtatcttgcaatagatatggtaaagcctggcgttagacttggcgacttgggtgcggccattcagaaatacaatgaggacaacggctactccgttgtaagacagttcgttggtcacggtgtgggcaaaaacctgcacgaagatcctgaagttccaaactatggcaaggctggtcacggcatcagacttgtggcaggtatggtaatagccatagagcctatgataaacatgggtacggctgatatcaagacaatgcctgacggttggactgtcaagacaaaagacggaaagtgggcggctcattttgagcatacaatcgcagttactcctgacggggcagttatactgaccaaagtatgacggagaaaagcgttgtagatataccgatcggttcagtggtgcttgcgaacgcaggccgtgataagggcagatattttgttgcggtagctgccagcggcggttttgtgtatatcgcagacggcaaggagcgtaagcttgaaaagccaaagcgtaaaaacataaaacacatttcacctgcgggcgtcaacatcagcactgatgagctgacaaacaggaaattaagacggctgatacaaggttttgacccaaaccgtgttacagcagaccaaaaccttttagatggggaggttttttaatgtcaaaggaagacgttatcgaacttgagggaacggtaattgaggctaagccaaatgcaacgtttctggtagaactttcaaacggtcataaaatccttgctcatatttcgggtaagctgcgtatgaattatattcgtatcgtacccggagataaggtaacggtcgaaatgtcaccgtatgacttgacaaagggaagaatcacatggagagctaagtaagctttcccgtaagtttaagaatttttaattcttgtcgctaaattcaaaggaggtatttcaatgaaagtaagaccttcagttaagcctatctgcgagaagtgcaaggtaatcaagagaaaaggcaaggttatggtaatctgccagaatcctaagcacaaacaacgtcagggctaacaaaccaataatggaggtgcagctaaataatggctcgtattgctggtatcgacctgccaaaggataagagaattgaaattgctcttacttatatctatggtataggtcagaaaactgctactaagattcttaatgaaacaggcgtaaatcctgacacaagagttaaggatatgtctgaggacgatgtagctaaattgcgtgaatatattgaccataacatcactgttgagggtgacctcagaagaaatgttgcgctcaatatcaagagattgacagaaatcggttgttatcgtggtcttcgtcacagaagaggtctcccagttagaggtcagagaacaaagaccaacgcaagaactcgtaagggtcctgtaaagacaatcgctaataagaagaagtaaggagggtgtgaacaatggctcaggctaagaagaagactactattcgtcgtcgtcgtgaaagaaagaacattgaacagggacaggttcatatccagtctacttttaacaacactatcgtaactattacagatatgcagggcaatgctatttcttgggcatctgccggcggactcggcttcagaggttctaagaagtctactccattcgctgctcagacagctgctgaaactgctgcaagagctgctaaggagcatggccttaagacagttgaagtttttgtaaagggacctggtgctggccgtgaggctgcaatcagagctttgcagtctgaggatcttgaagttagacttatcaaggatgtaactccgatccctcacaatggatgccgtcctccaaagagaagacgtgtatagtttataagacaatttgagtttgtagtttactcaaagtcgggtaagcaattcggctaagacccgataacatttagaaaacggaggtatttaccatggcagtaaatagagaaccaatactcaagagatgtaaatctctcggaatcagcccagcagttatgggtatcgctaaggaaacaaagcgtgatcctaacgctaacaagagaaagaaagtttcagaatatggtatgcagcttaaggaaaagcagaagctcaagttcatctacggcgttcttgagaagcagttccgtcacctgttcgagcttgctgagaaaatggagggtcaggccggtgctaacctcattactcttctcgagtcaagacttgacaatgttgtatacagaatgggtctttcaatgacaagaagagaggctcgtcagctcgttgttcacggtcattatcttgttaacggcaagagagttgacattccttcttacagaatcaaggaaggcgatgttatctcacttaaggaaaacagcaagaagagcgagaagttcaagcagatcattgaggctaacgcttcaaaggcagctcctacatggcttgatgtaaacaaggacaaccagacagctaaggttcttcgtatgcctgttaaggaagaccttgactatgacatcgaggagcacctcatcgtcgagttgtattctaaataatgtattgatagtggttcttacggtatgcactcttcaagagtgcgtatcggagaaatacttgatatgtttttggaagtgtatgtgttattgatcatataaaacaatcgagtttgaaaacaggagggtcttaaatgcttgaaaaaatagaaaagcctgaaatcgaaacagccgagctaaagagcaacggaacatacggcaagtttattctcgagcctctggagcgtggctatggtattacgctcggaaatagtctgagacgtgtactgctctcctctttgccaggcgtcgccgttacatcggtaaagatcgacggtgtacaccacgaactatcaacaattcccggagttaaggaagatgttactgagatcattcttaacctcaagggtttaactgcaaagctttacggcgagggtcctaagactatctacattgaggccgagggcgagtgcgttgtcactgccggcgacatcaagacagattctgaggtggacattcttgttcctgatatgcacattgcaactttgggaccgggcgcaaagctttatatggaaattgtcatcgacagaggtcgtggatatgtttctgcggaaaagaacaaggcgcttatgcctaacgcccctattggtgttattgcagtagacagtatttatacgcctgtattaaaggtgaacttcacggttgacaacacccgtgttggacagatcaccgattttgataagctgacattggaggtttggaccgacggtactatctccgctaaggaagctgtatcaatggcagccaaactcctcaacgagcatctgaatctctttgttgatctctcagaagagactaacgttgtagagatgatggttgaaaaggatgaaaagggcaaggaaaagatccttgagatgaccattgaggaacttgacttatctgtgcgttcatttaactgtctgaagcgtgcaggaattaacacggttaacgatttgattgaaaagtctgctgaagaaatgatgaaggtaagaaaccttggtaagaagtcattcgacgaggtcaaggaaaagcttcattcattgggttacgaccttaattcagaggacgataattaaagtaaggagtgaaaatctatgccaggcacaagaaagctgggaagaactagcgaccagagaaaagcaatgctcagagctatggttacttatcttctcgaaaacggtaagattgaaaccactgtaacaagagctaaggaagttgctgctatgactgagaaaatgattactctcggcaaggcaggcgaccttcactcaaagcgtcaggtactttcttatgtaactaaggaagacgtagctaagaagctgtttgacaacattgcaccttcatatgagggcagaaacggcggctatacaaagatcatcaagatcggaccacgtcgtggcgacgctgctgaaatggctatcattcagttggtttaataaattttgcatagcattcaaggctgtatccgtaagggtacagcctttttatgtgcttatatttgggcattggtatcaaggtatgcgggcgaacgttgttcgcccctacaagtgtggctatggtttgtggttattttagaagttcattgccaatgaggtcaatgaatttcttgcctgctatgccgttttgtgaatagctgtggtttttgagtatattgttcacggctttctgagtacctgcaccgaaaacatcgtttttatcaaggtcgatattgtgcataccctttttctttgcaagcataagaagatatttcagtgcaaggacaccattgcttttatcgccttttttgtagcctgtggtatcgagattttttgctttggaagggtaaaggttaaggcactttttcttcattatggcagggtagtctttgtaggcgtagttgcaatcgcagcgttcggaaacaccgtttacagttcctttgcttgtatactgccacattccatagtttgatatggcaggctttgcaacgtcaaagtgtgccacccaaatgtcgtagcggctttttacagagtctgataccttgcgcttgaaaaagtttgcatagctgtagacagccgcatagtagccgttgctttcgagatagtcgcagaaggcttctataattttgtttatggcagcgtttggaagttcactttgggaagcgtcctcaatatcaaaggcgaggggatattcaaacattttgcctttgaccgcttcaagaaaagttttcgcttccgcaagtgcatcggcttccgtaagagcgtaggaataccagtatgtgccgatattaagaccagcctttctggcggcggcatagttcttctcgaaattttcgtctttttgactgatgtacttgccgtagcctgcgtttatcatcacaaagctgtaaccctgtgacttcaccttgtcaaaatcaatttttccctgccaatgggaaacgtctatgcccttagctttttccattgccgtcacctccagatttttttgccgtctgtacgccaaagtaaaatgatatcaccacagtgaaaactgtgatgaactgctctccgctgactatccctttcagcgtgaggatacagaacacgcttgtcataagcagtgtgacaagcgattttacgtcaatgagctttgcgagtttttctttcatgaatatctctccctttccatgtctgttatcttttgttccgctgccgccattcttgagatgagtgcgttatgctcggaaactgtttgttccagcctatctattctatatataataagccgttcggtggcttcctgtgattttttgttttctttagctcccgaacgagctattataagctggcaggctatgctggcggccgccgctatgaacgccgctattactgcttccatgtttatcacctcctacttatcccgaaaaagaggtgttttgttgcataaaaaatgcaacaattgcagaattgttgccaaattaaaatataaatcatttgtttgcacagttttgatacagcgtttttgtgcattggtcacatactttcatgaacagaaaggatatttgttaaggcgcaaaaaaaccacggttgagtgtactttcagccgtggtttttgtttttagtacgttcttatttctcaggaagaagcattgtagccgcaatatatgcgataactcctgcaccgcctgcaaagcctataagcactgcacaaatacggactaaattcacgtcgatgttgaaatactccgcaagtcctgcgcaaacgcctgaaattattctgccctctcttattttgtaaagcggttttgccatttctatcactccttatctgaaattaagcgaaatttcgcctataccgttgtcaatgtcaagttttattttgtatgaaagctcgctttcttctgatgtgctatttattttcactttgctgtctgattttattttataatcgtttttgtagccgtcgatatcaaaatttatgctgcctataccgccgtctatatcagcgtcaccgaggagctttcctgcaaagtctgtttcgcctactccgcagtcaaagtcggaatcgttgaatgtgcagtctttgaaaacggtttttcctaccccaaggtcaaagtcggcttcatttgtgcaggtgacgttaatgacctctgagcttcctgcaccgaaatctatgtcgaggttttcacagttcaggtctgaaagcttcatttggcctgcgcctgcgtctatctttacagtgtcaaacgccttttcaggaagctctatagtcagcttaggttgacttccgtcaaaggagatatatccgccattaaggtgcaaaaggctgtcagcggtcttgacctgaagcttgctgtttgatgatgaaaaatttatcttctctgggagattttctcccgtgacgtggatattttcgtcactgctctttttgatgttgagatcccctgcggagaagtcgatctccatattatctatagtggcaacgtcaaaagtttcgttgtaggaataacgcttgccaaggcttttggtgtttgtgaccttgataagcaccacgcccacaataaaaagcactatgccgataataaatatcgtcaggaaaaatgggaaacgtctgcgctttacgtcgcctgtgttatcatattttgccattatgccaccgcctttgagcttacaaacctatggacaaagtttgtgaatttgttgaaaaggcttacacagccacgccatatgcaccttataacaggcattacgatcatgcctccaagcccgatacaaataagtcctgcaccgataagggcaatgcctgcgggatagaccgtgaaaagcgttacgattccgcctattgtaagggagaagcctgttgcgaaaactgcaattattatgcttaaaagtgcgcaaagtatcgccaaggctattgcggcaaaggcacacataaggctgaaccatattgggcttgtgatgatgataacaagaagctttgcaagagaattgccgttctgtggcacattattgtcaatatcacgagcctgtgaggggtcagcggcggcttccatttggaacaccgagtcgccctgtgggtgtatgccgctatcctgcaaaattttgttggcaagatcttcgggcgagccgaggtttgcggcagtttcagcttcatgtgctgtccctgcgtcaagaaatatctcttcataaaaccccattgcgtcgtttatttcatcctcggcaagtccgccgtcttcaagcgatctgcgcagttgggtaagatactcaagtctgttcatgtattttctccacctttttctaataatatacggtctaccatattcttgtgcttcttccactctctgcggtattcttcaagagctttttctccctttggggtaacatgataataacgcctgttcctgcccatatattccttatcgtaggtttcaagcagttcgtttttttgaagccgtttcagcacaggatacaaggtggattctgaaacgtccaccgcactgcgtatgaactgcgttatctcatatccataggtatcctctctgtctaccactgacagtaccatggaatcaagcagtcctgcacttattggaaagcccatttactctctcctctctttagtcagctcagttattatatagatctataatactatatcgttgaatatattatacgtcatataatattatttgtcaaggggtaaaatcagtttttttgttatcatcactttatgccagttagtttagaataattgtttgttgaaaatccctattgattttctatgcttttgtggtataatatctattaggaacagctaacttgtgacagccatgtcatgacgttttacaaagcctgacaaggcgatagaggaaaggacacagaatatgaaaagtaataatttattgaagataactggacttcatgtgagcgttggggataaggaaattttgcacggtgttgacctgacggtgaacagtgatgaaactcacgttcttatgggtcctaacggcacaggtaaatctacgctgggttatgctataacaggcaaccctgcttacgctgtaacagagggtgacattgtttttggcggtgaaagcgttgtggatatgcctgtgaacgagcgtgcgaaaaagggcatttttctgtcattccaaaatccgctggaagtgcctggggttacactgagctcgtttataagaagtgccttggagcagaaaacaaagacacgtcttagactttgggatttcaagaaaaagcttgcggaaacaatgaagcttctcgatatggacgagtcttactctgacagagatctcaacgtggacttttcaggcggtgagaagaaaaaggcagagatattgcaaatgcttatgcttgagccaaagcttgctatacttgatgaaacagactcaggccttgacgttgacgcagtaaggacagtttcacagggcgtaaagctctacagagagcgtgttcacggctcactgcttattataacacacagcacaaggatactggaggctcttacagttgatgccgctcatgttatggaaaatggcgttatcgttaaaaacggcggtgcagagcttgtggacaagataaacgaaaagggcttttcggctatctgatataagtgtgtaaggggcgttttgccattacacgcagcaagaggacgaggtgaaaatgatgaaagaaaaaagtcaggtcatggatattgaccgcagtatttatgatataaaagatgttgaaaatgacgcttaccgcataaaaagcggtctgacgcctgaaataatagagaagatatcaaaagaaaagaacgaccctatatggatgcagcagttcagacttcaagctttgcagatatataacgagatacctacccctgattgggggccgtcgctcgagggacttgatatggacaatattgccacatatgtaagaccaaacacgaaaatgcagaacaactggaagaacgttccgcaggatataaaggacacctttgaaaggctgggcataccgcaggcggaaaggaaatctcttgcaggcgtgggtgcacagtatgactctgagcttgtttatcataacgtgcgttccgaggtggcacaggagggcgttgtttacatggatatcgaaagtgccatgaaaggcgaatatgccgatatggtgagaaaatatttcatgaagcttgttacaccgagggatcacaaatttgcggctttgcatggtgcagtatggtcgggaggctcgtttgtgtatgtgcctaagggcgtgcagctgtctataccgcttcaatcttatttcagacttaatgcaaagggtgcaggtcagtttgagcacacgcttatcatagttgacgagggtgcgagtctgcattttatcgagggctgttctgctccaaaatacaatgttgcaaatcttcatgcaggctgtgttgagctttatgttaagaagaacgcaaagctaagatattccactatcgagaactggtcgaagaatatgtataaccttaatacaaagcgtgctattgtggaagagggcggaaccatcgaatggatatcaggttcattcggctcgcacatcggctgcctttaccctatgagcattttaaagggcgacaattccaaaatggagttcacgggagttactttcgcaggaagcggacaaaatcttgatacaggcgcaaaggtagttcatgtgggcaagaacacaagctccttcatgaacacacgttcaataagcaagagtggcggaataagcacattcaggagcagcgttgtggtggaaaagagtgcgaaaaaggctaagtcatcggtatcatgccagtcgcttatgcttgactctgagtcaaggtctgacactatccctgcaatggatatccgcacaaaggacgccgctatcggtcacgaggcgaagataggcagcataagcggcgacgcagttttctatcttatgagccgtggcatgactgaagaggacgcaagggctcttatcgtaagtggctttgcggacaacgtttcaaaggaactgcctgtggaatatgcggtggaaatgaacaatcttataagacttgaaatgaaaggcagcataggctgacgggaaaggagtgcttaaaatgactaaaaatatcctgatagacaagctgccgacaaaaacgtggaatttcctcaaggtaaacagtgctgagatacagtgggacagcgaaagtgcagcgaaaactgaggaaaacatcatattaaaaaaagatgaaaagaacgagcctgtaaggcttgacaacagcggcgcagagggatatactgaaaaggtcgtgaacgtaacggctgaaaaggccgcaaagggcgttatttttgaagtttgcagaggaaacgctcatatgctgtcaagggtgaatatcgaccttgaggagggagctgaggtgaagctcgttatgcttcttgagccgtcggaaaacggacttgtgcgacatgaggtcagggcggaatgcggggtaaattcccatatccacattatgactgtcatgataggcagcggcgatatttacagtgacgaccacgttactctcagcggtgacggagcgaggtttgacgctgacaccgcttatctggggaaaaattcacagactatagactataacatagtggctgaccatttcggcaaaaagacggagagccttatcactgtgaacggcgctttgacggacagtgcaaaaaaggttttcagaggaactatagattttaagaaaggctctgcggactctgttggcagcgagaacgaaactgtgctcatgcttggggacgatgttgtgaacaaaactgttccgctgatactttgtgcagaagaaaacgttgagggtactcacggagcgactataggcgagcttgacgctgacactatgttctattttgagagcaggggcattgacagagaaactgccgagaagataatggcttacgctgctgttgaaaggcttatccatatggctgaggacagcgaatttgcggcggaggttgaaaaagacatgggaataaaaactgatacagaggaatgagatagatgcagggatacaagacggattttccacttcttatgcaggataaaacggtttatatcgacaacgctgcaactgcacagcgaccgaaatgcgttattgatgctgaaaaagatttttacacctgccacaatgcaaaccctctccgtggaatttatgagctgagcgttcaggcaacggagaattatgagaatgcacgaaaggcagtgcgtgactttatcggtgcgaagtctgtgcaggagataatttttacacgcaacaccacagagagcataaatcttgtggcatacagctatgggctttccaatttgaaaaagggcgacgaggtggtggtttccataatggaacaccacagcgaccttttgccgtggcaaatggtttgcaggcagacgggtgcggagcttaaattccttgaatgtgaaaaggacggcagtcttgaccttaacaaggctgaggaacttataacagaccgcaccaagatagtggctgttacgcagctttcaaatgtgcttggcagagaatatcctatagaaaagcttgcagaaattgcacaccgcaagaacgctgttatggtggcagacggtgcacagagcacgccgcatattgcggtggacgtgaaaaagcttggggtggatttctttgcattttcaggtcacaagctttatggacctatgggcataggcgtgctttacggcaggcgtgagttgctcgaaaaaatgccgccgtttctcacaggcggcgagatgatagagtcggtgtcaaggacttcggcggtgtatgctgaactgccccataagtttgaggctggcactgtcaatgcggcaggtgcagtgggactgaaatcggctatagactatgtgaaaagcgtgggctttgaggaaatacacaagagagagcttgaagtttcggcgtatgcctttgagaaaatgaaagagattgctcacataaatatacttggttcggagaaagctgaggagcataatggtattttgacttttactgtggacaatgttcacccacatgacgtgagcgagatacttgcggcagacggcattgcggtcagggcaggtcatcactgcgcacagccgctgcttgaataccttggctatcgttcaacagtgagggcaagctttgctttttacaataccaaagaggacgcagacagatttttagacagtctttcaactgttagggagcgaatgggttatggaaaatagaaatttttacaatgagatactaacggagcacaatatgcaccctgatttcaagcatgatatagaggacgcagacattgtgctggacgggataaatccaagctgcggcgacgagatacagttaaagctgaaaactgacggggatatcattacggacggggcttttgttggtgacggctgtgcaatatctcaggcttcaacggatataatgcttgggatgataataggtcagagcaaggaaaaggctttggaatatgcggatattttcatgagaatgataaggggcgaggcgtctgacgaagagatagacagccttgaagaagcttctgcactcagggatatttcccatatgcctgcgagagtaaagtgtgcaatgcttggctggcggacgctttctgaggcgctgaaagataaatagggtataaaaaatgggcgctgtaaaaaaaagcgcaacaaagcccgtggatttcctcgatatggaagctcacgggctttaatatatcacacagcaaaaaagaactatctaatcttgaaaaaagggtacagcaaacacagcggcacaaaaactgcgtttttgccgtgttgaaaatgtggaaaatattttaaatttatgccgctttttttattgcaggctttttcaagtggaatttatgcagattaaaaccacagcaaatcatcgcaatttctaaattcatggcatttaagccacgtcttctggctctagagccagaagacgtggcttaaatgccatgaatttagaaattgcgatgatttgctgtggttttaatctgcataaattccacttgaaaaagcctgcaataaaaaaagcggcataaatttaaaatattttccacattttcaacacggcaaaaacgcagtttttgtgccgctgtgtttgctgtacccaaaattcagccaaaatagttatttttgcgatttggcataaaaaagagtcgagatttcccgaaaagtaggaaatctcgactctttgagcgctgtttttttacaacgcctttcgttttatcaaccgtaattgtacttaatacgaaaatccccagtgaaaaatatagatttttcggtgtcgaatgattgactatttgtgcagattgtgctataatataacagataatacctcgctgtaagcgtaggtttaagaggtgtaaaaactatggctgaaaagaataccgccaatattggctttgaaaagcagatttgggacgctgcctgcgtgttgtgggggcatattccggctgccgaatatagaaaagttatcgtgggacttatcttcctgcgttacatatcaagtgcatttgagaagcgttataacgagcttgtggctgagggtgacggcttcgaggacgagcctgacgcataccttatggacaatattttcttcgtgcctgaaaaggctcggtggtcggtggtgtccgctgcggctcacactcctgagatcggctcggtcattgatgatgctatgagagctatcgaggacgagaacaagacattgaaaaacgttcttccgaagaactacgcaagccccgacttggacaagcgtgttctcggtgatgttgtcgatctgttcaccaatatggatatgaccgacacggaggacagcaaggacttgctcggtcgcacttatgaatactgtatcgctcagtttgccgcctacgagggtgtcaagggcggtgagttctatactccgtcaagcgtggtgcgtacccttgttgagatattgcgtccgtttgagaactgccgtgtttacgatccttgctgcggttcgggcggtatgtttgtgcagagtgcgaaattcattcaggctcacagcggaaacaggggcaatatctctgtttacggacaggagtccaatgccgacacttggaaaatggctaagatgaatatggctatccgtggtattgatgcggatttcggacagtatcacgctgacacgttcttcaacgacctgcacaagaccttgaaagccgactttatcatggcaaatccgccgttcaacctctcaaactgggggcaggacaagctcaaagacgatattcgctggaaatacggtgtgccgcctgccggaaacgctaactatgcgtggatacagcacatgatacaccaccttgcaccaaacggcaaaattggtctggtgcttgcaaatggtgcgctgtcaacgcagtccagcggtgagggtgacattcgtaaaaatatcattgaagccgacttggttgagggtatcgtttcgatgccgacacagcttttctactccgtcactatccctgtaacgctgtggttcattacaaagggtaagaagcagaaaggcaaaacgctgttcgttgatgctcgtaaaatgggttatatggttgaccgcaagcaccgtgatttcacggacgaggacattcagaaacttgctgatacattcaaggcatttcaggacggcacattagaggaagtcaagggcttctgtgcggtggctgacattcaggctatcgctgcacaggactatatccttacaccgggacgctatgtcggcattgaggagcaggaagatgacggcgagccgttcgatgagaaaatgaagcgcctgacctcggaactgtcggatatgttcaagaagtcccatgagcttgaaaatgagatcagggagaagctgggggcgattgggtatgacatttgatattgttcaattatgcgatattaatattgatgtaattgacggtgatagaggaaaaaactatcctcatcaagatgaattacttgaagcaggtcattgccttttcctttctgctaagaatgttacacaaaatggtttcttattcgctgataatcaatttatcacacaaaaaaaagatgagttgctgaataatggaaaactaatgcgtggagatattgtgattacaactcgtggtactgtgggtaatgttgcaatatactctgatgaagtgccttatgataatatccgtataaattcaggaatgcttattataaggtgtggtgataagattgataattactacttatatcaagtgctaagaagcaaatggttctataatcaaatcttatcaatacaaagcggaagtgcgcagcctcaattacccaaatcgcattttctaaaaatgactattcctatgcccaatatgaatacacagcataaaatcgcaggcgtattatccagcataggtaataagatttctgtaaatactgcgataaatgaaaatttacgcctgcaagccgcctaaatctgcgctgtcgacacgtcgatctcgccgttcatcagcttcggcaggagcgtgtcacggatggcggcaagtcttgctatctcattgcaattcttttctatttcgtgtatagcagcccaagctaattctgaaaatctacttatttgcgttatatcagctttaggagaagtaaatgccgaaatcatttttgtagtgaggctaccacggatactattggagttggatattactcttaattcttcatatcttccgcagatattccaataaataaacggcatatatattctttccgactctacaactatgatagactgattgatataggtatctgtaagcaacatcgaggtttgacctctggtgtgaccttgaccagcagatgctattacagtatcatatttcttggctaatcgggtagaagaattatcaacgcctgcctgtgtaatagttttttcagtatctacgatgtatttttgagaagtttcacccgatgaaagccatttgaactctccactccagtaggtttcatttgaggtagttggtgtaccaccactaaaaactctatcagcgtagtcgctgatttttgcggtatgctcacattccttaaagatttcagcatagtaagctgctataagctgatgtaaattttcatttatgttaggagtacgatatgaacttaccaacagaatatattgaaaagtttgctgaatgttactgtaataggctgttggatcgtcgcatcagttactacattcatgataaggacaatcactcaagagctaatactgttcattctggcattatatggagtcgtgaagcagtaaaacagcttaattccattgatttcagaaataatcacgatcttaatcatttgatattgcttataacttatattgacattcttcttgaagcaactgaccagatatatcgtgtattatataaggaaaagaagcaaatgcctttgcctgatgatactgtttttctgaatcgtccagagttatacaagtctctcgatgataggcagtatttcaaagaaatacgcgcacttctcagcgcccaccctatcaatcttaatgagccgaactccaaagagaaacgatttgctgatactcctattgtctataatccgattacagatttcaagagctatcataaaattgaaggaggatacgatttttcatctcgtctatggacagcgactcgacatgatgagaatactattcattttccgattagaattaacgaattagaagcctttgcagaaatactaaacaatagatatactgtatttttacaaagagtacgagatatagcatataagagaatttgaggtgagatatttatgccttacaccgaagaaaaatacgaaaacgcaataatacagctatttgaggaaatgggctacacccacgcctacggtccggcaatagaccgtgactataagacaccgctgtatatggacgagcttacagaagccttgtatcggctaaatcccacgctccccgatgatgcgatcagcgatgcactctttaagctccagaattttgaaaacggcgagctggtgcagaaaaacgctgtatttatggactatctgcaaaacggcatcgaagtccgctatactgataagggcgaggagcgttctgcaatctgctatcttgttgactacgcaaacacggacaacaactcatttatcgttgcaaatcagtggactttcatagagaatgacgagaagcgccccgatgtcctgctgttcatcaacggtctgcccgtggtgcttatggagctgaaatctccctcccgtgaggaaacggacgcttccgaagcctatacgcagatcaggaactatatgcactccattccctctatgttcatctataatgctatctgcgttatgagtgacctttccgaaaaccgtgcaggcacgatcacttcgggcgaagatcgctatatggagtggaaaacaaaagacggcagctatgaaaatacgcagtttgcccaatttgacacgttctttgagggtatcttcacgaaagaccgcctgctcgacattctaaaaaactttatcctgttttccaacgagggcttgcagagttataagatacttgcaggctatcatcagtattttgccgttcgcaaggctatcgaatccaccaagaaagctactgtcaccgacggtaagggaggtgtgttctggcatacgcagggttcgggcaaatcgctgtctatggtattctatgcccatttactgcaatctgcccttgaaagcccgactgtcgttgttatcacggacagaaacgatcttgacgatcagctctattcgcagtttgcgaaatgcaaggcgtttctccgtcaagagcctgtccacgctgaaagccgtgaacacctgaaaacactccttgacggtcgcaaggctaacggcattatctttaccacgatgcagaagtttgaggaatcgggtgagccgctgtctgaaagaagaaatattattgtcatggctgatgaagctcatagagggcagtacggtcttaccgaaaagatcaagatgacgaagaatgaggacggcgagcttgttgcccgtaaggtcatcggtacagctcgaattatccgtgatacgctcccgaatgctacatatatcggctttacgggtacgcctatttccagagaggacagaaatacccgtgaagtattcggagattatattgacatctatgacatgacacaggctgtcgaggacggtgcgacacgtcctgtctactatgaaagccgtgtcatgaagctgaaactcgatgaaaacactctgaaactgatcgacaccgaatatgagatcatggcgcagaatgccgatgctgacgtaatagagaaaagcaagcgtgagcttgggcaaatggaagctatcctcggtcacgatgatacgataaagtcccttgttgacgatattcttgaccattatgaaagctatcgtgagaacctgctgacaggtaaagcgatgatcgttgcatactcccgtgctatcgctatgaagatatataagcgtatccttgaaattcgtccgggctgggaggaaaaggtcgctgtggtcatgacggcttctaacaaagatcccgaggaatggcacagtatcatcggcaacaagcgccacaaggaggagcttgcaacaaaattcaaggacaatgacagtcctctgaaaattgctatcgtggtcgatatgtggctgacaggctttgatgtgccgtcccttgcgacgatgtatgtctataaaccgatgatgggctataatctgatgcaggctatcgcccgtgtcaacagagtgttccgtgacaaggagggcggtcttgtcgttgattatgtcggtatcgcaggtgcattgaagcaggctatgaacgattataccgttcgtgacaagaagaattacggcaacacggatattgcaaaggtagcatatccgaagtttcaggagaaactgcaagtctgccgtgatctgctccatgaatatgattattctgcatttttcggcggtaatgagcttacggcaggacgcacgatcactggtgcggtcaattttctcatggacagaaagagggagaaagacagagaaagctacacaaaagaagctctgctgctgaaacaggcactttcgctgtgttcctctatcgctgaggaagatgagcgtgaagaagccgccttttttgaagctgtccgtgtcctgttgatgcgtattctcaatcagggcggaggtaaaaggctctcactccctgagatcaatgccaaaatcaatgagctgttgaagcagagtatcaagagtgatggtgttatcaaccttttctccgacaaggaacaggacttttcgctgtttgatccaaaattcttggaggagatctccaaaatgaaagaaaagaaccttgctgttgagctgctgaaacgcctgattgctgaacaggtacatatctacaagcgaacaaaccttgtaaaatcggagaaattcagcgagatcatgcaaagtgctatgaaccgctacctcaacggtatgcttaccaatgaggaagtcattcaggaaatgctcaaccttgcaaagcagatcagagaagcacaaaaagcaggcgaagatctcggtttgactgctgatgagcttgctttctacgatgcactcaccaaaccgcaggcgataaaagacttctacgagaacgaggagcttatcgctatcacaaaggagcttgccgatacgctccgccgtaatcgcacgatagactggcagaagcgtgagagtgcaagagccagaatgcgaatgatgataaagaaacttctgaaaagtcatcgctatccgccggagggtatggacgatgcggtggctactgttatgcagcagtgtgagctgtgggttgacaacgcaagtatgaattgatataggagatgaaattatgctgaaaaaagcaacatggccgctatttacactttcaaaaaaacgtaaaagaatagatactaatcctgattatcagcgaccagcagtatggacaaaagcacaaaagcaactattgattgattcaattttacgagacttcgatgtacctaaaatttatttgcacgaaaaaaacaatgacacatatgatgttatcgacggtcagcaacgtattcgtgcaatatggtcgttctatgatgatgagttcgctttgcctaaagatgctgaacctgttaatggttatgatgttgcaaacaaaaagtatagcgaacttgatatggatattgcaacaataatagatagctataatttggatttcgttatacttgatacacagaacgaagatgaaatacgagaaatgttcctgaggcttcaaaatggtacgactttaaaagctcaggaaaaaaggaacgcaatgcccggacgaatgagggttttataaaagagcttactaatcatgaattcttctcgaaagtcaatttttccaatactcgttttacttatgatctcatagctgctcaaatgacacttcttgaattgaacaagggtatttgcaatataaaagatagagatttaaatgcaatgtatgaaaaatcaaagaattttaatacttcatccactgatgccaaaacaatatatcgcattttggattatcttaataaaatgtttcctgtcaaaacaccggagttgaaaagatacagcaccatttcactatttatactaattatggatttaatgccgaactatgatattcgtgagcgagaagctgatattgcaaagtggtttattgattttgaagctgagagattattagacgaacataaagaaccagaaaagcaagatccacgtcttgtagtctaccatgaaagagtatctcattcatctgactcggaagattcattactttacagacataatttccttaaagaaagccttttaacccatgttcctaatcttccacaaaaagatcctaaaagaagttttgacgaggcgcagcgtcaagtcatttatcgacgtggaaacggtatttgcaaaatatgtggggtaaaatgtaattggaataactgggaagcagatcatattactccatggagtaagggtggaaaaaccgaaatagagaatggacaggtactctgtccttcatgtaattcaaagaaaagcgattcgtaagaaataatatccaacaaaacttagtctattggtgcacacaaaacctatcccacacaactcacattcagcattgtggtatatctcataatcagtggatactaaaatgatacatagcaacattaaagcaccctctcggagcgttcctgagagggtgctgttttcatcggtttgttttccgctcggcaggctcggacggcgttgaggggcattttcgttcgtcacagtccgcaccacattgctgataagctcagcgaggacggtgtaccaattccctcagattactactacgcaaagcttggcaaacctaatcctcgccgtacaaggcatatgtggagccgtgaaacagtcaagcagatacttcacaattacacctacctcggacatcttgttcagctccgcacaagaactgtcagctacaaaaatcacaaggtcatcaaaaatgacgatgaagacatgatcgttgtgaagaatacgcacgaagctattgtttctcaggagctttgggacagggtgcgtgagatggagcaatcggtgtcgcagggcaagcgtaacagtagtggctcagcggtttgatctactgtcaggactgcggaaacaaagtccgccttgcgtggaacaataccacaagcggcagtaagaagaagccgagaaagtatatccaccacaattacaactacacttcttacatgaaattcggaaagcgatactgtcccagccattacattaaaatgcaggatatggacgctatcgtgcttaaagatattcgcagtctcgcactagaggacgaggaaaaggcaaaagcggaatctcttgcacgcaaggcgaagcatcatgaagagcagtattccgtggacaccaagaagttcacagaaggcggataccgcttacaggagcttacccgtgagatgtgtctggtatcacgcttgatgcctatgtcgaggtgcagccccgtgagatctacatctactacgagctactcgatgaacccctcaaggacaagagaagcctgttttaaggcgtatttacgttatttatcaaccatacgaaagtgtgttaccatttggcaaggggactaccgctgatttttacagtcacttggatttcaactctaagattgactcagctaatacgatcgccaatatcctcggtggcggagctgtcgaaaggccgcccgctacggaaagcaagagtgtaggaagccctaatacggctgatgacatgaagaaataaaataaatgtgactgattggtagataaacggacaaaaaaataaaatcggacttcaaaaaagcccgattttacgatgatttatggtgccgctaaccggacttgaaccggtacgctgtcgccagcgagggattttcgtactactctatgttaccatagccacacaaagcgtgtgttgtagtctggacttggtctttaccatatcctttcggacttaggtagtcggtgtaaggtctctacactcaccctgacggattagcacggcgttctgtttgtgccttcgccgttttagccgacttctactccacagatttctctgtgggcactctctgagaaaaaactcagacgcacattgctatgcgtacaaacatcaaagtcccttgtgtctgcctattccaccacagcggcatgcaagatatattataacactttttttgcaaaatgtcaacgcttttttgcaaattacaagttgttaaacggaaataagtggtaattgtggaatggcaacggtgtttattttaaatctttttgccttgaaactgaaaatctgtagataaatacagatatcaaagcggtgacgacttctgttatccagaatgcgttccatacgcctgttggtcccgtgagcttgcagaggaagaacgcaagtggcagtattatcgcaataaatctgcacagagatatcataagcgatggaatgcccatgccaagcccctccagcgcacctgatgaggtgacggatactgcggagataacaaagccgatacaaattaggcgaagtgcagttttgcctatggcgatagtgtcagcgttttccgtgaaaagccctatgagcttggctgggaaaagtgcgcatatgatagttcctgccgccaatatcacacctgtcatgtaaagaacaatgcggtaaattttcttcacacgctccttctcgcctgctccgtagttaaaactgataactggtcgcataccctgaataacaccgtttgcgggtagataaagaaaggtctggagcttgtagtaaattccaagaacaagcacatagctttgtgaatatgccgcaagtatgccgttgagggcggatatgagaagtgacggcagtgcaagattaagtgttgcaggaatgcctatggagtacatctttgcgattatcatgccgtcaggacgcttgtgttttgcggaaagcttaacaggaagctcacagcgaagatatgctattatgtatatgacaagggtcagcacctgaccgataccggtggcgagtgccgcaccctttatacccatctcaggaaaaaatccaacgccaaaaataagcagagggtcaaggattatgtttgcgatacagccgcagagcatactgaacattgatatcttcattctgccgacagattggaatatcttctcaaatgcaatggcaagcattaatgcaggagagaatgtaaatacaatgttacaatactgcacgccaagatctataacgtttttattacttgtgaacatagatagaaatgcaggcattatgagtatgcaaactatcatgaggacaatgccgtgcaccgctgaaagtgcaagtccctgagttgcggcaatgtcagccttttcctttctgcctgcaccaagatatatggcaatgaccgcattgatgccgataccaaagccgatagcagtggcacttataaaattctgcacagggaacaccagtgaaagcgatgtcattgcgtcctcgcttatttttgctacaaaaaagctgtcaatgatgttgtaaagagagtttacaagcattgatatcaccattggcagggacattgaaagcagaagagggaagatcggtcttgttttcatgaaatcactgttcatttatttttttacactcctttgtctgtgggcagaaaaaaagccgcacagcctgtttgctgtgtggcgaaaagtgacatactgtcaggaaaaatccacgcaagttttacaaagtatattttaacatagcggtatgattttgtcaatgaattttctttaatattatgtttcaaaaaagtatacaaacacgctaattgtagattgacaagatttttctgctatggtaaaatgttattatgataatttatgttaggggagaaagcgtaatgacttttatagagtggctcaaagactgtaatgaagcagaccctttgactaaaaaggtttacatatgtaatgattatctcaatgccgagagaatgttggagaactcaagcggtgaaaatattgttataaggcttgaaagatacacagtcgcagatcatgcaaagcatattatcgaaaccagtgccgagtatatggacagcaggataataacgctgtcaaacgctgagggctgtgagatagtaagacgtattattgatgaaagcggtataaactatttcaaaagcgatgaccataatgcctgcatggagatattcaagacgatatcagagcttagaatgaactgtataggccctgattcattgtccttggacagcagacgtatcaacacgctaagagcgatctttcaagtgtatgaaagatcgctttcatacagcaaactatatgacagtgcaaagctcataagcattgccagcggtcttataaaggctggtaagacagacgtgaacagcgttcattttgcatatgacaaagaaatagaagctgacaagctgacagcggagtatatagggcttttgcctgatccttcggttatagataacatggctgatatgagcgatgagcagtatcagaatggtctgagagagttagcacaaaaggcggagctttggagaaattatggcataacaaacgaggtggagagaactgttctacatatcgtgaacagtggttacgagctttgcgataccgctgtgctgtgtccagatgacgagtatatggacttgctcatgaatatgtgcgatcaatacaaagtccctgtggaatttcctgagggcatttcatgcagacacagtgacgttgttgcatttttcagggcaatgctcaaatggtgcaaaaatgactatagatttgaccttttcaaagatgtgatgctttcgcctgttttcaaatatgaggagaaagtagaggacggcaagaccaaaagcaagggcaggatattccttgaagcacagaactctggaaacggctggggcattgaatggtatagcacaaggaatagtcaggtgttcaaggacttttataagttctttaaaaaagaaaatgtcagcgcaaaagagttttacggtggcgtgctgaacttggtgaatgattatgtgaatggagcaaacgctgggcagagaagttctatatcaagcgttaaggacgctttgataggcagatacagattttatgcagactatgacaagagtcttagcttgcaggaagcaatgactgagatcaccgacattgcagagaacgcaaggtattctttgcctgcatcaaaaggcgctgttacctgctgtcttatggggcggtattctgcgattttcatgaaaaacatatatgttcttggtctgacaacaggaagatttcctgtcatgcaggacgagtcgcctgttctgaacgataaggagagagaacagcttttcggcaaccgtgaccattgttctgacgctatcgagcgcagaaagctcactgaccttgtgagaactgttctcatggctgagagagcaaaccttgttgtaagctgtagtgtttatgataccgtagaaataagagcgcaaagcccgtcggcagtgtatactgttattgcggctgaaaagggcattgatgtaaacaaaatagaagtgtatgattatctttctgacagacgcaaggtgagcgtgcgttctgagatatcattaaacagtgattttctaaacaaggcagaaaaaatcgggcttcatgatgacggtgcgaagcaaagcgaaagccttacggagtatcttgataagcaaagaaaaagccgtatagatatattgcgtgaaatgtgcaaaaatgaacattttatcatttctgccacaagcctttcgactatgcttcagtgtccgctgaggtttttctatgagcgtatcgctcatgttgaaaagccgcaggaggtggatatagaccgcagtgcatggctcaaaggcaatgtcaagggaatgtatatacatgagataatggagaattatgctaagactgtgcttaaaggcaaaagtgcggctgaggtgtctgaaactgttgacaaggcgatgcttgatgagatattcgagagcgtttctaaaaactatcttcgtaactatccccctgtggatatggctgttgcgcagagtgagagaaatgaatattacaattgtgtcaaggcatatcttgacgaactgcacggcgatatacactcaggcaaacgtgaggtcgttgaggtcgagtatccatttgtcggcgatgtgaaaataggagagtatgaagtcaccataaggggtaggatagaccgccttgacaggataatagacggcacaaaggtgtcataccagatagttgactacaagacggaggatatcaaaaaattcagggagaagcttccagaagacccgcaggatcatatttatgcccttgcacttgaaaatggttgtacgcctgtgggcgaagtgagcgaaagtgatatcgtttccgcagattatgttttcattcttgaaaaaggtaattgccatgtagttaacaataaggataattctgggatcgaaaacatgataacaataacatttaagaaaatagtagaagagggctttaaaaagtgtattgtgaataagaatgataaaattactccatgcacgttttgtcctgcttatgaagaagtttgctcagggggtgcaacagaatgagtgaagaacagataagaagctatataatagataaagacagttatgataagaatatccttgttgaagcaggcgcaggtgcaggcaagacaaggcttataatacagcgtgttataggtcagataggcgcaggtatacctgttgaaaagatagtgcttataactttcaccaacgctgctgcaaacgagctttatgagaggatacaggcagggcttacggagaatatcgcaaaatgcagcggtgaggaaaagaagctgtatgagaacgctgttatgaatttacagcgcatgaagataagcactatacacagcttttgtttgagtatgctgtcagaacagccttttgaagctgacctgcatttgggattaaaacttgccgaggacggtgaaacaaagcaggcacaggctgactttttcgagagatattaccgcacaaatggtgcgaacacagaagatttcggctttctgaacagcaatcaatataagctcagagacagccgtgttaaaaactttcttatggaaacatttcttgagtgtgctgaatacagagatgttgagtttgttagggataaaagctatgacagtgtgacatttgacaccataaataagcttgcctataaagaaatgtgtaactatagggatagtcttgtgcgtgcgttctataatggtgctttgggtggaaaatacgaagatatagcaggttttcttgttgatgatgtgacgaagaaattacctgatgatatgaagacctatgacccaaagtataattatgtaaaagtttgcgctaatcttaaagcttgcaaaaagttccttgagccttttaataagactaaaattaagaaagatcatccaaagagcaatgagaacatggctattttcagcccaagtgggtttgataatgtaaagaaagaaaatgcactatatgccctcaacaagacggcaacgtatatagagcaggctgtaaaggcttatcaggagagtgaagacggggagagcgtttcaaatgacggacttttgtatcacactcacgagcttctcaaaaacagcagtgaggcaagagcgtttttcaaaaacaagtattcctgcatttatatagatgaatttcaggatactgatgttatgcagactgagcttctgctgtatctttgtgcagacgacagcaagcttatagcaggcggtgatatatggcaatgcccactccgtgatggtgcgctgtttgcggtgggcgaccctaaacagtctatctacggcttccgtgacgccgatatcaggctttataacaaaatgaaagccaaattccagaacaataatgagaaaaactgcgagtttttctcacttgattacaacttccgctctgatgagcagcttatagcttgggtaaatgaaaagtttcagccggaaataaacggcaaatatggtatgacatacagcgatatgatatcaaaggctgataagcctgcggctgtttccgatgatgttatcagaggggcgtattttgtcaaagatccgggtgctgaaagcgtggctaagataatttcagaccttgtgaacggtggaaagatattcgacaatggcgtggaaagacctataagatacagtgattttcttctgcttctttggaacacaactcaaatggagttttattcaatggtcttgacagatcgtggcataccatatacaatgtggggcaaacgtcctcagaaaaacagtctggtgctgaaaagatttattgctcttgcagagttcgtttttgaaagctacagtcctaccgcaaaggaaaaggcttattctatcctttggagatgtaggcctgacagcatcgattttgaagacgctgaaattgacgtagacgattatgaacaaaactgtgaaagcaatgacgccacgcttgttgcagtaaaggcgtctgccgatactgtcaatgagcctatagcgaagctttataagatacttgattttcctgagcttcttttcgataataccagcaacagagaatatgagctttcaaatcttatctatcttattgaaaagtgggaaaagcaggattttgcaggaaacgatgagcttatggacatgatgaaaaacgaactttctgtgctgaaagaaaaagagcttatccttgacagcagtgagcagaactgcgtaaggctcatgaatcttcacaaggcaaagggtcttgagggaaatatcgttattatggcggaggctaaaaatcataaattcagcggtggaaagtacaccgaccttgtggctaaaagacaggtctatgtacctttgaaaacaagcgatttttcatatattgactatctgacattctaccctaatgagatgaagcaggcagaggataaatattttggcgaacagctcaggcttgaatatgttgcggccacaagagcaaagcaggcttttatatttgtgtatacttttgaacggaaaaaacctgtgatcgacaaacttacaatgagcaaaataggcagagaattgccgcagataaacaatgccacagcgcaaagtgctgtgcaggcggcgcagataaacgtcaaggatatattcgacgaggtgaacaacagccgaaatgcttttgatgaaagcgttaaaaagctcagtgagaaacatgttagcaaaatcactccgagccaccttgaggacggcaaaaaggtcactataccaagtggagtagagaaactgtcttacaaacgtccaatgggcagagatatcggtcatatggtacatcgtgcctttgagcttgcggtgaatatgcgtggaaagctgtttccgtataacgaaacgccacagcagaaagagctaatccagaagattgtcagcagagcgtatctcgactttgagggcgagtgcagttcgcaggcttctgagagcttttataaggactatatcaactatcagcttcacagctttttgaaagataaggatatcgaaaaattgctcaaaactgcgcaggcagtgtatacagagcttccattctacagtatggacggcaatgaatacagcaacggagttatggatcttgtgcttaaaatgtcagacaaaagctttatcataatcgactataagaccaacatacaggaagaagccgacagaaagctttttgaggagagaattttaaagacatatcgtccacagcttgatttctacgaaaagatactcagaaaaatgctttcgctcagtgagaaaactgaggtggagtgccatatttactttatgaatgacgataaatatatgaaaaactagagcaaagtcgcttaaaatatgaatgagttaatattatgaataatattataatttgtatcgttcggttgacaatgtgattgaggtgtggtataataaatcagttaataatgtcgaaaaaagtaaaaaaagcaacaataagtctacactaagcgtaaggagaacgtgaatatggacgtgtacaaattatggacctgcgatgataacagcgaaagccaactgagttctacctcttcggagatagaaaaggaaattgacgttctcaggaaaacttttgattttgtcaggcttctgaaagcggacggtcctcatggagtgagcggctgcgttgaaaatccatgtcagtgtttttctttttggaaagtggacgagccttgtgaaaactgtatatccttaaaaacttttattgataaaaagccgagaactaagcttgaatttatgggaactgacatttatcaggtcttttcaaagtatgttcagattgacggagagccgtatgttatggagcttatcaaaaagcttgatgaggactctctgctgggtgttcaggacagagaaaagataatgaataagctgtcaaaatatcataaggcaatgtatactgatgcattgacaggtgcgagcaacaggagatattttgaagataagcttaaaaagtcccatgtgcctgcgggtgttgcgatgatagatcttgacgacttcaaggtttataacgatacatgcggtcatgacgcaggagatatggtgcttgtgacagtggttgatgctataaggcgctgtattagaaaatctgatgtgcttgtgcgttatggtggcgacgagtttttgcttgtcatgcctgatattcaggaggacgattttgcccataagctcaggacgataaaacgaaatatccatgcggcaactgtgccagggtattcaaatatacgtctgtcagcaagcgtcggcggcgttttctctgatggcaatagccttgacgaagctgtcagcaaggctgataagcttatgtatcaggcaaagacaaagaaagatacagttgtcacagatggtcacgaaagtgttgtcggtgagcctcaaaagcaggagatacttattgttgacgattcaaatataaacagagagatactctctgaaatgcttggcaatgaatatatcatacatgaggcggcaagcggcgaggagtgtattgacctgcttagtcagtatggcactggaatttcacttgtgcttttagatataatcatgcctgaaatggacggatttgaagtccttgactatatggcggaacatcattggatagatgatatccctgttataatgatatcaagcgaggattctgcgtcctctataagaaaagcatatgagtttggcgtttctgattatatcagcagaccatttgattcacgcgttgtgtatcagcgtgttttcaataccattaagctttatgcaaaacagcgcagacttatttcccttgtaagcgaccagatgtacgaaaaagataaaaacaaccgtatgatgataagcatactcagccagatagtagagttcagaaacggcgagagtggaagccatgtggtgaacataaagcgcataacggagctgcttttagataggcttcctatgcgcacaaacaagtatactgtcagcggcactgagcagcttctcataccaatggctgcggcactccatgatatcggcaagataggcattgacgataagatactcaataagcccggcaggctaacaaaagaggaatttgagataatgaaaactcactccgctatcggagcgaatatgcttgaaagtcttgagcagttccgtgacgagccactcttgaagatagcccatgacatatgcaggtggcaccatgagcgttatgacggcaggggctatcctgacggactaaaaggcgacgagataccgatatcggctcagatagtttctgtcgccgatgtttatgacgcacttgtcagcgagcgagtttacaaaaaggcgtattctcatgaaaaggctatggcattgatacttaacggagagtgcggtacattcaaccctgtgcttgtcgaatgtcttaaagatattcagaacgaacttgcaaagggcgtagaataagagatgatatgatttgtaaggagtgtcctgatgactactagagaattttatgaaagcattggcgcaagttatgacagcgttctggtacgtttcggcagtgagaaaatgataacaaagtttgcaaaaagatttgctgatgatacaacttttcaggatatgtgcaaggctttagaggagaaaaacgccaaggaagctttccgtatggctcacaccctcaaaggcatttgcagtaatcttggctttgacgagctttacaaggcgagctatgaccttacagaggatcttagggacggtgagctgtcaggctatgagcaggattatgaaaaggtctgcgaaaaatataagatagtttatgacaatgtgacaaaaatagataactgagttttgaccgatagtctgtcagactgtcggttttatggtgagggggagcttccaccacatgagcttagaatgatgtctgcgttcaatacgaagatagcaaacttcaatcgcaaaactatcaagggcagacagcgtttcagaatgaaatatttaattcgccccagaaaatagcaaaacacccgtatcatgtgcgatacgggtgtttttttatcagaaaccttgttctttaagctcttttactatatctacataaaattctctcacgtcaaaatccttgatgttctccctgaaaaggtcgataacatcgccatgagaaatgccacgcttgcccttgtgttctatcatcttggagttttcaccataaagtcccgactcaactgttactagcccatcattgccattgccgtatggcttgttgagcagatagccgatatttaacggaaaacctgcagaacgtatgctgttcattttgctcatgacggagcggtaggaaaccaactggctgtcaggggtgcttgcgttaagctcagagcagtttttataagtcaggtcataaacgccatctaaaaagcttgggtctttgtcacccagagcagtgaaaagcttgttgtattttctatcaacaaagctctgtatgctctcaggtatcttcccaagaagcatatcaacgaatttacagccatagtgtggtgtgtttatggtggtaagagttgccacatatttgtccatgccgaggtgagagatagcgtatctcgagtcaagcccaccctttgagtgtgcgattatgttgaccttttctgcaccagtttctgcaatgacttcttttatcctttcagctacctcagtggcactgacggatactttgttggcagactgttgcttgccataatagacctctgcgccatttctaataagttcattaggtaccctgccccaatagtttattacctgccaatcacggaagaatatgccatgcaccataagtataggatactttgtcttgcatatctcgttctcttttcgtgcagcgtcaaggtcaagctttgcctgctcgaagtagtattcacttctcgctgccttgtagaattttctgaacacgatgcagttcacaagaggtatgtaccaggtgaataacagaataacataccacagtattttcacctgacgtgccgaagccgctatccgcacaatgccactcagacacaaaagcgttgttatagcataagcgcaaagtgcatttgcaagaaaccgccaaccattcagctttgtaaagcaaagtactatcactattataagctgtataacgctttgcaaaacaccgcaaccaagtacaaacgctccggaatcaagccgtcggatttttccgtgagaacctttgcatccatgtgatttgaacatgaaaaccaaggtgtatagtgccaaaagtatgatgataagcgttttgagcagagaatttatgttaataagtttccacagcgcaggtgcgtttgcaagcagaagcaccggtatagaaagaaaagttcccctaatttttttcattttttaccccttaaagattatttttcagctttacgtgtctaatatcgtttcccacaaacataataggcatgaaacagcctgtgagcctcgaaactatacgctcattatattttgcattgtattcttcattggtgagattggtagagattatcgttggcctgccaaggttgatacgctcgttgattatttcatagatcacggaatcggtaaagctcgtttgaaattctgagccgaggtcgtcaaggataacaaggtcggcattctctatgatgtcaagtgtctgacctgtagctctgccaaaatgctcgtcctctatctgtctgagaagcttcagcagagaggcgaaaatgacgctgtaacccttttgtataagttcatttgcaatgcaggctgaaagaaaagtcttgccaagacctgttttgccaatgaaaaacagtgatggagagttttcatgaaatttgtcagcatatgcacggcagtttgaatacaccgttctcattttctctcttggtgacattccgttaccatcactttcaggataaaattctattctgaactcagagaaatcgtgaagctggatactgcaattctcgttaagctcctcagtggtgtattttttcagcaagtcggtgaagcactggcacttcactccgtcacgatagccataatcacagcatttaggacagtaatagtgataatcaaggtagtcttcaggataacctcccattttaagcagccctttaatggcacgtttagtattggcattgttttgacgcattttttgtatatattctcttccatgagcatttttgcctactatgcccttcatgagttcacagttatttgcttttagtgatcttgtaagaacctctatttcaggaagtcgctgtgctatctcctgagcgtgaacctcatgctcgttcatgacagcttcacgccgtcttttaagttcattttcagccttgtcatatgcggttattgaatatttcattttctactccttatcatagctttcctgatttttctagatcaaaattcattgcgaatttttcaaaatcatcaagattataggaagtttgcttattagtattcttatttttcttggaggtgtggtacttttcatcctcgtgtgtgacctgttcaggggtagtgatgctcttgccagcccagtttgacagtatagtgtctatatatttgtaattcagtttgttggtattgtcaacgcacttgttataggctatctccagcatttcaacagtgaagcccattgtgcgccatttttctataaactcaagctgctgctttgacggctttgcggtctgtccgaaaattttcagtaccttgaattcatacttttttatgttggaaagcctaattatttcttgttcaatttgttgataagtacagatgtcttgttcaaaccaccctcgcattactgtcacaaggtaagacacgttgtgcttttcaagtgacacacagtattctgcggctaagagaatagatgcagcatcaaatcggtaatattcataaagagcaagaagttccccttgctcagttccattgatagtgcgttgtaaaacggtttgtatctcgtcaaaaagatgtgcaaggttagggtccttctgctgtttttccaatatctcagaattcttgtatcttatgcacagcttgtttgaaacgctctgacgtttcggggcaactgcctcaacttttgaaacaggctcggcctttgtttcaggctctgaaacaggtgtagaaacggctttgacctgtgcaggatttgtcgtatcactgtgttctgtggtgatgactcctagcgatacccagtgtgtcacagcgtcaatgacagtgttctcagaaagcccggacttttccgcaagctttgcactgtcgcattcacgttccgttgaacagagtatgcagagaagtacctttacaaagtcgccatcacttaattttatgtatttatcgaccactttagacggcactgaaaaactgctcccccagcggtcgcaatcaaaagtatatttcattatgtatcctcacaaatatgattaaaactatccaaaataattatatcacataatctggacttttgcaacaaaatttgtgcatttgacttttgataaataaaatgctataataggctaataccaaagaaacggagagataaaaatgataagaaaatttgtgcctgaggacagggaagattatatcagattttccactgagttctataattcttctgcggtggacaagcctgttccaagagagcattttgagcagggcttcgatgaaatgatgaggtctgacgtgtatgtgcagggttatatgctcgtttgtgacggcaataatgttggctactgtgttacaatgaaaacatattcagttgaagcaggcggtattactatatggatagacgagctttttgtgctggaggaataccgctcaaaaggtctaggcagggagctttttaagtatatcgaggaaaatggcgacaaaaagctccgccgtatccgacttgaagtcgagcttgaaaacggcagagccatatcgctttataagaaaatgggctttgagcctgcgccttacgacggaatgtggaaaactattttatagtcctttcgtgaatttcccttgaaatgctgtcgcaaaccttattaagggcggcgtgatccattgcggcgatataatacttttctatctcgtcatggactttcttggctttcttgatgcctgaatacacttcctctgcaaggtcggaggcggtgactttatctaatctcagtcttgttttcagggctgagatctttttcttgtcataaaatctgcccatgttgatagctttttcaaagccgtcaagctggcttataggggaatttatcacaaatgcgatgccagcctccgggataagcaaatgctcgtaaagggtgttgccaaataggatagcagggcagaggataacatcataacctcgctttacagcctgctgtgccatgagggtgacgaacttgtgggaagcggcataataatcatcgttcatggcgaacacgtcaaggtagctgtcaagagtggcaagctgcgtcatacagccgtattctgtcaaagcggtcaactgtctaagatcagttttgccgctgccagagccttttttgtttagaagacgttttgctgatcgttctgtgaagcttttcagcttttcctccagcagacagccttcaccgcaattgtaggtatcaaagcaaacgttagacagggcagtggtaaaccttttgcttcttgccaaaagcgacttgtttttgtctgtgacctcgattatttcagatctgaaggccttcagtttttcttcgtcccaatactctcctaagttgattattttctgacaaactcctggatatgaacattccataacgtgtggcgcagtgccgtcgcagattatggcctttgatgtatgcagaacgattgcatcaagggaagcaggatcagaggagcaataaaatctagtgacgtcctctgtcggttcaaactcggcggctatctttttcataagtgaagattttcccgtgcctgcacctcctttgagtatgaatgtgaaatactccttatcagccattatcttgccaaattccgtggaaaacccattctgcgtcattgcaccaaaaaaatacttttctgacataaattaccctccatatctcaaacgcatcagatcagtgtgactgcgtttgcattttcatttttataatatgtcagaaaaagcatgattgttcaaaaaaattaggtggacaaaaaaagcttgaataaagtaaaaaaaactttcattgcatgacgttgcaaattgacattgtgataactaccttatctttcctgcctgcaacaggatacaaaacgccgtccgctttatgcagtgccttttttactattgcagaacttttcattatgttccgcctttcttatctatcttaattctgcgatatcatacagctagttatgactaactcgtaaacttttatgatagcacaacaaggtggaaatgtcaatagaattggggcgatggaaggcggtaaggacagaaaaataccgatacagagggggctgtatcggtggaatatatgggtaaagcttagtctggaaattcaagagatcttgtacatatcatttttgtagaacattattgaatcgtttttttcagagcgccttagaacggtaaggacattataaacatctggaaatggcgaaaccatacccatacacgccataccaaaattcaatccattaaatactctaaattcggcaggactaattaaaaataatataaaaggaatcaccccaagaacaaaaggcagcagacacatcaatataaacctatctcgttttaatggatatgatgctaatgccacaaatgttgtctttcctttaattcttcctattgttacatctgcgtccttaggataaacgattccgtgtaaccactcg

SEQ ID NO: 53 - DNA, 2866039 bp, Ruminococcus albus (residues 1,433,021-2,866,039 of 2,866,039)
  modified_base (551278)..(551376): a, c, t, g, unknown or other
  modified_base (552315)..(552408): a, c, t, g, unknown or other
  modified_base (1935508)..(1935606): a, c, t, g, unknown or other
  modified_base (1961094)..(1961191): a, c, t, g, unknown or other
  modified_base (2103944)..(2104040): a, c, t, g, unknown or other
  modified_base (2224851)..(2224949): a, c, t, g, unknown or other
  modified_base (2260447)..(2260542): a, c, t, g, unknown or other
  modified_base (2534879)..(2534973): a, c, t, g, unknown or other
  modified_base (2775625)..(2775707): a, c, t, g, unknown or other
  modified_base (2802337)..(2802432): a, c, t, g, unknown or other
tgaattatcaacaataaaaagcctaaagcaaatcccaccagaataaatattggagagatcacgaccaccttgcacacaatggttttaccaagcatagcggcaaaaagtaaaacacatagaattacagctatcggcaacgcttttttcatcagttcatcgacgctcttaggcgtttctatctttattgcattatcgggtaagtttcctgtttgatatttatttatatcttttattgaccacacaatttttatcatattacatacctttgtttatctaatctcgatttatcgtctaactatatcgtattattcattataccacaccatatgccccaaagtcaagcaaactattcgatccgatatagtttgaaactatatctatcccacagaaataaatattttactatcgccttttttcgtgctatactaaataccagcaaaccaataggaaataaactatagtaaaatgaaagaggtaatgaaaatgaacaataatatcaaagcaccatgccgctacgattttgtgggcagctttctcagacctgactatctgaaaaaggcaagagcagattttgaaaacggcgctatcacagccgagcagcttaaagaggtagaggataaggctatccttgacctcgttgcaaaacagaaaaaggctggctatcatatcatcacagacggcgagtttcgcagagcaacatggcatcttgactttatgtggggcttcaacggcgttggtcacagcaagacacagacaggtctgcctttccatggcgaggcagcaatgatagacgatacatacctcacaggcaaggtatcagttggcgaccacccatttgttgagcattttaaatttgttaaggctctcgaggacgagaatacagtcgcaaagcagactatccctgcacctgcacagtttcttgagcagatgataatgcctttcgcactggagaacacaaagaagtattataacgatacagaagagcttgttcaggatatcgcaaagggctacagaaaagtcatcgctgacctttatgcagcaggctgccgcaatattcagtttgacgattgctcatggggcatgatagttgaccctaatgcaaaggctatttttggagttgacgacgcaggacttgaggatataaaaagacttctgctgagaataaacaaccttgctatcgatggcaagcctgaggatcttgttatcacaactcacgtttgccgtggcaacttccactcaacatatgcaagcagtggcgcatatgacagtgtagctgaaacacttttcgcaggcgaaaatgtaagtgcgtattatcttgaatttgatgatgagcgttcaggtggctttgaacctttgaaagcagtaagcggcgacaagaaggtagtcctcggacttatcacatcaaagaagcctgagcttgaggacaagcaggctgttatcgaccgtatccacgaggctgcaaaatacatctcacttgacagactttgccttagcccacagtgcggcttcgcttcctgcgagataggcaacaagctcacagaggaggaacagtgggcaaagcttgctcttgttaaggagatcgcagaggaagtttggggataaccaacagatttaacatatatcccgagggatactcaatattcttgataaaaaatgactcatgtcaaaacatatccgacttattaacagatcatacgagtgcagagaaaaggataaataaaaacaggtagataactcaattgaggtatctacctgttttgttcatatttcactatataggtcattcatattagttctttgaaaatgtctatatgagtatatatcaaattgatgtgagtcatttttttagcttaattatgttgccacacgcaacgtattttttatagcctatgtacccaatcaatagccgcctctgcccaatgagccgccaccggctgatagtgaccttcccatgtggcagtggtttcgtcgcacaatgcaagtccatgtccaccgtattcataaatgtggctctcgaatggaatgtgatactttgaaagactgcacatataccaaagtgtgttctcaacccttacacagccatcatcagcacagtgccagatgaatgtaggaggagtgttctccgatactctcttctccattgaaacaagctctctgagctccgatgatttttcctcgccaataatattgagtattgagccttcatgagtgtattcaggttcggatgtgataacaggatagcccaagatagagccgtttaccttgatgtcctcagggttgcagccaagaggctttgtgagcagctcgctgttccagaagtttgccattgttgccgcaaggtgtccgcctgctgaaaaaccgcatactattatcttgtcagggtcaatgtcaaatttctccgcattatctctaacatacttgacagccgccgcacattccaaagcgtcagtaggaaattttttcttgacgcatgagtatcttagcacaaatgcacatatgcctgcacccaaaaatctgaatgcaacaggttcagcttcacgctcagaacaccaatcatatcctccgcccgggcagattataattgccttgtgtttctttctgcctatttcttcagtgagtgtgttgtaatagcaatcaagcacaggtgcgcagccttcgcttgaaacgccagccttttcataatctacttttatttctactgtttctttaagcattttatttcctccgaaaaatttattctgtagccgcctgctggtctgtctgagaggacgagtcagcaggtgctgcattttctgtcatattcacgcagacgatataaccgtcaacgttgttgcctgagatagtgttaggacgctcattgttgctgtcgtcaagtggtacaggcacgttcgtggtgctgcccttgtctgcggcaacgtagtaaactgaatactcagtgtcatcaaaagccgtgaatgtgagcggtttttcaaatgtatagtccttgacaaaatctatgtattcttcaaggcaaagcttgtttgctgtcattatctcagcgtgtggtatacccacatatctgaaatgataagccatagggcttacacctgtgatgtcagctttgtcctctgggtatctgaggataagtccgtatttccagcagttttcagatatccaactacaatctccctcgcctgtgaactcaggatatgcgcctgtgcttgcgtcataaagatgcaggtcaaaggcaagtccagtgtcatgctcgtagcaggcagagctgctgtcttcatcatcttccgcaggcatagctgtgtttatcataagtgttgatatcttcttgtcagaataaaaatcattgcccattttgccaaaggcttcaaaggtctcttttttagccgtcagttgagtgctgctggtggacattatttgacttccgttcttgtcaaacaaataggaataaactgtgtctgtgttattcactgtaccggtgaaggagtggtcgccattaacgagaataagatctccatttaccatatcggttttgttttttgcggtaacatacatataattgcccgtaagcttttttacagcttttttactgctgctgtcagccttgaccgcagaggagtttgacgagctgtcggaaattttcttcgggctgtcagcctttgaactgcacgatgtagatattcccagaatgatcaaaagcagtatggcaagagccgctgcaatattcttgtatttataacgttttacttttggcacttaacatcaccttcctgtataacatacacctaaattataacacatttttcgtaataagtgaaccatatgccactgtagtgtcggcacttttgttatatcagacaaatgttttgcggacgttttatgcaacaagcacaaacataataagggctgtaccgcaaaacagtacagcccttagcaataaatattctgttagtttcttacatagtcaacaacagactttatgaacgcacgtccctcaggggagtgtgaaagcttatcaaaatcgcatgagcaaactaccaccttgccgccgtccttttcatactcgtagaggagtgaaagatcgtggttgcggtcaaagttgtcgatagttctcacgataacatttttctcacccttaaagtcgtcaagaataaccgagcgtgagttctgaactatctcccaccactgtggcgttgagtatttttcccctgcaaagcctgcaagagcagggtgttcattgtcgataagaagtcccattgtgccaacagggtcaggttttttcatcatctgtgagatgatacagaacatatgatagcaccagaagtcctgacagtagaagccctcaatagaattgtcaggccttgaaaggtcaggaacgataagcactgtcttgccctgtttcagcagactttcagcctcatcgttcacctcgtcgaaaatgtatgcgccgcttatatctgtcttttcaactgtcggtatcacccaaaggtcatagtgattgcgtatgtcagtaccctcaatttcaagtgcaagcacagcctttgtgttctttgtgacctgtgggagagtaaactctacatcgcaaatgtcagtgtagttgccttctgcaacaaaattcttttcgaccttgccaatgacaacaccgttttcaagagtgagagtgcaaataagcttgccgtctttaaggtcaggtctgtaattgcaaagctctgtgtgcgccttgaaactgctgccagcttcaagaacatagctgtcaaaacgcgccattacaacagcatcattgcagaactctctccactcgctgtctgtgataagtcccttgctgtccatgaatgcgtcaagtacacccacaagggcagtaccctgaccgctgaaatcctgaatatcgagtatctggaaaccgccaagaagtcttgagcggaaaacagcctccatttcttccttatagcactgcacagcaagcttgcctgagcatttgaaataatcctcagccagcggaagcagacccttttcatcaagtctttctctgaatacctcaaagtttctggctttaagggagcctgtgtatttttctatctccttgaagttcggataagtttcatactgacctatttcgtgagtaacgataggcacttcaggaataaaatctgcgtcagcttcgcttgccttgactgttttcatggtcgtgccgtactgtatctgaacagtgccgtcctcagaaacttctgtggagtttgcctgcttcttaggtcttataatgctgtcataatcgtgatttgccgcaggcttgtcagtctgaatatgaccaagtggagcgtcacacatagcgtatgagcctcttataagcctgtcgtttgcaagtcttacgccaacaaagaaatcgtcgttctcaataacgttaggaaaccactggaaattgtttgagccttgtgtgtaaaggtgtctgttatcaaatttcttgtagccgcctatgatatcgttaagtatcttctttgagccccaaagctcgttgcccattgacatcatgcagtaggaagggtgattgccgaagaatttcagcatattgaagccctcttcaacgaggaaatcctgctcctcctgattgtggttttcctcgccctcttctgtgatagttccccagaaaggaagctgtggctccatataaattccaagcatatccgcagcgacaaacgcagcctcagggggacagcaggtgtgatagcggtagtggttcatgccgtatgactttgatatcttcattaccctcagccactcgtcaaggtcggtaggtgcaaaagcggtcttagggaatatcatgccgtcatgttttcctctgagaaaggttttttcgccgtttatggtgaattttccaccctcagtattgaactcacgcataccgatgatatgctcgctcacgtcgccgtcgatatctattctcagcttgtagagattaggctcatgctcactccaaagcaggcaatcgttgcccattttgtataaagcgtcaagcttgccgtcggtgtattcaaagctctgcacctcaggagtgtggcttttttcgctgttgaaactctcagcgcttatgacagcttttccgctttttccgcctgttatgttggctgttactcttactgtcttgctgtggatatcgcaccaaagcataacattttcagcgtgggcgtttttgtagcctataagctcgatgcgtcctgtgattccgttccagttggtctgagtgtcaggtgaagtcaggtgaccgcccttggtcttgtagccaacatttgaaacgcagatagtcatttcatgtatgccagtaccgatatactcgttcaggtcatagatgtgcggagtgcaaaggctctcctgcctgcctatctttttgccgtctatataaagttcagttattcttgttctttcaagataaagtttaagattttcacattgcagagcagagaagtcaacgttttttctgaaccatgcaaagccttcaaatttatatgtgtctgtaagaaagcctgtttctctcttagtattgtattcgccttttttagcgttggaagtggtgtttggaaggtttattgtatcatcaaaaacaaggtcagtacccttacattccttgtcaagacacagcagccattcgccgctgaggtcaagcttgtttatcattaagcaactatcctttcaagttcaaattttcaatatccattataacatatggtattgcccatttcaaccgaaatcgtttgatttaaccaaaatgctataaaattttgttgtttttaacaataaaatatgatacaataagataaaaagaaatctgccaactggaggtgcaggaaaaatgcttgaaaatacagacagaaagctgttgtggctgtggctcgatgttgcgttcggacctgcggacaagcgcttgtgggacgttatgtcatattatgacagcgttgaagaaatgtgcgatgatctattgtcactgcgctgtggttatgttactcagcaggaggctgaaaagatagcctgctgtacgttctttcaggcgaaacaggtggctgaatactgcgagaaaaagggtatatatatcctcacccctgacgatcctctttatcctgaacggttgaaacagatagaatgtccacctgctgtgcttttctgccgtggcgatgtaagctgtctgtctattgaaaagagcgttgccattattggcactagagaaccaagcgattattctgtagccgtggcggaggagttttcaagttttcttgcagagcgaggagtaaatatcataagcggatttgctatgggtatcgacactgccgcacaccgcagtgcgatgcgtgcaggtggaagcactgtggctgttatgggctgtgggctagaatatgattatcctcgtggcaggacgggcttcaagcgtgagatagcaacacatggggtagctatctcggaatttttcccgcaggcaagacctgttcctgagaattttcgtataagaaaccgcattgtttcggcactttcacattgcgttcttgtggttgaagcaggaattcgcagtggcacgctgaatactgtaaatcatgctttatcccagaataaagacgtttttgttataccgcctcatgacattttcagcgagaaatacgcaggacagtgtgcgcttcttcgtgacggagcggtagaagcttattctccaaaagatatcctctattttctcaataaagccaaaatgtagaactacacttagttagtgtttaatatcatacctgtaccaaatcaacaatatctacgttagttgtaggggagcggctcaatttctgtttcgcagaaatgcgacgtgccgatcattcgttttttacactctatctaaatgaaaaaggctgcgactttttgccgcagccttttgtgatatttgaaattactttgaaagtgggctttctctgtagatgatgtcctctctctttggtccgtttgaaaccattgtgatagggaagccgatatgcttttcaacgaagtcgatatacttcttgcagttttcaggaagatcttcatacttcttgatgcccctgatgtctgacttccagccgtcgagaacttcaaaaacaggctttgccttttcaagctttcttgttgtaggaaagtctgttgttacctcgccgtctatctcatagcctacgcatacaggtattttgtcaagatagccaagaacgtcaactactgtgaaagcaacatctgttgcgccctggatacggcagccatacttagttgcaacgcagtcgaaccaacccattcttctaggtctgcctgttgttgcaccaaactctccgccgtcgccgcctctctttctcagctcgtcagcctcatcgccgaatatctcagaaatgaatgcacctgcaccaactgcggaagaataagccttaacaacagttacgatagtctttatctcataaggaggtatacctgcaccgatagcaccgtatgctgccagtgtagatgaagatgttaccattggatagataccgtggtcaggatccttcagtgagccaagctgaccctcaagaagaacgttcttgccctctttgatagcgttccaaaggaatgcagatacgtcgcaaacgtatggtgctaccatttccttatactccataagagtattgaaaagctcatcagcgtcgataggaggcttgtgatagagatgttcaagaagaatgttctttgtttcaagaactctcttgatctttaccttgagagcctcttcgtcaaacagctcctgtacctggaaacctatctttgcatatttatcagaatagaaaggtgcgatacccgattttgttgagccgaagcttgcctttccgagtctttcctcttcgtactggtcaaacagaacgtgatatggcattaccatctgcgctctgtcggaaataagtatcttaggcattggaacgccttcggaagttacctttttaagctcattgaaaaatacagggatattaagtgcaacaccgttgccgataatatttgttgtgtgatcatagaatacgccggaaggcaaagtgtgcaaagcgaactttccgtagtgatttacaatagtatgtcctgcgttagctccgccctgaaatcttactactatatcagacttttcagcaagcatatcggtaagcttgcccttaccctcgtcgccccagtttgcgccgacaatcgctctaaccatttaattttatcctccttgccataaaacagcaaaattagtagcagatatttatcaatgtcaacactgccactaggatattatagcacaaaacattctatatgtaaaggcacttttaaacatttaacacttttataacatttagcgtattaccatactgctatgataaagaataaaaagttttaatatatcttgcaaaaatcagatttgtgtattataatatagtgtaacggctcgtgctgtgagataacaaaataaaatacgaggggataacgatgacaaaaagaaaacaatgtgcggctcttgcgcttgcattgacgctgacaatttctatgttcggctgtgaaaaagacaaagaaacaacacagtcgtctgcggtgtcgcagataaagacaagcgactcagctcaaccaagcaatgtgaaggtcaaggaatacaaatttccggagtttctgaataaaataaaaagccttgacgagctttcacgaaagctttatacaagctttgacagcactcagtatgttgccgaggttgaggagcagtcttttgaggaatataaatgtgaaaagcttcttgcagatcttttcttcacttatcgtgacggcagagcagtgggacttcttgacaagtcgggaaacgttgtgcttgaagctgatgagtacactgaaataactgtggtgagcaatggtattctacagctttcttatgataaagagcgcaacgctcctatgcagtatatgaaatatgacagcgacggaaatttaagtgactataagcataagaaattctccgctgacagcctttatacatatgagtcgcaggctgatgacagcggcacagacgctgtttattcacttatgattcctgacggtaaaaatgttgtgtcatcagacggctcggataagtgggattctgttgagaagatatcagccgacagcatagacactaataaggcgtacaaaggcttttacaagctcacaaagaatggcggcatatactatgcttgctttgatgacttttataattatgatatctacgagggcgcatatgcaaaggtttgtgtgaaagtaggcggagaatacggagaatgctatcttgccgatcatgatgattacaacgagcttgtgaaaatgatagacagcttcggcaacgcttcatacaggacggctccgtctaaagatccgggacttgattttatacagataactctaggacttaaagagaacaccaaaacagagataactatttcttctgacggctattgcctgacggacaccatagaagctgctgagggtgaggctgtgaacaagtatttctcctatcttgacaaggaagatttcgcagatcttatactttggtgtgaacaggtgcttgctgaggagtatcaaaaatagatttaaactttttataaataatttgcaggatagcgtaaatttcctgcaaaattgttttttttagcccttgcaagttgttgacattaggtagaacttgtgctattatattaaaggtgtggcggttttcctgcatattttcaatgaacactgcaaatacttctcttgtgacgaaagttactaatgaagaacgggaggtatctgagtgtctgaacaagaagaaaatgtagagagcgaaaagcttgctgaggatataaggcagataaaggaaatgggttctgtcacattgccagacgcaaagcacgttatacactgcctgaacattatcggtcaggtggaggggcattatattttgcctgcacaaaacaagaccaccaagtatgagcatatcatacctgcccttgttgctatcgagcaggataggagcatagagggtcttgtgataatcctcaacactgtgggcggagatgtggaagcaggacttgccattgcagagcttattgctagtatgaaaacgcctactgtgtcaatggttgtgggcggaggtcactccataggcgtgccgttggcggtgtgtgcgaaaaagtcatttatagtgccaagcgccacaatgaccatacaccctgttagaatgaacgggcttgtgctgggagtacctcagacgctttcttattttgataaaatgcaggaaaggatagttcgctttgtgtgcgataattcagccataaagcctgagcgtttccgtgagcttatgatgtcaacgggcgagcttgtaatggacgttggttctgttatcgacggggagcaggctgtaaaagaggggcttatcgacaggctcggagggctttccgaggcgatagactgcctttatgatatgatagaaaacagttctgaaaaggagaaagctgaaaatgtttcagacaataatcgacctttatgacgtattcaggactgacgtagatatcggagaagagtttgaggatgatgatactgctgtggacacagacccggcacattatctcagccgtgacggcttttatctctgacaaacaacaaaatttcggaggacagcaatgggtatcatcaatgcgatttttcaggctataattcagggcttgacggagtttcttccagtttcaagttcaggacatctttcactgtatcagcattttacaggaaacagcggagagggagctttgtttttctcggcgatacttcaccttggcacgctggtagcagtatttgtggctttcaggaagacaatatgggatatgataaaagagcttggcgttatgataaaggatatttttacaggcaagttcactcttaaaaatatgaatcctccaaggcgtatgatagttatgataatagtttcctgcttctgccttgtaccgttcctgccatttaagggctggtttgagggcattgcagaggattcaagcatttttgcagagggcctttgtttcctttatacatcggcaatactttttatgtcagaccgctgtataaagggtaaaaagactcagggcaatatagcttataaggacgcaataacggtcggactttttcagggagttgcactgttgcctggcgtttcaagatcaggctcgactatttcagcgggacttttctcaggcatgaccagagaaacatcggtaaagtattctttcattctgggcatacctgttatacttatgagctgtctgcttgaagtcaaggacgcagtttcaacacatactgatatagattgggttagctgtgcagttggatttgtagttgccgcatttgtgggactttgtgctatcaagcttgtaaactggctcgttaaaacggataaattcaaggtgtttgcttattatacccttgtgcttggcgtcatagtccttgttatctcatttatcgagatgtgcatgggtcaccctatatcctttgcaaagtaatgacataagataatacagtttctgtgaaaaagcttgaaattctgttttcaggcttttttgtgggttataaaggcaaataacattttgcctttatttgcttaaataagacacataccgaaaggaatggtaaaataaatggcagctcaaaagaaaggctcaaagcctgcgccaaagcagacagcggcaaagaaaaagtccgcacaaaagcctgcgcaagctgcaaaaaagaatacaaaacagcaaaagcctcagagcaagccgcaacagtcaaattccatgacagcagtgagagaaagagagaacagacgcttctggtcttacatacttttctttttcggcatacttgaactgcttatcacgttcgtggaaggggacggcttgtggaaatggctccatgagctgaaccgaggacttttcggcgtgacagtatttctgtttgcacctatgataatctatgttgcacttatgatagcttcagatgtgacccataacaaggtcattgcaaaggtcgttgagggaagcgttcttatgcttcttataagcggcatggctcagataatccaagtcggctctgtggacggaagttcgttctggctcaaacttgtggggcttttcaatgatggaaaacagctccgtggcggcggacttgcaagcgcattgcttggctggcctttgctttcgcttttcaagagagttggcgcaggtatcgttatcgtgcttgtggcattcacttttataatgctgcttacaaatgttacgcttccgcagcttctaaaggcagtttcaaagccttttgtaaagagctatgaagcggtgaacgaggagcgtatcgagcgtgcggctcagcctccgaagcctccaagagagaagaaagagtcaaggcgtaatggtagggttgatattgcaaagttctatcctgatgatggccctgacactgcggcggaagcctttgtgcctgttgcagaggcggaagaagctaccgataaggtggacgcttcaaagatagatatgccggtccaccctgtaaaagctcctgtgataacacatgaaaagcttgaagaaacggctaagactaccgataatgaggagcttaaaaagataatagaaaacgccataggcgacggcagagaagaaaagaagtccaaggacgagcctgttaaaccaccagtagtgaatgttgataagaacggtcagacaacgttctttgagaaagataataaaatatctgcttacgtttatccgcctgtggatatactcaaatatgctaaaaatcctgtggcttccgagatagtccagcaggagatacaagagaaatctgcgaagcttgtggaaacgcttgaaacatatggcgctaaaacaaggatcgtgggcatacacagaggtccgtccgttacaagatatgagcttcagcctgcagcaggcgtaagagtgtcgaagataacgggtcttgcagacgatattgcacttaacctcgcggcaatgagcgttcgtatcgaagctcctgtgccgggcaaggcgtgcataggcatagaagtgccgaacgatcatagagatacggtttctctccgtgagcttatcgacagcgaggaatacagaaaggcaaagggcaagcttacctttgcagtgggcaaggatatcgaaggtaatatcattatcggcgatatcgccaaaatgccgcatatgctcgttgcaggtacaacaggttcaggtaagtctgtttttacaaactctatcatactttctatactttaccatgcgtcgcctgacgaagtaaagcttattcttatcgaccctaagaaagtcgagtttcctatttataataagatacctcatttgcttatccctgttgttaccgagcctttaaaagcggctggtgcgcttggctgggcggtaaatgaaatgaacaagcgttatcttatgttcgaggcgaacaatgtaaagaacttgcaggagtttaacgacatggttcttgaagaacgcaataagcctgccgaggagcaggacgaagtccgtgcaaagatcgacctgctgccacagatagttattgtggtcgatgagttcgccgatcttatgatggctgcgagaagcgaggtagaggattcagttttaagacttgcacagctcgctcgtgcggcaggaatacatatgataatcgcaacacagtcccctagggcggacgtgttgacaggacttatcaagtcaaatatcccgtcaagagtttctctcagtgtatccagcaacgttgactcacgagttatacttgatgaaagcggtgcagagaagcttcttggaaacggtgacctgctttataagcctgttggcgttaaaaagcctataagaatgcagagcggctatgcagcgacttctgagataagagaggttgtaaacttcctcaagaacgagcataccgcagaatacagtgacgaagttatcgcagaggtggaggagaatactccgcaaccaaaggacagcggttcggcaggcagcgataatgtttccgtaaatcctgatgatgaccttgtaaatcaggcaatatccataatcgtgcagacaaataacgcttccactgcgttcttgcaaagaaagctaaagctcggtttccctagagccgcccgtattatggacgagatagaggaaatgggcataataggaccacaggaaggctctaaggcacgaaagataaacataacaaaagaagaatgggctgaaatgcaggcaagaagatagctcaggcggaaagggataacatggcaggcagatctgcaaaaaagaaaaattcgacagcaccgcttaaaaaggcggtaacgctcatagcggtttttgtggtgctgctttttacagtgcttgacctgacggggttagtttctttcgacagcttgcttattaaggcaggcgttgaggacaagccggcggaacacgctcagacagaggtacattttatcgacgttggtcagggcgacagcacccttgtgatatcacaaggggaggctatgctcattgacagcggcgataaagatgacagcaataaaatagaaaaatatcttgaaaagcagggagtgacagagttaaaatatctcattgccacccaccctcacgctgatcatattggtgaaatgagcgagataatagaccagtttcaggtggataaattcattatgccgaaagtcaaggctgatatgacgcccaccacaacgatatatgagaaaatgctcaaaagcataaaggtaaagggcttgaagataacacaggcaaagcctatgaaatttgagcttggaagctgtgaggtggagcttttcacacccaaaaaggattatgatgatcttaataactattccacacttgtgaagataacagacggtgagaatagctttcttatcacgggggattgcgagaccactgaggagaaagatatactttctcagggttatgacgtttctgcaaaggtgcttaaagcaggtcatcatggcagttccacttcttcgggggtcgattttcttaacaaggtcatgccgagatatgctgttatatcctgcggcaagggcaacaagtatggtcacccacacgaggaaactgtcacaaggctgaaaaaatatgcttcccatttgtatgtcactgcagatgtgggaacgatagttttcagctcagatggcgaggggttgagcgtttctgctgaaaagggagaaaagtgatatggaagagattcttatagttgacaggatagaaaacggctatgccgtgtgcgaaactgagcagggtgaaaaaaaggatataccgctttctgaaacaaaagacgttcatgagggttacgtgcttattttaaaggacggcgtttatatcccagataaggacaaaacagaagcaagaagaaaaaggatactcgccctacaggaggatctgtgggcttaaatatatgctgaaaggtatagatagaaatggaaaaagatttatttacgcttatcaatgaaaagctttcaggcttatcaaagggacacaagcttattgcgaattacattctctcccattatgacaaagcggcttttatgacggctcagaagcttggaaaaaccgtgggcgtcagcgaatcaacggtggtaagatttgcctcggagcttggctatgacggctatcctgcccttcaaaaaggcttgcaggagcttatgagaaacaagcttacaactgttcagagaatagaggtcacttccgaccttatgagcagtgataacgtgcttgaaagggtactcaatctcgacatcgacaagataaggcgtactttggaggaaacctcaaaggaggactttaacaatgccgttgacactatcgtatcctgcaataccctttacataatgggtacgagaagtgcagcgtctatcgcttcgttccttgcttattatctgggacttattttcccccatgtaaagctcgttcagagtacgactacttccgagctttttgaaaagataatgagaatagacgaaaaggacgccatgataggtatatctttcccaagatattcaaagcagactgtcaaggcacttaaatatgcaaagagcaacggtgcgaacgttatagctataacagactcaaaggcttcgcctatcgcaaagtatgcagacagcctgcttcttgcaagaagcgatatggcttcgttcgttgactctctcgttgcaccgctgagccttataaatgcacttatcgttgcggtatccataagaaatatcgacagagtgtcccagacctttgaacgtcttgaaaaggtttgggctgagtatgacgtttacgcaaaaagcgaggaagatacacagtgagaagatttgacgcagttatagcaggcgcaggtgcggcaggaatgttctgcgcagttcagcttggctggcgtggaaagagcgttgctgttatcgagcatagcggctgtcagggcagaaaactcatgataacaggaaagggcaggtgtaatgtcacaaacaactgtaccgctgacactgttatgaaaaatatcccacgcaacagcaagttcatgtattcagcactgagcagatttgcacctgaggacgttatgagcttttttgagtgccttggggtggaacttaaaacagagcgtggcaacagggtgttccctgtgagcgacaacgcaaaggatatcgtaaaagcacttgtgaaagcctgtgaggacagtggtgtgcagtttatcgacgatgaggtaaaagagcttatcataaaggatggcagagcagagggctttaaatgcgagcatggggattattacgcagacagcgttatcgttgcaactggcggaaagtcctatccacggacaggctcaacaggcgacggctataggcttgcgaagtctgtggggcataaggtaacggcaataactccgtcactttgccctgtagttacttatgagcgtgaggaatgtgcttccgcaatggggctttcccttagaaactgcaccttgacgcttcgtgaagaggacagagataaaccaattttccacgagcttggggaaatgctttttacacactttggtctgagcggacctcttgtactttcggcttcggctcaccttggtgatatgaacaagtcaaggtattatatggatatcgaccttaaacctgcactgagccatgaacagcttgacagcaggatacttcgtgatttcggtgattttccaaacagggattttcagaattcactgggcaaactgctgccttcaaagataataccacttataataaaaaggtgcggcatcgaccctgagaaaaaggtcaatcagataacccgtgaggagcgtgaaaggcttgtttccacagtgaaaaagctaacgttcacggtgaagtgtatgcgccctgtagaggaagctatcatcacccgtggaggagttgatgtttcgcagatagacccacggtcaatggagtcaaagctgtgtaaaggactttactttatcggtgaggtgcttgacgttgacgcttatacagggggctttaatttgcagatagcgttttccacggcgtatagctgtgcggataaaataggataaggagattttgatatgggaataaacgtggctctcgacggaccttccggagcaggaaagtccactatcgcaaaggcggtagcgaaaaagcttgaatatgtatatgtagacacaggtgcgatgtaccgctctatagcttattatgttataagcaagggtgcagacctttctgaccctgagcagataaaaccctttcttggtgagatatacataaagctttgctacacagaagcagggcagagagtaatactcaatgacgaggacgtttcagacaaaataagaacgcctgagatatccatgggtgcgtcaaaggtgtctgctatacctgaggtaagagaatttctgcttgaacttcagaagaatatcgcaaaagaaaacaacatcatcatggacggcagagatatcggcactgtggttttgccaaacgctgacgtgaagatattcctcacagccgctccagaggcaagagcagaaagacgtttcaaggagcttcaggaaaagggcgacaagtctacatatgacgaggtattacaggatataatccagcgtgactataacgatacacacagagagatagcaccgctgaaaaaggctgatgacgctgttgaggtggactctactgagttgactcttgaagagtctgttgaggctatctacaatgtaataaccgacaagactaaaaaaaaagagcgtaagataaaagagataatgcctgtcagacctgtgaaaaaagaacacaggcttggtcatttccatatgttttggtacacagtgctgagatatatcgttatcggactttatcatctgtattttaacatcactttcgagggtacggaaaatatcccaaaggacggcggaaatatattcgcttcaaaccacagaagctatcaggaccctgtttttatcgcactgccaacaaaagtgccgctgtcttatatggctaaggaggagctttttcatcagaatgtgttcttcactctgcttataaaagcgttcggagcattccctgttacaagaggaaagggcgacactcaggtaatagatacatctatcgaaaagcttgaaaagggcagaaaccttgtcatcttccctgagggaacacgttcaaaggacggcaaggtaggaaagggcaaaacaggcgttgcattggtggcggctgtggctcaggtgcctgtggtccctgttggtatcaatttcgagggcaagctcaaattcagaaagcgtgtagttgtaagatttggcaagcctatagtgcctggcgagataggcgttacagctaccgaccctcattctcttaggactatcaagaacgagatcatgaaaaatatcacggagctggtacattaaatgttaacaaagtgtaaaatttgcgttgcaaagaccgcaggtttctgttttggtgtagacagagccgtaaaaatagtgtataatgaattagataaccgaaataatgttgtaacgttaggcccaatcattcacaatccaaacgtagtttctgaccttgaagcaaaaggagtttactccaccgatgtggataaggtcacgaaagaccagacagttgttatcagatcccacggagttggactggacgtgtatgaaaagcttgcaaaggtaggtgcggaagtaattgacgctacctgtccctttgtggcaaggatacacaagatagcagccgaaaaatcgggcgagggatacgttattcttatcgcaggtgatgaggctcacccggaaataatgggtataagaggtcattgcagcggagagagttatgtgttcagttcatgtgacgattttgaaaatttggtgaaagagaaagatttttcgtcaaaaaaggttgcaattctggctcagacaacgtataataagaatatgtggagaaagtgcgaagagctttttgagaggtatctgcctgaggctgtggtgtataacaccatatgcagtgccacttctgaaagacagaaggaggcggcggagcttgcgaaggctgccgacataatgataatagtcggagggctgcacagctccaatactcacaagcttaaagccatatgcgatgaatattgcaaatgttggcttgtggaggacgccgaaggactgagggcatgtgatattgacttatcaggtgcaaaatttatcgggatttctgctggtgcatcgacgccggcttatataatcaaggaggtacaacagaccatgagtgaaatgttgaacaatgttgacgaagaatttaattttgaggaggaactggaaaagactctgaaaaaaatacatacgggaatgaaggttgagggcgttgtcaccgatatcaataacggtgaagtagccgtagatatcggaacaaagcacacaggctatattcctgcatctgaacttacagatgatcctactaagaagccagaggatatcgtaaaggtaggcgacaagatcgatctgatcgttcttaagacaaatgaccaggagggtatcgttacactttctaagaagaaggttgacgcagttcttggtttccagaagatagttgaggctaaggaagctgacgctacacttacaggtacagttacaaacgttgttaagggcggtgtactcgtatcagctaacggtgttaaggtatttatccctgcttcacaggcagctccaagaagagatttcgatcttaacgatctgctcaagcagtcagtaagcttcaagatccttgaggtaaacgaggctaagcagagagcagttggttctatccgtgcagtagcaagagaggaaagagcagcagctcaggctaagttctttgagacagctcagatcggttctgaggtagagggtacagttaagtctatcacagattacggcgtattcgtagatctcggtggtgttgacggccttatcagaagaatggatctttcttggaacaggatcaagcacccttcagacgttgtttctgttggcgataagatcactgttactatcaaggatatcgacagcgaaacaaagaaggtttcattgacatataagaaggcttctgagaatccatgggagatcttcaaggctaactatgaggtaggtcaggtagttaaggctactgttgtttctatcacaagctttggtgcttttgcacaaatcattgacggtatcgacggtcttatccatatctctcagatcgctaaccagagagtaaacaatgttgcagatatcctttctgtaggtcaggtagttgattgccagatcacagagatagatctcgacaagaagaggatcagcctgtctatgagagctttgcttcctgctgatgacgaggcttctgaggacgctgaataagcaataaaattcatgggggcgagtgatcgccctcgttttttattttcaatgaaataacggcagcttcgttctgtcaaaaaatccttagaaaaaactaaagatttaccgaaaagacttaactttttgattcgtatgtggtataataatatcagatcaaataaagacgaaaggttaaatttatggatgaaataaaaaacacggcagtgaaaaaacgcaaaaagaaaagatccactaatcctgctgtcagagttctcaaaattataggcacagctttgctgtcgatattcctgatactcattatcacctgttcaatatttgcaacagttctgactatttacgtccttaactttgcagataccacaacaactatcagccttgacaagacggaaacaagcaacatttcgagatttttgtctgtcaaccctgactatgatgaagatgatgaggattcacaggagtatgacctttattatgctctgaaaaacagcaataagcacgttgtatgggctgatcttgaggatattcctcagtatgttcaggacgcttttgtgtacaccgaggacgagagattttattctcatgacggcgttgacttcaagagaacgttcgcttcatttgtcaatgtattcataccgatatacggcggcagacagataggtggttcgactatcactcagcagactatcaagaacatcacgggtgatgactccagagattctatccatggtatcgagcgtaagatacgagagatcttccgttctatcaacgtggaaaagacctacacaaaggaagatatcctccaaagttatcttaaccttgtgccactgacaactcaggagtatgatatcatcggagttcaggctgctgcaaacttctattttggcaaggacgtaaaggatcttaaccttgctgaggcagcttcacttgcgggtatgacaagctggcctgctgcaaacaacccatatgataatatgaaaaacaacaagctcagacagaagtacacgctggatcatatgctcgataacggtgcaatttctgagcaggaatataacgaagccctcaactatgagcttaaaataacaggcgatataacctatacaagctcatctatctatgaggacgaaacaaaggatcagggtccgacatcttatttcatggacgctgctatcaatcagacgatacagataatcgctgactattatggcatttcatgggaggacgcttccgcaagactttatgacggcggatttactgcatataccactgttgacagaagtatgcagaagaaggtcgagaaggaaatgcagaagcaaagtaatttcaccacctatgaaatgaacaaaaaggacgatactctgtggtcaggctttattgccatggactatcagggcaatgttaaggctatcgttggcggacgtgataagaaaaaggagtcgagagtttataatattgctactgatgccaaacgttcaccaggttcttgtatcaaacctatagcttcatacgctccagcgctggatcaggaccttatgacatggtcaaccctgtttactgatgagcctatcactattaaggtaaagggcaaggacaaaaagtggcctgtaaactattctgaaacaggcgacagtgcaaactggtcttatcagcagcttacaactgtagaaatgctcacaaggtcgctgaacactcttcctgcacagcttatcaaaaaaatgacacctgcttattcctataacttcctcaaggaaaagcttgacattactacgcttgcagactccgatgctgactattcaccagtaactgtcggcggtcttacaaatggtactaagcttgaggaacttgtaggcgcttatatgatattcggcaatggcggtaagaagtatgacgttacctacgtttcaaaggtagaggatgctgacggaaacgctatctatgaaaagagcgacggatacaagcaggctatcagcgagtctaccgcttacgttatgaacagaatgatgcagaatgttataactcagcaggacggtactggtagatatgctaagctaaacaatactgaccttgtcggtaagacaggtacttcatctgactggtttgacctctcatttgtaggctgtactcctgactacgtttcaggtatctggataggttatgaaaaccctgccactattcctacgaacgagtatcagaatatcggtgcgatttggaagaacgtttttggtgatatcgctgagaatgagaagcataagtcatttgaaaagactttcaaaatgcctgatacagttgaaaagctcacctactgcacaaagacaggtaagcttgcgtcaaattcatgctatagcacggcaactggatattacaagaaatccaacgagcctgagtattgtagcggaaatcattaaaattaaagcctccataactctatggaggcttttttgaaaggaaatcattatggaaaataaactgcgaatgtgcgttccatgccatttcgggcttgaaagcgtgcttgcatatgagataaaaaagataggcggtgaaaatcttaccacaactgacggcaagataagctttgaaggtggctttgacgtgcttgcaaagggaaatctttggattgccacaggagagcgtgtacttatcgagcttggcagctttagagcagaaagctttgaacagctttttgacggcgttatgaatcttccaatggagaactttatcggcagggaagacgctttccctgttaagggtcatgcccttaattcaaagcttcattctatccctgattgtcagaagataatcaaaaaagcctgcgttaaaagacttgaaaaagcctatggcataagctattttgaggaaactgcggcgaaacatcagatacagtttgctatccataaggacattgcgactatctatcttgatacatcaggtgtaggacttcacaagcgtggctacagaagaaattccaacgacgcacctatcaaggaaacacttgccgcaggtatagttgaccttgcaagagttcgtgcggactcagttgtggtggatcctatgtgcggttcaggtacatttcttattgagtcggcatacaaggcactgaaagttgcacctggtctgagaagaaattttgcggcagagcagtggtcacagatacctgaaacagcgtggcgcaatgcaagagccgaggctatggacgctattgacaggcagggtgcattcaaggcgtttggctttgatgttgatgatatggcggttgagcttacgagaaacaacgctaaaaaggcaggagtaggctcaaagcttacagtaaaacagcaggatatctcaaaatacagccagatagagggttcgataacaattgttaatcccccatatggcgagcgtatgcttgaaataaaggaagccgaggagctttataagaaaatgggacaaagactttgcccgtcaaaggagaacccatgctatataatctccccacatgaggagtttgaggtctttttcggcaaaaaggctgacaaaaagcgcaagctttacaacggcatgataaaatgtaatctgtatatgtatttcaagtgaggtgcgtggtgggtttgaaattatcagaacttgacgggatcgtattcgatatggacggcgtcattttcgacagcgaagtaataggtcttgaaagctgggagcgccttggaaagaaatatggtctgaccaacgttcacgaaaatgctatgaagtgcattggcagaagcactgttgatacaatggctatcctagaagccgcatatggtgacaaagtgtcaatacccgaactttatgatgaagcaaaagacatttgtgcagatattatcgctgagcgtggtttgcctctgaaaagcggagcaagggagttgctttcttatcttaaagagcgtgatataaaggtaggacttgcttcatcaacgtcttacaaaggggttatcaaaaatctaaagggagcaggtctgcttgattatttccatgtgattattggcggagatatgataaaacattcaaagccacaacctgagatatatttacttgcctgtgaaaagctgggagtaacgcctgagaaaactgttgctgtagaggactcttacaatggcataaaggcggcttacaatgcgaagatgataccaataatggtgccagatcttattgcaccgacagatgagatattgtcaatggtgtacaagaaaatggacagtttggacgctgtccttgaatattttaaagcataaacaaagcccctcggcttatcaccgaggggctttgttttaagtatgatgaaataaatgcagtggtatcattttaaaaatagcataagtcgatcggtcaggtgttctgatcagttcaagagaatgcttttttcgtacccgtcaaaccctctgcaccctactctaaaaaacagactctgcgagggatcaccattccagcaggagcgaatagacttttctttggcaaacccttacgaaaagaaacaccgccctactctaccaaagtaacggtgtttcttttcactaaatctttgggagaaaccgcttagccaataggcttatgcagtacccctttatatatcagtatagcataagccaaaagaaaagtcaatcttatgctatcaactgcaaaaaatctaaatatatcgacattttatgcagttaacatacataagtcaccataattacgataaaaaattacaataaaaaattataaatagtacaaaatcattgacaatttatgtgaaatatgatatccgtatattgttttccttgttgatattgtacttcgacaaatattgtcgaaacgagcagtggttctgattatccccaaaggatgccttcttgtctcatacctataaccaaaactgctgcattccaatctgttttgctcttcaaaaagcttgatgttttaaaattaaaatgttataataatataaaagcaccaataataatcaataatcccgtttgaattttataaaaggaaaaggtgtaaaagatatatgttaattgaattttcgttttcaaattaccgctcttttcgaggggaaaacacattatcgttagagagtttaattaagaaaaaagaatctctgccacttgtggctatatatggtaaaaacggtggaggcaaaagtaatttaataagagcattttggcttgccgttaaatttatatgcaatgcacaaatgacacaaggtgctggagcgcctgtgcccgttgatccttttaaattgaatgactattctacggaaactccgacaagtttcgaatttatatacaaacataatggaataaagtatatctatggcttttctgcgacgaaagagaagatatgcgaggaatatctttttcattatcccaagggttctaaggctcaagtttttaaaaggacgggacaagaattttctttcattcaaaataaggcgttcaagcaattgataagtaaagccgtagcggaaaaccaactttatttttcggtagcaaacacaatgaatgaaagcgtgtgcaccgaagcgatgaagttttttacagaaagtatagtgttttcacgagaatttgaggatataccaggacagatcagatttaattataacaataacaatgttctaaaatccatgaaacaatatgctcaacgtgcagatgttggtataattgatatgaagtttgatatgaaaaacacggagatagatgttgatgacaccataccggaaaacgctcctcctgagttgtcaagagctctgaaaagttttgttagtgcgttgtctgataattctcaggcaaaaatacaaagaaatgaaattaaggctcgaacctatcatactggtgtaaacaaaaaaggagagctaggtcaatatgagcttagtttagaagatgagtcagatggaactcataggcttatggcactggctccggcaattgacagggtgattgataatggtggcatatttgtcgcagatgaactggaaaaaggacttcatccgttactaacggagtatatagtcaataaatttcaaaattctgaaatcaataaaaatcacgctcagcttatattcactacccatgataccgaaataatgagacaacattttcttgatgctgaccaattttacttcgtagataaagaccgacaaacaggggagtctgaactatacagtgttgatgggctcggtaaaaaaagcaacgctgatataagaactggctatctaattggtaaatttggcggtattccagaattgggagatgaataagagtctgaatacccaaccgtgtaaatgacaataatacccacaaagaaatttggaggtagattgtaatgaaaacaagagatcacggtttaagcgagaaggaaatggagcttgtgaagctcatcatggcggagtgcgaaagcacaggcgatattcaggctaaactcaagcgtttgtttgcaggaactatcgagcagatgcttgaagctgagatggacgagcatctgggttatgagaagcattctgccgcaggcaacaactccggaaacagtagaaatggttacggcaaaaagaccatttccagcgattacggcgagtgtgaaatagccgttccccgtgacagaaacggtgaatttgaacctaagatcatcgaaaaaagacagactcacacggacgaaattgagcagaagatcatggcgatgtacgctaagggaatgtctcagcgtgacatcgaagataccctcaaagagatttatggtgctgaaatatctcaaggacttgtttcacgaataaccgacaagatccttcccgaagtaaacgagtggcagaacagacctcttgacagtatttatcctgtcgttttctttgatggaatcgtttttaattcgcgcaaggacaataaaatcatcaataagtgcgtgtactctgtactcggtatcaacatggagggtcagaaggagattcttggaacatggatttctgaaaatgagtcagcaagcttttacgcaagtatatgctcagatcttaaaaaccgcggagtcacggacattttcatcgcttgtcacgataatctgacaggactttgtgatgcgatcaacgctattttcccgaagacaaagaatcagctctgcatcgttcatcagataagaaacagctgtaaattcgtgccttacaaggacagaaaagctgtgtgtgctgatttaaagaaaatctacggtgcagtcaatcttgacgacgctgaatttgccaaggaagagtttcgtgaaaagtgggacaagaaatatcccaacatcataaaatcatgggacaaaaactgggctgaactgacaacattctttgaatatccgcaggagatcaggaagataatatatacgacgaacgctgtcgaaagctaccatagaatggtaagaaaatttacaaaatcaaaggcggtttttccgaccgatgattccatacgcaaggtcatctatatgagcgtcaaagagatagccaagaagtggaccatgcctatcagagactggggtctggcgtattctcagtttgcgatatactttgaggacagatttgcagcctaacggctgtcggggactctgtccccaaacccctgaggtttatccgctttggaaatatccggtggaatattgaaaaccgacgacatttctgccgccgctttccaccgttttatctcacagcctgcgtcaggtcgttcctcagcgttgccctgtttggctgcaattttagtattgtcagaaatttggcgattattgcgtttacacggtttatttttcggaaccatgaataagattagtaaatgaaaagattctgaaaaaatgagttttcaagctcatatctttttatgtaaatctgtttttgatatatttatgtattatagtaaaacttgacaagttacaatcaaaagcccataaaaaaagtccctcggctaaccaccgagggactttcatttatgtcagaaagattactttgtcattgctgcaacttcgtcagcgaagttctcttccttcttctctacgccttcgcctctctcgaaacgaacgtactcaacaacgtcgatcttgccgccaagcttcttagctacagactcaacgtacttgccaacagataccttatcatccttaacgaatgcctgctcaaggaggcagttctcagaatagtatttgccgatcttaccgtcgatgatcttgtgcttaacctgctcaggtttgttagccatcttaggatcctcagccatctgagccagcatgatctctctctccttgtcaagagcgtcagcaggaacagactctctgttcaggtatgcaggattcatagctgcaacctgaagtgcacaatccttaccagcagccagaagttctgcattgtcagctgcgatatcagaatcaagctttaccataacgccaatgctgcctgcaccgtgaacgtaaggaacaagaatgccttccattctcttgaatcttctgattaccatgttctctctgatcttgatgaacagatcctgaagtgtctcttcaactgtcttgtcaccaccgctgatctttgttgccttaagtgcgtcaacgtcagcagggtttgtctcgattactgtatcagcaactgctgcaacgaaagccttgaactcatcgttgttagcagcaaagtctgtttcgatgtttacttcaagaacgcagcctacgttgcccttaactacagctgtgcagataccctctgctgcaactctgccgctcttcttagcctgtgtagcaagtcccttttcacggagaagtgttactgccttttccatatcgccgtcagcttctacaagagccttcttgcagtccatcatgccaacgcctgttgctgtcataagttctttgatctctgctacggataccttacccattattattcctcctagtgttttatatcgaaataggcagacaaatatactataaatgcctgcctgaaatttcagctcttattcagcagcctcgtcagcttcttccaccttatctgcctcttcagcggactcagcgtcctcaccctgtctgccttcgattatagcgttagccatgcaaccagcgataagcttaactgctctgatagcgtcatcgttacctgggataacataatcaacatcgtcaggatcgcagtttgtgtcaacgatagctactacaggtatgccaagcttcttagcctctgctacagcgatcttttcctttcttgggtcaacaacgaaaagtgcgcctggaagcttcttcatgttcttgataccgcccatgaacttttcaagcttttctatctcaagcttcagcttaacaacttccttcttagggagaaggtcgaatgtgccgtcctcttccattgtgtggagctgctcaagtctcttgattctctgctggatcgtcttgtagtttgtcatcataccgccgagccatcttgcatttacataatgtgcattagctctcagtgcctcttccttgatagaatctccagcctgcttctttgtacctacgaaaagtacctcttcgccattagctgagatgtcacggataaacatataagcttcttcaagcttcttaacggtcttctgaagatcgatgatgtaaattccgtttctttctgtgaaaatgtatggagccattttagggttccatcttcttgtctggtgaccaaagtgtacaccagcttcaagaagctgcttcattgatactactcccattgtagtaacctcctgtttggttttagatttctgcttctgcagatgtttttatcctccggacggctttacttgctttcacctgtcttacggcaggaccaacggcaaaaacctgtccgtgcgaattgctttaatattatatcatattttctatttcatttcaagagctttcgacaatttattttaacaaattttcgatttttacagttctgctctttgtgcatactgcactatcattgaattttacaagtatggtatcttcgccgataagctcgatatccgagcattttatgataatatcctcatctctgcccatgataccgaaagcccttggtttgccatagacgatcagtgaaactatattcgctccctgagtatccatttctatatcatcaacatagcctattttcagtcctgttcgcatattgacgacctctttatttcgtaagcttgaaaaactacatatcatgaaaccttcccctttcaaaaaagtgcataccctttataataggtatgcactttggggatcgtcctatgtatgatcgtttttgtttttgtaatacatctccaactgatcgttatacaaatgctttatatataaagctatggtgtttatgtacattgcatttgtaggctttgttccgttagcaaggcaactttcaaaaagcatttgcctatccacaggcttcattttttcccagcctgaaactatagcacttcttgttgagcgttcaatagccgcagtgctttttccgtattgtttttcaatgtccttataaagttcgcctatttgtactttattaccgctatatttgaatataagaaggaatatcatgtagtagatatagtcatatcctgaatgcttacggtttatgcccgttgatgttatgatcctatgtatctcctttgaaatattctgtctaaggatatcaggatcgacaggtatcctttttagcttgtcaagcatatagtggcatacgttcttagcgtcgtatggcataagtatatgcagaatatcatcataatcgagaagaatacggatcgtttctgtgtcatcataagtgtagatgttatatattatgggataaatgtcattttcgtgaagtatctcacgaaaatgcagaagctttttatatcccagcttacagcagtcaataacgataacgtcaggagtatattttacagcacctatctcaagctctatttcagtatcaccgcatatatggacctttgtacccttgcgtttcagttcctcggtcaacagtttatgctggccgtcatacgactcggaaataaggaccgaataatcagtcagcatacacttcaactcccttatgacgatttaacataataactcctatattattatatcaaattttttgactacaagcaactttaatggcacattattaatcaaattgtttcaaaaacgtgaccttattgtaattgcatataacaaaaatattcacaaatgtcgacttaacgtattgcgacagacgttagatacttttcttgatgtgttccaatgcacctttttcaagccgtgatacctgtgcctgagagatgccaatattttttgctacctccacctgagtttgtcctttgaaaaagcgcaggaagagtatattacgttcacgaggctgaagctcgctcatggcttgcttcaatgaaagctcttcaagccagcttttatcgtcacaggagtcgctcacctgatccaatacataaagagcatcgccgttgtcagaatacacaggctcatagagtgagaccgggtcggttatggcttcaagggcaatgaccacctgactaggcttttcggtgatagtgtctgctatctgctcaacagtaggctctttctggttttcacatatgagctgttctttcgcctgcattgctttataagcaaggtcacggagagaacggctcaccctcatgggttgaaaatcacgaagaaatcttctcagctcacctgctatcataggcacagcgtaggtagaaaacttcacatcaagagaggtatcgaaattatctatcgccttgataagccccacaacacctacctgaaaaaggtcgtcaggggagtcgcttcggctcacaaacttctgcaaaacgctcagcacgagcctgagattgccatttataagctcctcacgggcttttttgtcgcctgaatgggcttttttcaaaagctccagcttttccgactctttcagcgttttaagctcattggtattcactccgcttatctcaactttattgtactgcatcgcacgctcctgttaaaaagcagcattttatgctgccgtgataatataattattacctttcgatcaggaactatacagatatttttcaggaaaatctgaccataaaaaatgcagagccgtgtgactctgcattagttctattcttttctgtcgctcttgcgctgatagtagaccgcttgtatcgctgttattatggctgaaatgcaaaaggccagcagaagcttgttggatatttttctgtttatgaaattcattgtagggttgagtatatccaatatccagaatacaatgaacattcccgcaagtattatcgtgatatgtgggagaattttgcttagtcttttcatttttatcctcctatatagataatgtcgctgaggtcacgtccaccgccgtcaggagcgttcacaatgctgttgttgaagtacatcatagcggactttccaccgtcaagattgaacgcagacatacagccctcatcgctcatgatagccgcaagctcgctgagagttgcgccctttgagtagccttcgtttctgccgtcaactgtcacgaaaatatagtggcctgccgacacacagccgatagctgaacgtggatttgcactgttgagatattttgttgtgttgaacgtttcaagaacgttgccacttccgtcaagaagtgcagggccaaagttccaagcctgccatgcaccttttgctataacagcgtcgctgtcatattcagacggagagtaggtctgcattgtgccgtctgtgaacagcacgcacacgtctgcatcgttgacatcatcacggtattttataccgtttcttataacgatactgcgttctgaattaccatagaaatcaccgtttatggcgaaaagagctttgttttccaccgccatactgaatactgagtccttgatgttcttaccgaattctccgtctgcaaaggcggcttttacctcgcttgcgcttgtgacataaacatcagccacaaaataggttatcttgttgctgccctcgccgatagattttttgtatactgtcacctgagcattgtcagttgaagccgagccaagctcctcagagtttatggcaccgtttgttatactgcttatagcgttctggtctgaacgatagtcggcagtgtcctgattgccccagtttctgtggttcgtctgctcagtacgcagtgtggttgtagtcttttctgcctgcggagctgttgtggtaactgcaggctcgctatcgtcttgtgctgtgccttctttctgcgagttgtctgccgcatttggcagggtgaagctaccctctgcggagctgtcaactgttgcgatcacttctccctttactcctgaactttgcggcataacgtagtcaaaaagcatgaacacgcctatcgctgccgctgtaagcacaacgtccgttatgatcattgcccagacaggcattggcttttttgtcttattcgtcaatttttctttccctctttctgaaaacgaaacttttttgcgccgcccagcttataaagaaaagcagcacttctataagtattttgctgatatatttgttgtgtatgagatatttcacacatagctctagcattattgtgtttgcagctagtattaatgcggcaagcagaaagtattttgcggctgtctttgcaatgccttccttatttttaaagacgaactttttgttcatggaaaagttgaaaatagagcttatcactcttgcacatatgttagaaaacgctacgttcccgcttatcattgcgaaaatgctgtagaaaatatagtccacgcagaagctaagaagtgatgagcatgagaatttcagtatatccttgtatattctccatgagtctttgataggattaaaatgtgatgactcgtttttgccaaggtaaactgtttcgataggcacttcatagaatcttatgccttctcttgcacattcaagtagcatattcatctcaaactcatatctgtcaccgtttaccgacagcataaaaggtatgagctttgaggaaaagccacgcaaacccgtctgcgtgtcgcttacctttactcctgcggcaaatgagaaaacaaattttgtgatgttgttgccgaatttgcttcgcaatggtatctttcccgaaaatctgcgacaacccataataagcttgtcaggggagcttttcagagcttccgacacccttattatatcctccaccttgtgctgtccgtctgcgtctgcaatgacgatgcccacagtgtcggcttcatgttcttttatgtactcaagcgcggtttttatgccacgccccttgcctttgtttacctcatgggtgagaactatggctttttttgcggcttcggcaaaaatcggcagcttatccttgccgctgccgtcattaatgacaattatatgaaaatcggtcaatgaagatatatcgtcaataacagccagcattttttcatcaggctcataagcgggtatcaccgtataaaatctatctatcgccaagatatcttctcctttcatttatcgtatggtctaagtatatcacatatgctttaaaaatacaataaaacttctgaagaatttatacatagtttatctgtcgaaattttgcgaaaatgaaattgtgtcagtattattgacaaaataataaaaatgtcgtataatagaagaaacaataaaaaatgtacaaattaattcagcaaacggaggatttgatttcatggaatatagagttcttgaaacacgttcagccgatattctcactaagtactacaataacgagatagacagctttcttaatgcctgtcatgaagacattctgtggataggtcctgctgagaagcatgtgatacgcaccagaaaggcgcttgttgatgctttttcgcaagaagaacacaagcttgaatttgtgctcagcgacctaaaggtgttttccataggtcttactgaaaggtcctgcgaggtcataatgtttttcattttggatacgatttggcctgacagcagtgttgggagagcagatcaaaggatgcagtttacatgggtgagtgagaacggcgtagaaaaaataaagctttgtcacatttccaatgccattaaatatgatgaacgtgacaggatatatcctgtacattatgaagaaatatacaagaaaaatgtctgttcaggtgaaaggcgtacaaagagagtgatagtaaatggcgtagacaggtcgcttgtttttctggataggtcatggatagcttatgtggaaagcagtggcagtcactgcgtcatatataccattgacggctcatttgaatcagtgcagagccttaaggtgtttgaaagacgatatagggatatgtttgtgcgctgtcatgaaaattatcttgtaaatcctgaatatgtaagccgtataagccgttacagaatagagcttacatatggcaaagtgatccctatttcagagaagaattacactgctgtgaaaacaaaattatcccatataacataaaaactggtgaacattttgcgtgttcgccagttttttaatcagcatattttttctaaatttcgccgtatggattttattatccgcttttcaagtcttgatatgtaggattgggatatgccgacttcatcagcgacctgcttctgggtcatttcttttttgcctgaaagcccaaatcgcattttcattatctgcttttcacgagggcagagcttttcgatttcctccagaagaagctgtttctcaacttcgctttctatgcccttgttcacggtgtcgtcatcggtgcctagaatatcggataaaagcagctcgttgccgtcccagtcaacattcagcggttcgtctattgatatttcatttttatactgatttgattttctaagaaacataagtatctcgttttctatgcatcgtgaagcataggttgcgagcttgatgtttttatcaggacagaaggtgttcaccgccttgatcagccctatagagcctattgagataagatcctctatgcctgtgcctgttgactcaaacttctttgctatatataccacaagcctgagattatgcacgataagcagttctcgggcttttttcgggtctgtttcaagaagctcaaaggcttttttctcttcctctttgtttaggggcggcggtaacgaatctgcaccatttaggtaatctatagtttcggggtcgtctgaaaacaaacggctcaaaaatctgttcagccctagagcgagtgttttaagtgtggtcatttgtattcctcctgtattatcccagcaatgcggggttgaatatagcccgtgactttccgttcagcgagggctttatgcccacatagcacctgacgttgtgtacacggtctttatcgtcgattatctttacgctccctgcggcggttatgtggataattccctcaccgctgacagtagagcaggggataagcctgaaaccgcttagagggtcaggctcgtcacggtcaaggtcgtagtgatagaaaagcctgtcacagcagaaaaccaccactggcgttcctgtgaagctgtcgcaaagcctgttcccactgtcgcatatggcagggactttcactatacagccaccattttcgtatatggcttcgtatttcgcgaccttgttgaaacacctgcgtgtgatgttctcataaagacagagcagaccatatgttataccgcaggcaagggcaagcttaaatagagagatgtcaaaatacacagtgaggtttctgaaaaaaatcaccttgctccctgatatctgccaaagggtcaccactatacccgtgaaaactgcgttcacggcactgtatattataaagtatcgaagtagttgccaagggtctttacacccaaaggctataagcactgagaataccgcactgacaagctttatcaccacaataagaactgcagtgaaatatcctctgctgtctatagtcataacaagcgacgaaagtcctcccaccgagcaagctgtcaacagccgcagcggacttatgaccttgtgacatatcctgcctgccgcttccagcatgataagcgtcataatggcgtttgtcacaaggagtatatctatgtaaattttcatggcgttcctccctttgatattatgatagcactgcttggatggaaaaattgtcgcaatggggacaaaaaaagatccgccttccccaaatgggaaagcggatatgcttatttgatatcaaattagtcagcaaagaaaactgagaaagccttatatgccatataagtgtctatcttcgaggttatctcaaatggtgcgtgcattgaaagcactggtacgccaacgtcgataacgttcatgtcaaggtttgcgatatactgtgcgacagttcctccaccgccgccgtctaccttgccaagctcgcctgtctgccaaacgatgttgtgttcgtcaaagagctttctcactctgcccacaaactcagcagaagcatcggaagtgcctgacttgcctcttgcgcctgtgaactttgtggcaacaacgccgtagtttatctgtgatgagtttcttatctcgaacggctctgagaatgttgggtcatatgctgcatttacgtctgctgaaaggcactcggaagcagagataacgtttctgccctcaagtccgtatacctttgcaaggtcagcaatgaagtatggcagatatgagctgttaagtcctgtgttgccgtcacttcctgtttcttccttgtctgtgagtatggtcatgcaggtctttttagggtctttgcatttgaggatagcctgcaaagctgtgtatgcgcaaactctgtcgtcctgaccataagagcctaccatgcttctgtcaaagccaacgtcctgtgccttgaatgctggaacagcttcaagctctgcggaaacgaaatcgtcctctacaatgccgtatttctcgttaaggatagccattatgttgagttttaccttgtttgaaacagcgtcatctctgaatggtctggagcctatgagcagatttagctcctcgcccttgatgagctgtggagcaggtcttttcatctgagcgtctgcaaggtgtggcaggatatcagttacgcagaaaacagggtcgtccttgtcctcaccgatatttactgtaacgctttcaccgtcagcctttataacaacgccatgaagtgacattggaacagttgtccactgatatttttttataccgccgtaatagtgtgtcttgaacaggcaaagctccttgtcctcgtaaagtgggttctgcttaaggtcaagacgtggtgagtcgatatgagcggcagcaagtctgatacctttttcaagaccgtccttgcccataactgtaagtatgatagcctttcctctgtttacaaaatagaacttgtcgccggcgtcatacttcttgcccttttcataaggcttgaagcctgctttttcagcctgagccactgcctcgataacagcctcacgctctgtctttgcagtgttcagaaagcttttatagccctcgcagaacttgtctgcctttttgagcttttcttcgctaaggcgaagtccaccgtttttcttatccgaaagaagcttttctgcaagcttttcgccctcggacttttctttcttcttgttatccattgtaaagtcctccttttaatgtattcttattgaaactgcgttacaatgggcggacactgttcgcccctgcgcatggttttgcttaactgttttctgtaatatccccatgactgctgagtatatccttataattgtcataggctttgcgtatcttgcgcacatagtttgaagtctggtcattttcgtcaggtatgtcgctgactttgaaattgtcagggtcaacagtgccgttttctatccaactgtcaacaagattcattccgcagtgatatgccgccgctgtcagctctacagagccgtcatacttttccataagatagctgagataatatgtgccatattggatattaagttcagggtcgaacatatcatcataggtgttgtcacgctgatcgtcaaggcgatattttatccaatcgtatgcgtcctccataagctgcataagacctctagcacccactgatgaaacagcgtccttattaaagccgctttccacttttattacagagaacacaagcacagggtcgcacttgtacttggtgctgtatcttattacatactcctcataatctgtaggatatgaaaaagagttcggaatatcctttgccttgttgattatctgctcgtgataaaggtatgtgagccagcctataccgcacagcagaagtatgactgctatgagtacgggacctttttttatgtgccttttctttttacgcctgctgttttttccgttagccgccattatatctttcctttattgtttctatgacctcacaggtcttttggaatgtgtcattcacagagccgttgttctcaatgacgaaatcgctgtgagccttgaaaaattccatagtatgctgagaagaaaaacgcttttttgcaagctccgccgaaatgccgtcccttttggttatcctttcaagccttatgccaaagtctgccacaacgcttacgataacactgcaaagcttatccgcacctgcttcaaaaagggtcggtgcgtcaagaagaacaaactcgctctctgtagcgtttatctttttgtcaataagcttgtttataaaagggtatatggtatcattgagcatttgaagcttattcttatctgaaaaaactatctccccgagcttctgtctgtcaagagaatagttctcgtcaaagcagcttggaaaaagctttgcaagctctttacagcattcgttccctgcctgtgtgacttctcttgcgactatatcgcaatttattatctcaaagccattttctctgaaagcgtccgatatagttgtcttgcctgcaccgctttgacctgtaagccccactactgtttttttcacagtttcaccacctgaaagcccgcggctcttaaaagtcggttatacactgcaagccccacgccgtctttgttaggacagcgtgcaaaaactttctttgcacctatatcgtcaagctctctgagaacgtcaaaaagctcttttgcctgctcttcgtcatttgcgccatagcagatgtggggtatatcaagcccctcgcaatcgctgtcagtgaacaccataagagtagtgtcattgtcagcgtgagttttcacatattctctgaaagcttcaagactgctgtcaatgatagtcacatcagcctttggggcatagtgcttgtatttcataccaggggagcggacttttacgttctcacccagcttttccaaaacgcccttgtcgataagaacgttcggggtgatctccataaggtcttctgcggaaataaatcccggtctgagaagtcttatgccgtcatcgccctcaaagcttataacagttgattcaacgccaactccgcaagctccaccgtctattatggcaggtatcctgccgtgcatatcgttaaggacgtgctgtgctgttgtaggtgacgggcttcctgaaaggtttgccgatggtgcggcgatagggaagccgcaggctgagataagcgctcttgccaccttatgtgacggcattcttatgcccactgtgtcaagtcctccgctcgttaccattggtatcttttcagactttggcattaacattgtgagaggtcctgcccaaaatttttctgcgcactttacagcaaggggcggtatcttatccacaagtccctcaagctgagaaatgtcagatatatgcactattagaggattgtcggcaggtctgccctttgcggcgaatatttttcttacagccccttcatcaaaagcgttcgccgcaagaccatatacagtttccgtcggcataccaacgacttcaccctgtgagagcagctttgcggcatatgctatgctgtcctcgtcagtgccaagtatttttgtgtcaaacattttttattcttcttcctgacttgcaagcttggcagcctgatcggctgttgcaagtgcgtcgattatttcatcaagtgcgccgttaagcacctgttcaagtctgtagatagtaagaccgattctgtggtcggaaattcttccttcaggatagttgtaagttcttattctttcggaacggtcgcctgttcccacctgtgaacgtctgttgtctgcgatctccttgttctgtgcctgaactttctgatcaagaagtcttgaacggagaactttcagagccttttccttgttcttgaactgtgaacgctcgtcctgacactcaactaccatgcctgtaggcaggtgagttattctgatagcggaagatgtcttgttgatgtgctgtccgcctgcgcctgatgaacggaagacgtctattttcagatctttttcttcgttaaggtcaagctccacttcgtcagcttcaggaagcactgcaactgtaacagtagacgtgtgaactctgccctgtgactcagtttcaggcacacgctgaactctgtgtacgccgctttcgtatttcagtcttgaatatgctccctcgcctgacacgctgaaagttatttccttatagccaccaagctctgtttcgttggcgttcatgacttctatggtccagccctttgaagcggcatacattgaatacattctataaagagagcctgcaaacagcgcagcttcctcaccgcctgctccgcctcttatctctatgataacgttacgctcatcgttagggtctttcggcagcaggagaagcttaagctcttcttcaagcttagccatatcttccttggactcctcaagctgcatctgcaccatttccttgaagtccttatccattccgcctgcgtcaagtagttcaagagcttcgtcattggcagcctttgcctttttgtattcgccgaacttttcaacaatcggcgtaagtgtcttgtattctttcataaggctcgtatacagtgaagtgttgtttacagtttcaggctgcatgagcttttcgtttatttcattgaatttatcttcgagtgctttgagtttttcaaacatagttatattctcctgtcatttttattttatatcatacatttgttatatatcataaattgcgagaatagctatgactcagcctctctgataatagtttttacgttcttttcggctttgctgcgtactatcatgaactctcgtccgcagccctcgcagcgcagcttgaaatccatgcctgagcgcagaactatcattctgttactgccgcaggggtgacttttcttcattacaagaatatcgccttttacaatatccattttgcaccactttcctttcttaaaaggtgaagcagagcgaatactctgcccatacatcgttattataacacatttctccctttattgcaatagcggagagggcggttttattgctgtacaaatattatagtccatatatttgatttttgttgcattgttacaaaaatgacattataagaagctgaatttacaaaatgttcattgaatagcttttgaaaaagtgttaatattagattgttcaaatttgaaatatctaatattggaggtttgacaatgaacgataatatgacaacagcaacgcatatgtttgatcattcaaagaagcttgcagaagcatatgaaaaagtcatgcagcccctttgtaaaaagctcgatatgccaaagacggcgcttgacgtgctcatgttccttgcgaacaatcctgagttcaacacagcgggtgatgtgtgtagatataggaatatcaaggcggcgcttgtgtctttccatgtagaaaagcttgtggaagcaggctttgttgaaaggcaggcggtaaagggcgacagaagaaaatgccgtctggtctgcacagaaaaggctcagcctgttataaaagagggcagagagctgcagaaaaagtttgcacaaaagcttatcgctggcttttctgacgatgacatggcacatttcagaaaatgcctgcatatcgttagcgacaatatagacagcattcttaaagaatgtatgtagaaggaggtaacaactatgataaaactgcttaaaaagatgggcaagcgtgaggtgcttatggctgttctctgtgcacttctggtgctgggacaggtgtattttgacctgacgctgcctgactatatgactgacctgaccatgatgctcaacacggcaggcagtgaaacttccgatatcctgaacgtcggacttaaaatgcttggctgtacccttgcaagtgccgctcttgctatcgtctgcggctatctttccgcaaagactgcctcaggattcagctacacaataagagaaaagctgttcaaccatgttatggatatgggcagcgaggagatgcaggacttttccataccgagccttataacaaggacaacaaacgacatcacacagatacagatgatagtgtcaatgggacttcagatgataataaaatcgcctatcatggcggtttgggctgttataaagatactgggcaagagctgggagctatcagcggtgactgcggcgttcgttgtggtgatatgcgtattcgttcttgcagttatggcgacctgcataccgagattccgtatcgttcagaagctaactgataaaataaaccgtgtggcaagagaaaatctcacaggcataaacgttgtccatgctttcaatgctgagaaatatcagaacgacaagttcgatgttccaagcaaggatatgatgaacacacagcttaaaaaccagagaatgttcgcacttatgatgccagttatgaatatcggaatgaatggtctgacccttgctatctactggcttggtgcagtgcttatccagcagatagccctgacggccgttcaggacaggataacgtttttcagcaacgttgttgttttcagcacatatgccacatacgttgtaatgtcatttatgatgctcgttatgatattcatgatgctccctgcggctcaggtatctgcagagcgtatcaacgaagtgcttgagcgtgacgtgaacataaaagagggaagcgtcagcgagggaagagagcagggtactgtggaatttaaaaacgtttctttcagatatcctcatgcctctgaggacgagctgagcaacataagtttcaagatagaaaagggtcagacccttgccataatcggcgcaacaggaagcggcaagacaacgcttataagccttataccaagattttatgacgcaacagagggcgaagtcctcgtggacggcgtaaacgtaaaaaactacaagtttgacaccctttatgacaagcttggatatgtcacacagaaggctgtgctttttgcaggaagcataagagaaaatgttttctttggagagagtgccgctcctgaaactgacgaggagcttaaaaacgctatcgagctttctcaggcggaggagtttgtgaataagcttcctgacggcacagagcatatgatatctcaaatgggcaggaacgtttcaggcggacagaagcagcgtttgtctattgcaagagcgctttcaagaaagcctgagatacttgtatttgatgattctttctcagcccttgattacaagacagacgcaaagctcagagagggtcttaacgagaaacttaaagacacgacaaagataatcgtcgcacagagaataagcactatccgtcacgcagacaagataatagtccttgaccgtggcgaagccgtgggcatgggtactcatgaggagcttatgaaaaactgcgacgtatacaaagagatagcactttcacagctaagtgcggcagagcttgcatagaaagggggactgcataatgagaaaatacgaaaaggctagtaagggcgaaatggcgtccgttatgaaaaaaataatagagtatatgaaaggcagtgtaggtatcgttgccgtggcattggttcttgcggcgcttggtgcggtgctgactatcatagggcctgacaaggtgggcgagataaccgaccttatagcagacggacttatgacaggcattgaccttaaagcggtggcaagggtaggaatattccttggagcgatatatatttcaagctcgctttttacctttattcagcagtatataatggcaactgtcacgctgaaaatgtcatacagaatgagaagcgacctttcaagaaagataaactgcgttccgcagaaatatttcaattcacattcacagggtgatatcctcagccgtatcacaaatgatgtatcaactttacaacagggtcttacaaacagtcttccgaccataatcagtgcggcggcacagtttgtgggctgtcttataatgatgttcgttacagaatggcgacttgcgctcatctcactgttcatcacattcttgggacttttcttgatagttttcataatgtcaaaatcacagaagttcttcctcgacagacaggaaagccttggtaagcttaacggctatgttgaggagatgtattcgggtcacgaggtagtaaggatatcccgtggagcagataatgtaaagaaacatttcgccggacttaacgaagctgtatacaacgcaaactggaagtcacagtttctgtcaggtatcatgcagccgcttatgaacgttatcggcaatcttgcatacgttgcagtatgcgttttcggctcaatgctcgcccttaacggcactatcacattcggcgtaataatatcgttcattctttatgtaagacttttcacatcacctcttggtcagatagctcagggcatgacgaatatgcagacagcttccgcctcggctcagagaatatttgactttatcgaaagcgaagaactttcagacgagagcgacaagagcagtgaaatgcctgaggtaaagggcaatgtaagctttgaaaatgttcgtttcagctatcctgatactcctgacaaggtgataataaagaacttctccgcagaggtaaaggcaggacagaaggtggctatcgttggaccgaccggtgcaggtaagaccacaatggtaaatctgcttatgagatttttcgagataaacagcggaagtatctccatagacggcacgcctatctcacagctgagccgtgaaactgtccacaatatgttcagcatggttttgcaggacacatggctttttgagggcactgtgagagaaaaccttgtttacaacatggagggcataagcgacgagtcacttgaaagagtgtgcaaagcctgcggtctggataagttcgttcatacgctccctgagggctttgatacagtgctttctgaaagcgtagcaatatccgcaggacagaaacagcttctcactatcgcaagagcaatgctccagaatgcgcctatgctcatacttgatgaagcaacatcttctgtcgatacgagaacggagcttcttatccaaagggcaatggataagcttacaaagggcagaacgagctttgttatcgcacacagactttcgactatcaaaaacgcagacctgatacttgttatgcgtgacggcgacgttatcgaaagcggaaaccatgaaactcttatggcaaagggtggattttatgccgagctttataacagccagtttgatcaggcttcataaagcaggcttttatatgcaaagcacacggcttttacggctgtgtgctttgtgctttttttactaaaatgggtgtgacagtggtgtggctgtattgaaaaatgacaataaagcgtattttatttcttaaaatcagatatttcacttgactaatccgtattaaaatggtatgataaatatgtatttttataaaatatattatttgcagaaggattgatatataatgaaaacaccatttataaccaaggaaaaggctgaggagataatcaagcagtatcctacaccttttcatatctacgacgaaaagggtatcagacagagagccagagatctttacaaggcatttagctggaacaaaggcttcaaagagtatttcgctgtaaaggctactcctaacccattcattttgaaaatactcaaggaagagggctgcggcgttgactgttcttctcttactgagcttatgatgagcgactgctgcggattcagcggaagcgacattatgttttcttcaaacgtaactccaaaggcggatttcctcaaggcaagagagcttggcgcttatatcaaccttgacgatttcactcatatagattatcttgacgacctttgcggtattcctgaaactatctgctgccgtttcaatccgggcggacatttcgagatagaaactcagataatggacaaccctggcgaggctaagtacggcttcacaagagagcagctttttgagggcttcaagatacttcagcagaaaggcgcaaagcatttcggacttcacgctttccttgcttcaaacactgtttcaaacgcttattatccaaagcttgcaagaatactttttgagcttgctgttgagcttcatgaaaagacgggtgcagacatcaagttcgtaaacctttcaggcggtgttggcatagcatatgagcctgacaagccacagaacgatatcttcgctatcggcgagggcgttcgcaaggcatttgaggatataatggttcctgctggtcttggtgacgttgctatcttcacagagcttggcagatatatgctcgctccgttcggtcatctcgttgctacctgcacacatcataagcatacttataaggagtatgttggacttgatgcttgtgcctgcaaccttatgcgtcctgctatgtacggttcatatcatcacattacagttcttggcaaggagaacgctccgtgcgaccacaagtatgacgtgactggcggtctttgcgagaacaacgataagtttgcgatcgacagaatgttgcctgagatagacactggcgatataatcgttatccacgatacaggcgcacacggtttctcaatgggttataactacaacggaaagctccgttcagcagagatacttctccacgaggacggctcattcgatatgataagacgtgccgaaactcctgctgactatttcgcaacatttgatttcactgatattttcgataaatatacaaagaataataagtaatgacgcttagatccacagggaatttctctgtgggtcttgctgttttcagggcgtttggtgagcaaatattaaaaaaatcggaatttatgtgatttttgcttgcaaaatagtatgagatgtagtataatattaaattgaattggtgtatttttgcacctaaggcgttgccttaatattaagaaaggtcagggattatatatggatttgaacatggtcaagtatctggcagagcttagcaagctggaatattccgataaagagcttgcagccacagccgagcagatgactgatattattgatcttatggataccgtaaaggaaatcgacattacctatgacgatctcaaggacaatcatgatgtttacctcaacgatctgagaaaagacgaggtcatcgaatctatgcctacttcaaaggtcctttcaaatgcagtgaatacaaacaactgctttgtagtgcctaaggtcgtagagtaaatttaacaggaaggtagtgtgaaatttggacgtttcttcaatgaaaatccgtgatatgcgtaaggctcttgacagtaaggaaatttccgctaaagagcttgcacagacatattttgagagaataaagaaatatgacgataaggtaaagagctttatcactgttacagaggaaaaggctctggaacaggctgaaaaggctcagactgttatcgataagggcgaagcaaaggctctcacaggaatacctgtggcagtaaaggacaatatttgtacagagggcgtaaagaccacctgtgcgtcaaaaatgcttgaaaactttgttccgccttataatgcgaccgttatggaaaagctcgacgctgagaatatcgtaatgctcggcaagacttctatggacgagttcgcaatgggaggttctacacagacctccgcttttgcaaagacaaagaatccttatgatcttgaccgtgtacctggcggctcatcaggcggatctgctgcggcagttgctgcgggacttgcacctgttgctcttggtactgatacaggcggatctatcagacagcctgctgctttctgcggcgtaacaggtatcaagccaacatacagcagagtttcaagatttggtcttgtggctttcgcttcatctcttgaccagataggttctatcggtcttgacgctcatgactgcgctatactccttaacgagatatgcggctatgacttccatgacggcacaagctcaaagcttgaagtgcctgacttcaccgcaaagataggcgagtcaatgaagggcatgaagatagcactccctaaggagttctatgcagagggcatcaatgatgaggtaaaggctgccgttttaaaggctgctgaggaatataaggcaatgggcgctgagcttatcgagtgttctatgccgtcgcttaagtatgctgttccttgttattatcttcttgcttgtgctgaggcggcttcaaatctgtcaagatatgacggtatcaagtatggtcacagaacgctcacagctgacagctatgaggagcttataatcaagtcacgttcagagggcttcggcgaggaagtaaagagaagaatacttcttggaaactactgcctgtcaagcggatattatgacgcttactacaggaaggcaatggctctcagacagcttatcagaaaagaatacaacgatatattcgagaagtgcgatgttattcttacgccgacaactcctgctgttgcatacagccctgagatgacttccgaccctgttcagatgtatcaggctgatatatgcacagttacagtaaatatcgcaggtctgcctgcaatatcaactccttgcggctatgacagcaagggtatgcctatcggtatgtctgttataggcagaaagttcgacgaggcaactatcatcaagactgccgacgcatacgaaaagagcttcaagcctgttgcgccaaagctttaagggaggtaagacaaatggaaaaatggagaacggtcatcggccttgagatccacgccgagctgcttaccaaaactaagatcttttgtaactgctccgctgagttcggaggtgcgccaaatacaagatgctgccctgtatgtacaggtatgcccggtactctgcctatcatcaatcagcaggctgtagagtatgctgtaaaggcaggatatgcgctcaactgcggtatcaacaagttttcagtattcgacagaaagaactacttctatcctgacctgccaaaggcatatcagatatcacagctttacagacctatcgtaggtcctggatatgtgcctatcgaggtgaacggtcagaagaagaacatcagaataaaccatatccaccttgaggaagacgccggtaagctcgttcatgacgctttcaacggaatctcaatggctgactataacagatgcggtatcccgcttatcgagatagttactgagcctgatatagcgtcagcagaagaagcaatggctttcgttgagcagatatctctgcttttacagtatgcaggcgtttgcgactgtaaaatggagcagggctcactgagatgcgacgttaatatctctcttatgcgtccagacgctactgagttcggtactcgtgcggagataaagaacatcaactctatcaagtctgttggcagagctatcaagtatgaggaaaaaagacaggcgcttcttcttgaagctggcaaaaaggtcgttcaggaaacaagacgttacaacgcaaacagagataagacaacttcaatgcgtacaaaggaaaacgctaacgattatcgttatttcccagagcctgatattcttcaggtaaaccttacagacgctcagcttgatgagataaaggctaagctgcctgaaatgccaagcagcagattcaagagatatactgaggaatacggtatttctgagatagacgcaaaaacgcttatccaaacaaagataatctcagatttctttgagaatgcacttaagagatataacaatcctaagagcgtggctgtgttcattctcggcgagtttatgagaagagtaaatctgggcgagatagatataaacaatatcagcttcacacctgaggagtttgcagagcttgttgaaatggctgatacagagaaggtatcaaagaacgacgctaagaccgtgttcagagcaatggtagaagagggcggcaagcctatggacattgcaaagagtaagggtatgataatcactgtggatactgcaaaggttgaggcaggcgttgacgagatactggctgcaaatgccgcacaggtagagcagtataagaacggtgaaacaaaggtattcggctttatcatgggtcagtgcacaaaggctctcaagggcgttgcaacacctaagataatcaaggaaattcttgaaagcaagctgaaagctgctgccgcaagcgctgcttctgatgctgagaagaaagaggacgtaaaggacaacgttatcgacacttcaaagctcacaaagtatgagaacgctgataagtatgtacctgaaaatgacggcaaaatgcttatgatagatacggctgacgtaaagaaagagtttatgcttgctgacgctaaggctaacatgggcaagaaagttgagttctcaggctgtgttcacagaataaagaacatgggaagcattgcgtttatcgttgtaagaacttcaagagatgttatacagacagtttactctgccgacaattgcaaggattctatcgagggtctgagagaaggcttctttgtaaatgtaaagggtatcgttaaggaaaaccctaaggatttcaatggtcttgaaatagaacttgattctatcaagcttatctccacaaacgccgctgaactgcctttgaagatatcacagggcagacttaactgcacaatagaagtaaatcttgacaaccgtgcggcttcactgagaaacccttatgagagagctatattcaagctccaggagggtcttgttcagggtatgcacaagttcatgcaggcaaacaacttcactgagatacactcgccaaagatagttgctcagggtgcagagggcggcgctaacatcttccgtcttgactacttcggcaagtctgcgttccttaaccagtcaccgcagttctataagcaaatggctgtggcattctttgacagagtttatgagatagcacctgtatacagagctgaaaagcacgctacttcacgtcatatcaacgagtatatcggtcttgactttgaaatgggctatatcgacagtatgtatgacgttatgaaaatggagattgcaatgctcaagtccattttcgagtatatcaaggaaaactatcagaacgagttgaagatacttgaggctgacgttcctgagataaaggaagttccgtctatcaagttcgctgacgctatcgaactgctgagaggcggcgagggaagcggcaagaagttcgaccttgaccctgaggacgaggtaaacctcggtaagtatgccaaggaaaagtacgattcagactttatctttgttacacacttcccatcatcgaagcctccgttctatgcaatgaactccagagaagacccaagagaagcatacaagttcgatctgttgttcagaggacttgaaattacttcgggcggtcagagaatacacgattataacgagcaggtagagaagatgaaggctcagggacttgaccctgctgacttcaagaactatcttgaggctcacaagtatggtctgccacctcacggtggacttggtatcggtcttgaaagacttctcatgaagcttcttaacaagaacaacatcagggaaacatcactgttcccaagagatatcaacagacttcttccatagtctgcaaatatgtttatcaaaggggctgtaaaaaaagtccccaagaaaaaaggctgcgatcttgccaaaaagcaagacagcagtctttttttgtggtatttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgcctttgttcgtttggcggagatggagagatttgaactctcgctacggttttgccgtactaccgcatttcgagtgcggacccttcagccacttgggtacatctccttgtgtcaactatactattatacaagtaatcacaaaaaaagtcaagccctttgtgcaaatttaagcacaaagagcttgtccattatctattgctgagcacgcctctgcatatccttaacatatgcaagcgtttcaggagtgtagcccaccattgcgttgggacaacattgggaaagcaattgcataagccccatggcggtgtccttgcccttggcatatacgttaaaacgcagtacattcttcttgtgcttcgtgcagacgattatctcgttggtgtagctgatgaaattcatactcgctgtgtgctggtaaatgccgtaggcttcctctcgccagcacatctgaaatggcgctttcttgttggcaagcaccctgtcggatacgataatataatcgtcctgatattgtatgttggcgtaaagctcgtcagcctgctgtaaaagatcgggattggctttgaatatgccgctcttttcagggtgcgtcctccgtgacgtaccaaatataagaaatataacaccaggcgtaagcgcaaaaagtccaagtatcaatacgctgtattcaccggctactaccgccgcaaatgagataaatccacccattagcgtgagtatcacaccgccaactatcattgctatcattctttttcgtatgttggcaaatactacttctcgtcccatttttgttacccctctttactttttatccgtgattctgctttgcaacaagactctctccgcagtatatcttcctgagcttcggcttctctatcttgcccgtcgggtttctcggtatgtctgcaaaaattatcttgtgcggacgcttgtatctcggaagcttctgacagaacgccattatctcttcctctgtgcatgggtggtctggctttagctcgattattgccgccgctatctcgcccaaacgctggtcaggcagaccaattactgccacgtccctgatagcgtcatgacttctcaaaaagtcttctatctgtacagggtaaagattttctccaccacttataataacgtcctttttgcggtcaacaaggtaaataaatccgtcctcgtcctcctgagccatgtcgcccgtgaaaagccagccgtctttgagagtttcggccgtcgcctttggatctctgtagtagcaggtcataacgccaggaccttttacgcaaagctcgccaacttcgccacgctttacagtgttgcccttatcatcaactatcttgaccttccagccaaagcctgccttgcctattgcgcctaccttgtcaatgttatccatgccaaggtgtacacagccgggacctatagattcgctaagaccatagttagtgtcatatttgtggttaggaaaaacctttttccagcgtgcaataagtgacggcggaacaggctgtgcacctatgtgcataagcctccactgtgaaagctcatactttgaaagtgtcacctcgccgctgtcgatagcgtcaaggatatcctgtgcccaaggcacaagaagccatacgatagtacacttttccctcgatacagtatcaagtataaattcaggcttcacgcccttgagaagcacagccttgccccctgagataaggcttccaaaccagtgcatcttcgcacctgtgtgataaaggggagggatacaaaggaatacatcgtccttggtctgaccgtgatgattctgctcaactcttgcggcgtgcataaggctctcgtgattgtgcagaatagccttcgggaagcctgttgtgcctgacgagaagtagatagccgcatcgtcctcgtcagtaagctctatgtacggagtagtgcttgcacagtttgcagtgagtctgtcataatgctctgcaaatgacggacagttctcgccaacataaaaaagaagtctgttcttgcttatctcatcagctatctcctcaactctgccgataaattcaggaccaaatacaagaatatccacctcggcaaggtcaagacagtattttatctcctctggagtgtatctgaaattcagcggcactgcaagcgcacccgtcttgaggataccaaaataaataggcagccattcaagacagttcataagcaggatacccaccttgtcacccttttttaccccacgggataaaagcagattggcaaagcggttagccttttcgttgaaaacgctccaggttatctcacggcgataatgacagactgggttaggctcgataagctcatattccttccaagtcacacgtctggtttctctgatctcaggattgacctctaccagagcaacatcgtttccgaactctcgtgcgttacgctccagtatctcggttataggcatacaaaaacttcctttcataattaaaagcttgaaagctagaaaacttaaaagcttaaaagtattcaaaaacatatatgttattattttatcatatgattacaaaaaagtaaagagatttaaaacagaataagtgacaaagtgaaagataaataattgtggagtttttacagaagaaaagtgtttgcccctacctaaatttgagcgaataccgtcaaaaagataaccaacaaaaaagacagccccacatgggagctgtcccttaacttaaaaagtgtaccgtttcagatcttattcttctgccttttcttcctctttgctcgcctcagccgcttgctgtgccttgagaagatccctgatctctgtaagaagcactacgtccaccggtggctctgcaggcttttcaggctcttcatgcttgccaagtgacgcaagcttgtttatgaccttcattattacaaaaataacgaacgccatgattataaagttgatcactgccgtcagaaatgcgccgtagtttatgtactgatttccaagcaaatgtatcttgccctctacgtcagcaccgcctatacagcctattatcgggttgataaaattctccgtaaatgacgtcacgataccctgaaacgcagcacctatgataacgcccactgccaagtccatgacgtttcctttgagagcaaacgccttgaactcatttacaaacttcttgataaatccttttttcttctcttccataacggttacgacctttcgttttttgttccgagccacgctcttatggtcattttatcacatattttgaccattttcaatagtttttctacaaaatcgtacggttttacgtcgttttgcacatatatgttaatgctctgtaaatgctttgtaaacaaacataaaaaggtattgcatttcccgaaatggtgtgctataatgattaagctgtttgagtgagggacatgacgatgggatatagccaagaggtaaggcagcggactttgactccgtcattccgatggttcgaatccatctatcccaaccaaaaacaagctaaatcgaacaaacattggggtgtcgccaagtggtaaggcaacggactctgactccgtcattccgaaggttcgaatccttccaccccagccacaaaagaccgtagattttttctgcggtctttgtttttttatacattctttcagcagccaaaagaaaggttttgcaactgagtataagtaaacataaaaaacaaaatgtgaacaaaaataattcggaattgcgtgtttacaaactggtaaaaatgtgttatacttaaagtgcaaaagaatttcatcaaaggaggtctgaaaaatgaaaaagataataaacagaaaaaatgcagcggcagtggcttgtgccgctatgatgatatgtgcggcaggtgctgtgcctgacagcgtgctaagtgtgagtatgcctgtgcaggcggccgaagctgtggagcagacaagtctgcctcaggtcacagggctgacatctaaaacgcctgatataagctcaataagacttagctggaacgctgtgagcggtgcggacggctattctattggaatgcgttcaaagggtcagtatcctgagatagcagacgttacggacactacatatcttgttacaggtctgcctgcggcaacgagggagaacttcaaggtaagagcctataagatagtgaacggtcaaaaggtctatggcgactattcagtgaactacaattccgccacaaatccacgccctataagcggtcttaaagctcagacgggcaatgcttccgtcagcctttcatggaaaaaggtgggctgttcaaactatcgtgtctttatgctgaaaaacggcaagtggaagcagatagcgcagacagatacaaacagctacactgtcattaggacttgacgcaggaagctataaatttaaagtaagagcctgcaagcgtgacgataagggtgcaaatcactacggcaaatattcgcaggagataacggcacaggctgtcatggtgaacaaggtcaccggtctgacatctaagacccctaacacaagctctataaagcttagctggaacgctgtgagcgatgcggacggctattctgtgggaatgcgttcaaagggtaaatatcctgagatagctgacgtgaaaggcacgacctacactgtcaagggtctgcctgcggcaacaagggagaatttcaaggtaagagcatataagatagtagacggagttaagatatacagcgactattgtgaaaactacaattccgccacaaatccaaggaaggtaacaggagtaaaagcttctgacatcaccgcttcgacacttgaccttaactggaagtctgtaggctgcacaagctacaaggtgtttatatacacaaacggcaagtggaagaacatagcttcatctacggtaaattcctgcgcaataaacggactttacgcaaagactacatacagattcaaggtaagagcctgcaagacggacgataaaggttcaaatcactatggagcatattccgaggagataaccgtcaagaccccagaccacactgtcgaggtcataaacggcatgagctatgttgacggagttcttttggcgaacaaaacatattccctccctgcaagctacgacccaaagggtctgaccaaagaaacatcagcggcattcaaaaagatgcagaccgctgcatataaagacggcataagtctgtgggtatgctcaggataccgctcttattacgatcagaagtacctttatgatatgtactgcaaccgtgacggcaaggctgcggcagacaaatactccgcaagacccggctacagcgaccatcagacaggcatggcaatagacgtaaacaacgccagcgactcatttggcggcacaagagaagccaagtggcttgccaacaactgtgcgaaatatggttttataattcgttatccaaagggcaaggaggcttacaccggttatcagtacgagccttggcatataagatatgtaggcacgcctttagcacaaaacataaccaacagcggactttctcttgaagaatacttcgggataacttcgcaatacaaggattgacatatggttcagaccgctgttcacgggcatctgtgggcagcggttttctgttattttccttgctcacttatcacttgaaatcttgcatttcaacatgatctgtgttatactatatttaaggcaataccgcacaaagattgtgcgtcagatgcgaagtcagattttttgtgtgatatgacggaaaatctgcaagcagatggcgtgcaaagccgtcaggcgggctttgtgcggtgttgccttatatattccactaaggaggtcatctctatgcttctttcaggtaagacggccgttctcggcgtcagcggcagtattgcggcttacaagatcccaactttagcaagactgcttaaaaagcaaggctgcaatgttcaggtactcatgacacagaacgccactcaatttataaaccctatcacatttgaatccctcacaggcaacaagtgccttatagatacttttgacagaaattttcaatacagtgttgaacacgttgctcttgcaaagcagactgacattgttatggtcgctcctgcttccgctaatgttatcggcaagatagcatacggcattgctgacgatatgctcaccaccactgtcatggcttgcccttgcaagaaaatgatatcccctgccatgaatcacaatatgtatcacaatcctattgtgcaggacaatatccagaagcttgaacgtttcggctacgagatgatcgctcctgacagaggtatgcttgcaaacggtgatgacggcgacggcagaatgcctgagcctgaggtgttgtttgaatacattcttcgggagcttgctttcgagaaagatcttgcaggcaaaaaggtgcttgttacggctggtgcgaccatggaggctatcgaccctgtgaggtacatcactaatcattcaagcggaaaaatgggctgtgcggtggctaaagcggctatgcaaagaggtgcaaaggtgacgttagtggcaggtcacatggaggttttgccgcctatgttcgtggacgttgtgaacgtaaagtctgcggcggatatgtttgaagctgtcacaaagtttgctcctgagcaggatattatcgtaaaggcggcggctgtggctgactacacgcctgttgcggtggctgacaacaagataaagaagtctgacgatgatatgaagatagagctaaaacgcacgaaggatattcttggctatctcggtcagcacaaacgtgacggtcaggtcatatgcggtttttccatggaaacgcaggacgttatcaagaactctgagaaaaagctcaccaacaaaaactgcgatatgatatgcgcaaactcactaaagaccgctggcgcaggcttcaagacggacactaatgttatcacccttatcactgagggcggtgctgtggagctgcctatgatgacgaaagaggacgctgctcacaggatacttgacgagcttgcgaaaatgatataagtgtacgataatatgtacagataaatagatcacgaagggaaatacgccatatgaaacgtattgagatatatgaaaacggcattaatatagtatttgagataacagacgacaacgaggcgaagcttctgcacttctctgctctgccatttgatgaagtcaagacggcttcatacatggggctgaaaacattcagacctgtagagatacaggcgagcggtatcgaccgtcctgacgagcgtcacggaaacaaatatatcgtgaccgcaccaggttggagaatgaagttcaaggacttccgtgatgtgaacaatgattatggcagaaagcttgagcttgtgacatttgatgagggcacaggtcttgaagctgtgtcccactatcagttttacaccggcacgtctgttgtacgctgttggactacccttacaaacaagggcagcgaggtacagaccattgaatatatgtcctcctttgcactgacgggcgtagaaaaagaggggcttaaaaagcctgaggacaagatgaagatatgggtatgccacaactcatggcagcgtgaattgcagtggcaggactacactcttgaacaggtggggcttgcgtcctctgctaagcctacggaacagcgttcatcaaaggtatttgcctgcacaaacgttggaaactggtcggcaaaggaatacataccaatgggtgtgcttgaaaacaccgaagcaggctcggtgctgttttggcagatagagcaaaacggctcttggcactgggagctttcggacgtgggaggacacttctatttacagctttctggtccgtcggagatagagtcccactggtacaaagatcttgcacctaacgagagcatagaaagcgtgaaatgtgcggtaggttctgtggctggcagctttgataaggctatgggcgagctgacgaaataccgcagaaaaatacgccgccgcaacaaggataatcagaggcttgcggtaatattcaacgactacatgaactgtctttggggcgacccaacgtctgaaaaggagtttccccttgtggacgctgcggcagaagcaggctgtgaatatttctgcattgacgcaggctggtatgctgacggcttttggtgggacgaggtcggcgaatggaaagagagcagaaagcgttttcctaacggcgtaaaggaagttgccgactatatccgcaaaaagggtatgatacctggactttggcttgaaatagaggtcatgggaataaagtgtccgcttgtggacagcgtttgcgatgacagttggttcttcacacgtcatggcaagagagtctatgacagaagccgttatcagcttgatttcagaaaccctaaagtccgttcccacgctgacgaggtaatagacaggcttgtttcggaatacggcataggctacataaaaatggattacaacatagagcctggtataggcactgagcagaactgcgacagcgttggcgagggtctgtggggtcatgaaaaggcttatcttaaatggcttgacggcgtttttgctcgtcaccctgaccttattatagaaaactgctccagcggtggactcagaatggactatgcgatgctttcaagatactccattcagtccacatcagatcaggacgattacaaaaaatactgcaccattgcggcgaactcccctactgccctttgccctgagcaatcggctatctgggcttatcctatcacatcaggtgacagagaagaagttgttttcaacatgataaatgcaatgcttctgagaatacaccagagcggtcaccttggcaacatcgaccctgaacgcaaggcacttgttaaagaggctatcagcgtttacaagaagataagggcggacataaaggaagcagtgccgttctggagcttgggtctgtccaaattttcggacgattgggtatctctcggtctgagaaacggcaacaaggcttatcttgccgtatggaggagagagggcaagagcgacacctgcgttttgcctatcgacttcctcaagggtgttgaagcaagggtgaagtgcatttatcctgatttcagcgaaacccctgtggagttttcaaaggcgacaggcaatgtttctgttaagtttgacagaccttatatggctagactttttgagatagagtggtaaaaaaagttacctgccaataagggtaacttttccccacaccgcaccttttgatttgtccgattttacggacagttgctcgcctgtgggagatattatcgctgatattccgcagtttcctgcacggaggacatatcttctgttctcaacggctcgcattatgcagtggcggtaatgctgttcacgggcagagcttttgccaaaccatgaatcgttggtggaaacgcaaattatctgtgcgccctgctctttctgtcggctcacaaggcttggaaaaatggactctatgcagataacagagcctatggtcatgccgtctgaggcgaggggcttggtgcgtctttcgtctgcacattcgctcatagtgtcaaggtggaaaatgcctgcaaaaggtgtcttttcaccgaaaggcacaagcacttgtttcaggtagggcgaagacgcaatgccgtttttatcataggcgaaaagggcgttgtaatccttgccgttttcaagatagaacgaacctgtcacaagggtacacccatgggtgtcggcaaagtctgatataagggaaaattcttttagctgttcgtcatagtctttcgacacggcagtttcaggaagcagaacaaggtcagtaccccaccgccaacagctttccattatagaaagataggagcgtgctgagtcaagggctttacggtgtgatttttccctgccctccagactatcctgtgcgcagataacgtctatctgaggatagatgttatcaagctttttgtcgaggtttatggaataaagtccgtagcttaaatttgccccctgcaaaagcagtgcaaaggcggtgtaggcaaaacgctttttgcttgtatatatctccccatgcagaccgttgagcaggaaaattataaagcttgtaaggcggcagcttatgagcgtggcggattgcaaaagcagtggcgaacttgttacagctagccatgccgcagaccacggaaacgccaaaatcggaactttctcttgaagccactcccctgctgtcaaaagcaggcagagcaaaactatctcagacaaacggtgtttgagatgcggtcgcaggggcaggaaaaggctcagtggaagatacataaggatacactcccacaaggtcagacctaaccacgctaaagtggcaagaggtatagaggcaaaggacggcagaggacatattttccatatggtgagcataaaagtgagctgaaaaagataatatggtacaaaaaagcacagaaaatcaagcctgaaagcccttttttcatggcagactgacaggcaatgcaccattggcgcaaagataaaaaacgcaagccacggcaaattcaagatagattgcataagtgcgctcactatacccgtgagggcgaggaacgctctccgtgagattttggggtcaattattttcgagatattcatgtaaatattatgacccgaaagtcgcacataattcacaaaactataaagggaggcagtaaattggagatctttattccgcagtttgtcaggacagctcttgacaggctgaatgagtgcggctacgagggatatatagtcggtggctgtgtaagagatagtttgcttggcaaaaagcctcatgattacgatgtctgcacaaactgcacccctgacaaaatgcttgaagttttcgcaaatttccgcactattgaaaccgggctgaagcatgggacgctcactgttttgatagagagcgagccggtggagataacctgttatcgcagtgacggagagtatatagggcatagaaagcctgctcaggtgacatttgaaagctcgctggaggaggacttaaaacgtcgtgactttactgtgaacgctatggcatactcaccaaaagaggggcttattgacctttacggtggacaaggcgaccttgaaaagggcattataaaatgcgttggcgagcctgaaaagcgttttgacgaggacgctctgaggatattaagagggctgagattttcttcatgccttgggtttgagattgaggaaaagacctcaaaggctatccttgaacaacgtgagcttttaaaaagcatttccgctgaacgcattgcgtcggagcttaaaaagcttctctgtggaaagggtgcaaggaagatattgcttgactatcgtgaggtcatagcggtgttcatacctgagcttcgggaaagctttgatttcaggcagaacaatccccaccattttcttgatgtttacggtcacatttgtttgagcgttgagaacgtcagaccacagtggcagatgaggcttactatgcttcttcacgatattggcaagccgagaatgcacactgttgacgagaacggcatttcccactttaaaaagcaccagttccagggggcttacatggcggagaagatattaaaaaggctcaggatagacaatgcttcggcgaaatatatttatgagcttatatgggagcatgacaacaggatacctgccacgaaaaagtcggtgcgaagatttatggctcagcatgactttgactttgttatggattatctggaggtgcgcagggctgacacatatgcccagtctgactacaaacggcaggaaaagcttgcagaacttgaccatatcgcagagcttgcaatggagataaaagaggacaacgagtgtatccacatttgcgaccttgacataaacggcaaagatcttttacaaatgggctttggcggaaaggatatcggcattgggctggagcttgcgttgaatggtgttatagacgaaaaggtggaaaacaaaaaagaggagctgaaaggctacattgaaagcaacttcaaaaggcaggataaagataatacttaaagggtcggcacttgtgctgtggtgcgtggtgatattcatgttctcggcaaacaatgctgacgagtccaacaagcaatcaaatgcggtgtttaacacagtgatagaatttgtcaaccctgtatatgacagccttgacactacagcgcaggcagaatacaaggacaccgccacgttcatcataagaaagcttgcgcatttcagcgaatacgccttgcttggaatactggcttttataaatcttgctatggtgaaaaagcttggatacagagggctttttgcggcagttttttcttgcatctacgcttcaagcgatgagatacatcagcttttcgtgccggggcgtgcaggtcaggtgcgtgatgtccttatcgacacaagcggtgcagtggcaggaattttacttgccatactaatacgaaaaatatggctcaaaagccgtgagaaaaaatcgtgataacaaaaaaatatccgtgggggcatttcgctctcacggatattttattctagcaaaacctattgcaaatcatatcgtgacccattggtatcgcctcattcaaagcctaggctttacttaaatcactttatctcaagtcttttggtttcaggctttacctcctgcatctttggcaggtcaagggtcaggataccattcttgtactctgcggcgatattgttggtatcaatgcctgtaaggtcaaagcttctctgataagaaccgtatgtcctctcacggcggatatacttgtctttcttatcctctgtctctgccttatgctcagcggtaagaacaagatcgttgcctgagatgtcaagcttgatatcgtccttatcaaagcccggaagctctgcttccattacatatttgtcgccctcgtccttgatatcggtcttgaagctctggagtgcattttctccaaagaaatcattctcaaaatcatggaatgcgttaaacaggtcgtagctctttctttcaaatggtgtaagtccaaacatataaattcctccttgatgtgttatatcttaaattgtcttgtaagcttttatcatttattctgctcttccattggtatcatttcctttcttcattgtctttatgatacccctgctatgtgttcattgtgtgaagatattgtgaacattagctgaaatttagcactctcattatacgagtgctagcatattaactttatgagtgctaaaacaatgtcatgacatgatatgataatcagcgggcgaacgctgttcgcccctactgcgtcaacgcctatcactgcttatcgaagcggtctttaagaagcttcaaggctttcttttctatccttgaaacataggaacgtgagataccaaggcgttttgcgacttctcgctgcggcagttgtggctgaccgaaaaggccatagcgcagagtgactatctgtctttcacgctcatcaagggagctttcgatatagcggtagagctgttcactgcgaatggaaagctctattttgtcggcaacgtcctctccgtctgcgattatatctataaggcaaagctgattgccgtccttatcggaatcaacaggctcgtcaaagtggatatcgttggcagactttttctgggatcggaagtgcattaatatctcgttctccacgcacctgctcccataggtggcgaagcgacagcctttcttgtggtcaaatgttgacacagcttttattagaccgatagtgccgatagagataagatcctcctgatctgtggaatttgaataatacttttttataatatgtgccacaagacggagattgtgttcgataagcttatcctttgccgccttgtcaccctgcgccattctctcaaaacactcacgctcttccttcgctgaaagcggttttggaaacacgctgcggctgtcaaaatgcagtgcgaaaaatagaaaattccccgtaagcagttcaaacagtgctgaaaacatatttgtccctccttatataaagtatcgctcatacgctttttaatcatatgatttttagggattgtactattctgattttgacataaggtcgcaaaatgtttctgatttgttaaatttgctgaaatattgattgtcttgtttgctaaaatcacgaatattgttaacgttttgtaaacagacggcattttacttttatcgttaaacaaatggtgatataattatatcaaataggtatgttttttgggggtgagcgctcatgataagcataaaaggacgatcggtattcggaagcattgcaagaggaaagctgaccttttatcaccgtgacgaatttatcatcaacaagataaaagtgtccgaccctgaacttgaatacaaaaaatatgtcaaggctaaaaacgctgctcttgtggagcttggggagctttatgaccgtgcaaggttaagcgttggggaaggcgacgctcaaatatttgtgatacaccaaatgcttatcaccgacgagcaatacgacagcagtattcgcacaaagatacttgacgagcatttcaatgccgattatgcagtcgcaagcacttcaagaagctttgcggagatgctggcacaaatggacagcgaatatatgcaaagcagagcggctgacgtcaaggacgtttcaaacagacttttaagacacatattaaactgcgccgacaagcttcccatactcagagagaacgccattatctgcaccggtgaccttatgccctcagaaaccatgctcatggacaaggcgaagataaagggcttctgcacaaggtccggttctgtgaactctcatactgcgatacttgcgaaaaatcttggcatacctgccattgtgaacgttggagcggagctttctgacgaatacgagggcaaggaagccgtccttgacggctacagcggaacgctttacatagagcctgatgagcatactctcagacagcttgaatacaaggaagccgttgagggcaggaaaaaggaacttctcacaaggctcaaaggcagaaagaacatcactcgtgacggacatgagataaagatatatgcgaatatactcaactctgaggagcttgaatcggcggtaaaaaacgacgcaggtgggataggtcttttcagaacggagtttatgtgttttgacagacctgcttttcctgacgaggattttcagttttacacctaccgcaaggcattggaggcaatggagggtaaagaggtcataataggcacttatgatataggtgcagacaagatacctgattgtgcagacatgagtgctgagagaaatccctctatgggctgtagaggcatacgattttgtcttgaaagagaaagcatattcaaaacacagctaagggcgttatacagagcgtctgtttacggacagctttcaatacttctgcctatggtcatagatgtgagcgagatactgagggtgaaagagcttatcgtgcaggtcaaggcagagcttataaaagagggcaggaaatttgccgacaatgttaagctcggggcaatgatagagacccctgctgcggtgatgacaagcgatatcatagccaaagaggtggactttttcaacatcggcaccaacgaccttgaacagttcgctttcggtcttgacaggcaaaatccatgctatgacagggtgtcccctaaaaatcacagggcactgcttagaatgataaaaatggtgtgtgacaacgcccatgcaaacggcataaaagcaggcatttgcggtgagatagcaggcgacccaacgctcacagagatatttctggagcttgatgtggatatgctgtcggtagttccgtcaaaggtactgccactgagaaaggcggtaaggagcataagtcttaaagacccgaagaaggcagagaatgacctgaagctgtttttataaaaagggtaattttcctcattccatataggcggtgggatacgttatcgtgcgtgttccaccgcctttttgctttgcttgcaaatacgctaataaggagagcgaactgttcaccactacagatatttaaacaaagaacgtattttatcttatggtctgtatggttgtcttatgaaaatcttaagagtttcttaaagcggttgacagttggaaagggctatgataaacttatatatgccactaaaaaatacgtctgaaaaagataagacacaaggaggagaaactttgaaactaagaaacataaacagaggtctggttcttggcggtgtgcttgcgctgggcgttgtatgctacacagcgtatgataacaaccagttcaagacttccaagcctgagatagaacagaccatgaaggattatatcgcagacttgacaagtgcaaacgttggaagcagtgatacgttaaaaagtcaactgacagattttgtggataagcattatgctgactacaccacttctgacaatgagtacgcttcgtcaaagtcaggacttctggacgaaataaaccaagctgaagttgcaacgcaaggaggagatatcacctcggctgagtatgacataaaagagatgtcaataaacaagagtggagctgacggagcaaaggtcactatgatatacaatgtgtgctatgacgtatcaaagggcgacccaacttttctcacaaccaacggcataaacaccatgacaagcggtaactacacaaattccgacaactatgaacccagcacatcttcatacaaggcgattttcagttatgaaaatgctgaattttatcttttgcgtacttctgacggctggaagatagcaacgtcctgctactacggatatggcgaggattacaactttgatgataacaacagtgacagcgtggctgatgaaagcaaggctgagtctgagatagttccggacagcagtgcagaaagctcagacagtgcagaaaaatccgacagcgagggggcagacagcgttgagtgatactattctaaagataaaggggcttaacaagacccttggcaaaaagcagatacttcacagcatagatatggagtgttacagtggcgaggtctacggctttctcggtcctaacggtgcaggaaagaccacaactataaagatagcagtggggcttttacagcttgacgagggggagatatccattaacgggaaggatatcagaaaagactttgagggcgcaatggcgaacgttggaggcattgttgaaaaccctgagatgtacaagtatctttctggaatggaaaatctccgtcagtatgcgagaatgagagagggagtaactgaggagcgtatcaaagaggtggtggagcttgtaaggctttcaaaccgcattaatgacaaggtgtcgaaatactctctgggtatgcgtcagcgtcttggcgttgcgcaggctatactccacagaccaaagcttcttatccttgacgagcctacaaacggtcttgacccgcagggcataaaggagcttcgtgacatactcaaagagcttgctcacaaggaaggcacttgcgttgtggtatcgtcacatctcatgagtgaaatggaaatgatgtgcgacagagtgggcattatcgcaaacggaaaaatgataggctcatacacaatggaggagcttatctcacagtctgacagctcaattgctgaatatgtacttgaagttgacgaccctcaaaaggctatgggtcttataaagctcgcagacgagggcaagcgtatcgacaaggaaacaggtgcagttgtcctttctatccctgtggagatagagaagaaaaagatagcctcggtgaacaagacgcttatcgagggcggagtttcactttacactgttcaccgcagagagaacaagaagcttgaggacgtattcatcgagcttacaggaggaaaggaagggggcgtacagattggctagatttttcagacttgtgaaaaacgagtacataaaggttttcaaaaagctatccacaaaaataatgatcgtgcttataataatatgtgcgcttggactttcaggcattgcactttttgcaaagcacaatatggagagcaataactattcaagctatgacgcaactggtgattatcaggaaaccatagattggctaaaaaacacaaacggcgaccctaacgagatcgcaatgtggcagtatcttatagacaacgatatcgacagcgatgattggagatatgatgtactgtcagccgtattcgcagacggcactggtgatatgtcagggataaagaagtatcttgacgacaacgattggcgtggcttctgtcaatacaggctggataatgacatactcacagagggcgaaaagtgggaatatcaatacaggttggacaaggatatttcctttgataagtcaaacgagaagaaaaacgatcttatcatgacagttgcaaacgcaaaaaacaccattgcgaccatgggcgacgcaaagtctgacggacagaacagcagagcaaagctggaggataatataaaacttgcactctatcagcttgacaatgataagctcgacaacacagcaaaccaaatgacgctgtttgaaacaagcgagcctgagcagataacattctggacagtgttcctcacaagcacttcccttgtaacggtagtcgcactgcttgctatcgttatcgcaggcggcattgtatcctctgaattttcacagggaactgtcaagtttctgcttataaaccctgttaaacgctggaagatactgatgtcaaaatacttcactgtcatcacagtaggttacataatgctttgcatacttttcgttgtgatgatacctattacagggcttatgctcggctttgacggcttctcaacgccttatatctatgtaagcggcggcgaggtaaaggaaatgcctacactgctttatgcggcagagcaatatctgatgaaaagcgttgaaatggtggtaatgtcaacactggcgtttgctatctcgtcacttgtaagaagcacagctcttgctatcggcgtcagcgtattcacaatgtgcataggctcaacggtcacacagcttttgggtcagcttggacaggattgggcaagattccttgtgttcgcaaacaccgaccttgcttctatctcaaagggctactcaatatttgctcagcacagcctgacctttgccgtaggcgttcttatagcacacatggtggtgttcctactcaccgcatgggacggctttacaaagcgttctgtataaaacagaataaaaacataaaacgggcggagaaatttcgctcgttttttgttgctgaaaagggtaaacaaatgaacagattatcatataaacataagattgacaaggctgaataaatattgtataatagtcgagttgatacagagatcgttttaatttacaggagatagatatatgtttgaaactttagttgacgtttttcttgacgcattaatagacagccttaagatcctgccttttctgttcggagtttatctgcttatagagtatatagagcatcgttctgccgacaagcttggaaaggctcttagaaaaatgggaccttttggtgcgataggaggaagcatacttggagcagtgccccagtgcggattttccgttgtggcttccaacctttactcaggcaggctcatcacaatgggaactctcatttcggtataccttgccacaagcgacgaggcaataccaatgatgatagcaaaccctgcatttgccggcaagctttggcagcttattcttataaaggtagctgtggctataatagcaggtgtgcttgttgaccttatcttaaagcttatgggcaaaaagcaggacgaagagcctttcaaggagatatgcgaggactgcgactgtgaacaccacagtattttgcactcggcacttcaccacactgtaagcataatactttttatatttgcggtaaaccttattctcggtgcggtaatggagtttgcaggagaggacacagttaagaccctgcttatgtctgacagcatagttcagccgttcatagcaggcataataggctttatcccgaactgtgcggcttctgttgttctcactcagctttatatcgagggcgttgtgagcttcggctcgcttatcgcaggactttgcacaggagcaggagtgggacttctggtgcttttcaagaccaacaagcacaacatgaaagagaatttcgccataatgggaatactttatgttttcggtgtggcagcaggctttgtggcaagtctgttctaaaatatgatagacagataaaaggagcaattcgcaatgaactgctcctttttgtttgcaaaaattcttcgtatgtataatgggctgtgataggcgggcgacccaaggttgcccctacactacatcatatcctcaataagataaggcaggcttatgcggaagcaaacgccgccttttttcatatcgttttctacctctatgcttccctcggaaagctcgattatcctttttacaagtgcaagtccaagaccgttgccctctgttgcacgggagcggtcgccctgatagaacttatcaaatatcttcgcctttacgtcaggggctatagacggaccgttgtcccatatctccgccgaaatattcttctcgttgcggaaaagcttcacgcttatctttccgccctccggggtgaacttgatagcgttgttgatgatattctgccatatctgcgccataagctcctcactgcccacatacatgatatcctcaaggtcgatatcaaggtcgatttttttcttcgaccactcaggttcaagcacaagaagtatttttcttatctgctcgtcaagagaaaatcttgtctttttgcccactgttttctgattttcaagctttgtgagcctcaaaatatttgacgaaagctttgaaagccgtgatgtttcgtcgattattatctgcgtgtattcctcacgctcctgctcggttatatcgtcagattgcagaagctttgcaaagccctgtacagacgcaagcggtgttttgaactcgtgggaaacgtttgagataaagtcacctctcagcgtttccgtacctgcaagctcctcagccattttgttaaagttctgtgcaagtatgctgtattcagggtcagacggttctcttactcttactttaaagttgccctttgctatctcagccgccgccgcactgagatctcgtataggctgtataatgcttcggctcatgaacgctgttataatagtaccgataacgatacagaccataaaagctatgatgacaacaaggtttactacccagtaaacgctgtcgcttgaaaagctgtctatgataacgaacttatcatagacctgagagattatagttgcgttaggcacaacaccctctgaggacacataatatcccttatgcacgatatctgcaaaatggtcgtgtactcttgaatcgtttttatccaccactgacagactataggctgaattgttcacaatggaaactatctcgtccactgtgaagccgcccttttcttcaagctgatccattgccatggaaagctccaccaactgctgttcggcattgcttttcattacaggactgcacaccattacaagcactgacaccgatatagaagccgacaccagcatcacaaagaaaaacataagagtcagcttgaactgcaaacttgttttatttttggcctttttcttatccaaacccctcacccctcaagcttatccgtcactgctttttcacagccttatagccaagtccacgaaccgtgacaatatcgaatgactcacagcttccgtaacgctctctcagccttttaacgtgaacgtcaacagtacgctcatcaacgtccttatccatgccccaaagctcgtcaaggagctgacggcgtgtgaatatcttgtcagggtagctgagcagtttaaaaagcagtttgaactccatttgcggtatcgtttccgccgctccgccgtcaaccgccacgctcatagcgtcataatcaagcacgcagtttcccacagtaagagaatgttccgacgccatttttgaacgccttaaaagcgcacccacacggagtatcatctcatttatatcaataggctttaccatataatcgtctgtgccggcagaaaagccctcctgcttgtcctcgaaggtctcctttgcggtgaccataagtataggcaagttgaaatcagcctttctgagctgtcttgtaagctcatagccgtccatattcggcatcattatatctgaaattataaggtctatattcgttttttcaagaacgtccaaagcctccagaccgtcatttgcaagaaaagtcacatagccatgctgtttaagtgcggcagacatgagctttctaaggcttgcgtcgtcctccaccacaagtatctgaaacataaaatatcctccctcgtaaaaaaaaattccccaataatgacattatagcttataattgtgaactggtgattaacatttatttttttcaaaaaactctccgaaatcccctgaaaattcatattcggttcacacagaactggtattatataatcacagcagaagatacaaaaaaagctttggtaattggtaaaacttaaagtcaggtttttgtcttctttccctctgcgattccccaagtcgctgatacatttcctcgtctttaggttttaccaaataccaaagaatccctttcataattctataaaaaattaatgctcatttcagccgatggaagtgggtattaatttttttattgctcttttaagacaagatacgacaaaaaaaccgcagaagccacataaaatgacctctgcggatattttttgcctttattagccgttagctgcaaagcttttcacgaagctcagccgcctttccaagaagcgcacagatgtagctgtccacatcaggctttgcaaatccaccaagcgctgagcctttaagctttcgctgacctgtttctccggggataacaaagttatcaccgttctttttcttttcgatagccgactccagcatatagatctcactggttatggtgtcgatatattttaatgtatcaagcttatcatagccgccaaaaaaacacgttttcagactatccattattcttccccctgccttactgctgttttgcacagcaattgttatcaaagcctacaatctttatttgatttaattatatcacaaatacttagctttgtcaataggtttgaaaatgaatgttcacagttaagtaattttatatgaattttcgtggcgttttatgttgaatcattatagatataaaaaaacgcagcctttgcagactgcgtttttacgttatataagtcttttgattatagtgatgttgttgtatcttgaaaaatactcaacatttgaaataacgataccagtggcagtgttctgggcgtgtaccattttgccgtcgccgatatagatagcaacgtggtaaatgctcgagatcgacgctccgccaaagaagataacgtcgcccttcttcatgttgttatatgaaactgtagtgccgtataaagcctgcgaagccgcatagtgcggaagatttattcccacctgtgcgaacgagagcatcacaagacccgaacaatccgttgcaccaaactgtgaaccgccccatacatacgctccgcccaccatgcttttggcatatgaaacaacagtgtctattttagaactgcttgaataatcaggcttaggtgcaggcgctgctgttgttgtggtagtggtctttttgcttgtttcaggctttggcttagctgtttcctgcggagttgtggtagtctgagccgtagtttcgtcaggcttttccgtctgagccggcttcttcgtggtagtggtcttttcaccgctgttgccactctttttggtggtggtagtctttttcttggtggtggtcgtagtcgtggtggtattcgcctttgaggacacctccgcatacttattgtccacctgctgtgacttattttcaaggtcgctcttatcgttctttatctgctcgataagcttgcccgactcctgctccattttcagaagctccgcctgctcgcccaccaaagttttctgctccttggcatattcctcagcctttgatttgagctgttttatctgctcatcaagctccgccttggtcttttcaagctttttatactgatccaaaagctcgttaagctcgtcattatcgtgctttgcaactctcgtcacaagctctatcctcataagaatatcataaaaatcagatgaatttatcagcacgttcgtgtacgaatctgctccgcctgcaacatacattgcacgaatacgctccataaaatcgtccttgccctcgtttattgcagtttcctgcaagtcaaggctgtgctgagtgtcaagctgtttgccgtcaagctctgccatttgatcttcaagctcagaggaatatttctctgaatttgctatctttttctgtatggatttatattttttctttatagcctcaaggttgtcctgctcgtcggcaagctttttgtcagcgtcagctatctgcttatcaagctcctgctgttgcttttttagctcttcaagctgactgctgtatgtatcgttatccgccaaagcgatatcacttacgcttccgtcagaaaaaccaaaggcggcaaaagctatgcacagagccatacagcctgcggctattcttttcatggggtaaatttttttcataatatcagttctccaaaatataagcgtattatatatttctcacgctgtaacgtttatgtagtcccttttattataacgcaaaaccccgttcttgtcaagaaaccaaccgctaaaagccgtattttcggcattttaagacaattcgccgcacatattttgtgcgttattgcacctattctcctccgaacatctcacccaaggtctttcctataagctcgcctgtatactgtgcctgagcgatagaattgccgtggcttcccacctctataagaagcgagccggtggtcaagtcctgattatagtggcgatagtcaaacagaataggacgtgtaagcccctgccaatcgctctccaaagccgactgcaaggcacaggcaaagtgaaaattcttcatatagtcaggcatacccatagtgccgtcatcacaccctgatattatcataagctgagccgcttccctgccctctatctccgccacaggtgcaagccttgtgccgtcctcacgctctatgccgtcacggtgaacgtcaagacatacctttatagaggggtactcctccaatatctgctttaccgccattcggcttgaatcgtaagagccgtcatagctgggataatcatgcacaagtgtatcgtggatatacgcaacgcctgctttgtcaagctgttcgcatatcttgtcccctaccgacagcatattcatttcagggtcggtggtcttacaggaaaaggagctgtcatagtggtctttgtctgtgggctcaaagctttccgtggcgtgggtgtgataaataagtatctgcggctcagaggaatttccgtctatttgaaaatcatatggctttgagctttcctcataaagctcatcatttgaaaggtcagtgcagttcctcacctgaccgccgccgtcaaggtcgaaatactgctcgccgtcatatctgccgtaggtgtatttttctataacaccgtcatttccctccatgcttgcaggatatggtatcttgtccgtcacgtcctgagcaggcaaaggacttggcacttctgcgcttacagagggcgtttgcttctcctgtggcgccatatccatatcccatatactgtgctttgacaccactgccgcttcaagtttacttggatatgcggtctgcacagctgctttgctatcatcatcagcggaaaaataaggcttgtattctcccatagccacccctgccgccacagccgccaccctgccaaacctgcttgcagatcttgcataaagccatatccccgtgggcataacgaacgccacaattataactgcaacacaacgcaggcagactttctttatatccaatgctgtcactcccatatacatcttagtattataatgtatatgcaggacgagccgtcatattacctgcccagcttcaccttaacaggcttgcccactgtcatagagtcatgggtcacgttgcagtcatagcatagtatcttcacgccctttcgggaagctttctccaaagcctctccaaactcagggtgagtgtcataatttggagtgaaatatttcacatcgctcatctgaacgagtatcattatataagactcatacccctcatcaaggcagtgagaaagctcatctatatgcttcaccccacggagggtaggagcgtcaggaaaaagcacaacgccgtctttctccagcgtacagccctttacctccatgaagatcttcctatcctgcgactctaagtaaaaatcaaagcgtgaattgccgtatttcttttcgggatagaccgagaagccctcgccaaaaggcattttttctctcagccactcccctaccgccttattcggggcttggctgtccatgtttatgagcctgtcacctttttccactgcaacaaggtcaaaagcggtctttctcgattcgctgtctgaatgttcaagccaaacagtacacccctcgatcaaaagctctttgcatctgcccgtatttttcacatggcagacctcggctttgccgtctatctcaacgttggcgataaaccggttcggtcttgacagaaatttgcccttatgtatattatcgtatctcataattcgctccttttattcttactattcacattataccacaaatatgtttgattataaatacctaaatcaagcattcttagctttgttgatttgtggttcgatacgaaaagggaaaaatatttcacaaaatctattgacgttatttgtgaaatatgttatagttttgagtataggttatataacaataataatttattaaaattttagaaagaggtatttataatgaaaaaaataactgcacttctcgtttcacttataatgtcatgcgcagtaatggcaggctgttctgacagcagttcttcaagctcatcaaaagcagacagcacatcaaaggcagaaacaagcacagccgctgacgagtcaactgcttcagaagcaggcacagccacagatctcgaggatactctcacagcgcagtatacaaagaagattcagggcgagagccttgctatcgacatgacagtggcaagcgaatatgacaattcatcagctgttgttgagatagcaggcggcaatatgcacatgaaaatgaactttatgggcgtggatatggatatctatagtatcgacggagttatgtacacacttgacagcgagtcaaaaacgtattacactgttgatatggaagaatctatcgacgacttcaagagcgaaatgggctacggcattaacgacagctacaagttcataagctctgaaacaactgacgacggtcttatctgcgaaacttttgaaagcacagaagatcctgatatggagcttgaatcaggcgtaactctcgacacaagcgattctgacgattattctttcacaacaacattcaagtattacttcaatgctgacacaaaggatattgttaagatagaaactatctctgacggctcaacgactactgttacagtaaactcattcacaactgaaaacgttgaggtcaagctccctgacgattttgacagttggacagagcagtctttcgatatgagcactgacgatatcccttatgacgctgaactcgatgttgagtcaggcgctgagtcagccgagtaatccttgtcatttttcggaggcaaaatattatgaacaagaaaatggtaactattattgcagctttggcaatgtgtacagcaatggcaggctgcactgggagctatactgcaagctcttcaaaggctgaaacaactactacaacaacggctgccgcagaatctaccgctcctgctgaaagcacagaagacgaaagcacagctgacgaaagcacagctgacagcacttccacaaacgcaggcacgacagattatgacgttgacggcgatttcagggcttttgaacagctgaaagacaagtatgagggcaactatcttgcgaaccttacaggtcagatgtcaaacaacggcacaaagtatactatctgcataaaggacggcaaggcttatcaggcactcacagttcagggcatgaagtcatacacagtttgccctggcgacggaaagctttacaacgtttcagaaggcacgactacctacagcattgaggacgacgacggaaatcagtggaagtcagccgacattcttttcggcgcgaccctcgattttgaccaagcatatattgacacaacaacaaacgttgttcaagagtattataacctcgacagcagtgtttcaggcggtgagggtcagatagtttacggctttgacggcgctacatatgaccttaagcaggtagttctgctcccagagggtgctgacgaatcaagtgcagtttacttcactgtagattccataggcgaagcagacgacagcctgcttgctgttcctgatctttctgcttatacaaaagaataattttatctgatctttttccaacatcgggcggacagaccactgcggtctgcccgctttttttgcatttccagcaaagcgttgtgcaatatgacggaaaagaagttcaaatatttttgaaatttgtgagaaaaatagtcttaaaccccttgacaaaatcgtcaaaagggtataaactatacttagcactcgagaagaaagagtgctaacacttaaatacaataagtgctaacaagaagaacgggtggtgagcaaatggacgaccgcaagctgaaaatactttcagcggtagtcaatgaatatatcgtaacaggcgagcctgtaggctcaaaggcgataatggctcacgtcaaagcgtcctcagcgaccataagaaatgaaatggcagagcttgagaagcaaggttatctcgaacagccacacacctccgcaggcagaataccaacatataagggctacaggctttatgttgaccagctcatggagcaaaaccagctgacagcaaatgaaaagaaaatgctggattcaatgataccgcaggaatatgtcacagaggaagaccttgtgaacaaggcttcaatggcattggcggatcttacgaaatgtgcggcggtggtcgcaaacgcaacgccaaagttctcgcttatctcaaaggtagaggtaatacctacaggaaagagaatgtacgttattttgatgataacgtccaacggctctattaagaataaggtttgccgattggagttcgacctcagccaggatcagcttgagttttttgataacttcgtaaaggaaaatctcaacggcgtgcctatcgacagtctttcggacgcttatcttgaaaagctcacagaagcaatgggaacgtacatgatgaccctttcaccgcttgtttccgagataatgaagatgacaaaggaaatgagcagcgtgtctatcaaaggtcagagtaatcttctcacctgcaaggacttcaaccaaaatgagataataagctttctcgataatcagaaggagcttaaaggatttattgacgatacgttctcagggcttcacgttatgttctcccctgagcgtgacgggtttgttatccacaactcctctattataacagctccgttctcaaaggacggcaaaacagcaggtgcgctggggcttataggacctatgaggctcgactatgcgaagtttatcccatatctcgagtatttcacaggaaagatatcggaaatgatatccgaaaagccacaagagcaaaacaaagaaaatgacgaaaacgaataaaaagaaaggcaggcggcgtaaattgagtaaggaaactgaaaaggacaccgagcttgaaaaagaggaaaacacctctgctgaaagcgaagaagtgaaagaggcggcggataccgcagaaaatgccactgaggatacagagaaaaaggcggaggagagcgaaacagaaaagctgaaaaaagagcttgccgaagcaaatgacaagtatctcagacttatggctgaatatgataacttcagaaaaagaagcgcgaaggaaagactggagcttacagacacagcaaagggaaatgtgataaacggcttcctgccggtgtttgataactttgaaagagcgttaggcacagaaactcaggacgcagtttataaacagggtgttgaaatgatcttcaatcagttcagcgatgctctgaaaaaactcaacgttgaggtcatggagcttgcgggcaaggaatttgacccgaacgttgcaacggcggtcagcacagttgacgaccctgacctgggtgaaaatattgtggcgcaggtgcttcaaaacggctacaccataggcggcaaggtaataagacacgcaatggtaatagtagcaaacccataaacaaagacatcgggacttaaggtcttgatataaattaagtaaattttgaaaggacttgatcttatgagcaaaatcatcggtatagatttaggtacaacaaactcttgtgtagcagttatggagggcggcgaagccgttgttatccctaacagtgagggtgcaagaacaactccgtcagtagttggcgtttcaaagaacggcgacagacttatcggtcaggtagcaaaaagacaggctgttacaaactatgacaacactgtaatttctatcaagagacatatgggctctgactacaaggctcacatgggcggcaaggattacactccacaggaaatttcagctatgatactccagaagctgaaagctgacgctgaggcttatctgggcgaaaaggtaacagaggctgttatcacagttcctgcttacttcacagacgcacaaagacaggctactaaggacgcaggtcagatcgcaggtctgacagtaaagagaatcatcaacgagccaacagccgctgcactttcttacggtattgataaggaagaggatcagaaggtcatggtttacgaccttggcggcggtacattcgatgtatctatcatcgaaatgggcgacggtgttacagaagttcttgccacagcaggtaacaaccacctgggcggcgacgacttcgaccagagaattatcgattggatgatcgcagagttcaagaagactgagggtgttgacctctcaggcgataaaatggcaatgcagagactcaaggaggctgctgagaaggctaagatagagctttcttctactgcttcatcaactatctctctcccattcatcacagcagacgctacaggtccaaagcatcttgaaatgacacttacacaggctaagttcaacgaaatgacagcagaccttgttgaatcaacaatgggaccagttcgtcaggcactttcagactcaggtctgtcagctaacgacctccagaaagtccttatggtcggcggttcttcaagaataccagccgttcaggaagctgttaagaaattccttggtaaagagccattcaagggcatcaacccagatgagtgcgtagcacttggcgctgcatatcagggcggcgttctcgcaggcgatgttaaggacggtctgctcctcctcgatgtaactccactgtcacttggtcttgaaacaatgggcggtatctgcacaaagatcattgagagaaacacaactatacctacaaagaagtcacagatattctcaactgccgctgataaccagtcagctgttgatatcaacgttcttcagggtgagcgtgagtttgctaaagacaacaaacagctcggtatgttcagacttgacggaatcgctcctgctccaagaggcgttccacagatcgaggtaacattcgatatcgacgctaacggtatcgtacacgtttccgctaaggatcttggcacaggcaaggagcagaacatcacgatcacttcttcaacaaatatgtctaaggacgatatagataaggctgtcaaggaagctgaggcattcgcagcagaggacgctaagaagaaagaggacgttgatgctagaaacgctgctgatcagctttgcttccaggctgaaaagtcactgggcgagttcggcgacaaggtagacgctgctgacaagtcagcttgtcaggctaagatagacgctcttaaggaagccctcaagggtactgatatcgaggctatcaaggctaagcacaaggagcttgaggaaacattccagggcgttgcaactaaggtatatcagcaggctgcacaggcacagcaggcagcaggcggtgccgcaggctttgaccctaacaacatgggcggagcaaatggcggcagcaacggcggcgcttcaaacaacggcggcgacgacgttatagacgctgaatttactgacgcagaataaatcataacggctgcctctgctccgatttttcgagcaggggctattgccgtattaaaaggctgtgtgaaaagcgtgaaaggactatacttacaaaaaggaggcaagcccatgccccaagactttcacgatctgcagcttacagagcatgggcgtttatatggctgaaaaaagagattactatgaagtgcttggcgtttctaaaactgccacagacgatgaattaaaaaaggcattccgtaagcttgcaaagcagtatcaccctgaccttcaccctggcgacaaagagtgcgaggagaagttcaaggaagtaaatgaagcttacgaggtgctttcagataaagataaaagagcaagatatgaccagtttggtcacgcaggcgtagacccgaactacggcgcaggcggtggagcaggtgcaggaggcttcggcggatttggcgatatgggcgatattttcgattccattttcggtggatttggcggaggcttcggtggcggacgttctgctaaccctaacgcaccaagacgtggcgaggatataagagcgaacgttgttcttgacttcatggaagcctgcaagggcaagactgtgaaaattcgcataaacagagccgaaaaatgtcctgactgtcacggcacaggcgcagccgcaggttcttcgcctaagacctgtcctgactgccacggcactggtacagtaaggataacacagagaacgcctttcggaaacattgctcagaccacgacttgcagtcgctgtggcggtaagggtcagataatcgacaacccttgccatacctgcaacggtcagggcagagtaaagaaggtatctgaaaaggagataaacgttcctgctggcatcgacgatggtcagacgcttagagtaggcggtgaaggcaactgcggtataaacggaggtcctaacggcgacctgcacatcaacattacagttcgacctgaccctattttcgagcgtgacggctatgacgtgtggacagagataccgcttacttatgcacaggctactctcggtgacgagataacagttcctacagttgacggcaaggtaaaatacacagtgccagagggtacacagacaggcacagtgttccgcctgagaggcaagggcataaagaaagtaaacagaaacgaccacggcgaccactacgttcgtgtaacagttgaagttccacgcaatctgaccaaagagcagaaagaaaagctccgtgactacgaaaagtccctcggcgaaaagaactacgcaaagcgcaaaacattctttgacaagctcaaagacaaattcaaataacagaaaaaggagaacggcaaagctgttctccttttttggtttgcaataaaaaatgccgcaggaagacccacggcaattatcatcttatcaagccatacctgtgtgctttttgatagccgcaaaggactccgcactgataacgtgttccatacggcaagcgtcctctactgcaactttctcgtcaacaccaagctttatgagccactgtgaaagcaacgtatgacgctcatacattttctcggctatctccaagcccttgtctgtcaaacgaatataaccgtccttgtcaacagttatatagccgttctcacggagatttttcattgccacacttacgctcggctttgaaaactcaagttcgtttactatatctatgcttcttacctcgcctttgcccttgcgctgactgagaataagtatcgtttcaagataattttcagctgattctcttatctgcattataacgtccctccctagaacaagtttgtcatcaggtcattacgactattatatcacatttcaaactgcatttcaagtgcaagcacgctttttcagcgattttgataaactttacatcaatgaattgtgttgatatacaaaggcactgctcacaaaaagcagtgcctttaaagctgtctgttatttactgtataccgcactcctcatagtctttccacttttcggcatgctccttatcctcaaaatatttgtatacaaaaagcgcagttgacgcaacaacaagtatcatcgcacccattaaagtccagaacgacttttttcttgaatagtttgacataacaaaacttcctttctttcgcaatagcatacaaaaacttgcggctatcgctcatagctttgttataattatactacacaatgctctttctgtcaattattttcacaggattttcagatatatttttccgagtaaaagtgcagaaactcctcaaggcaaagcccgcctgcggcaatgatacgagcggcttcaacgcccacataacgataatgccacggttcaaaatcaatgccggtcatctgctctttaaggcgaggatagcggaggataaagccgaaatctgcggcatttgcacaaagccaccgtgattcaggcgtcttgtaaaaatcgtcgctcacatcattgtcaccctctctgccgagatccacagcaagcccggtgttgtgttcgcttgacccggggagagcgagagttctgcccaccttttccacagccttttcataactcagaccgccccacatttcgtgagatacttcacgctcccaaagcatctgctgatattcaaaagagcgataggcagaaataattttcagctttatgccgtcagcttccgcctttttgagcagaagcctgagcctgtttcctgcctgagattccataaacttgccgttcacctctgtcaactccacacgatcgtaaaatcccatatctatgggattgaatttatccacaagcataagataatccatatactgacctccttgtcctgatggggagaaatgttttaacttagtatatgcagatgtgtgtggagagtatacacactgaatgaggaatgaggagtgaggaatgaggaattagcatagctgaccaaagttgtgcacaagcaccaagcaaagcgactttgcggcacaacaaacttgcccgaatgatctgtaggggcgacctgaggtcgcccgttctcagaacttgtaaaaattcagcattgtaggggcctggctcaatttcggtttcaccgaaatgcgacagcccgatatttctcgcccgttgaattgttgaaaaatatcacacaatgtcaccccaaaataatttggcatcaaggatatggcaaccacggcatcgctcacctacacatttcaaaaagcggtgcaaaattacatcatatcacaaattgcagcgtaaaatgcccgtcacggcgagtgacctatatccagcacccgtccactctgacgacctgcccgtgaatgtaatctgctccctctccactgagaaaacgcacaacattcgccacatctctcggcttgcctatcctgcctgccggtatgtcatcaactatcacacgaacatcttcatccgtcagctcgccgttcattttcgtgtctatcattccgcaggatacgcagttcacccttataccgcttatggcaacttccctcgacaacgccttcgtaaatcctataagcccagcctttgccgccgagtatgcaacctcgcaggaagctcccttttcgccccatacggaggttatatttatcacatttccactgtgttcccttatcatctcaggaagcactgccctgctcatacgcattgcaccaagcagattcacgttcatcatctcgcatagcttctcgtcagtcatgtcagtaaaaagctctatatccgctgtgcctgcgttgtttacaagaagcgtaacaaagcccaaactgtccctgacttccgccacgcatttatctatactgtccttgtcgccaatgtcgcagtaaaaaacctctgcacataagccacgctctttaagctcagataccaaagcttccgccgccgccctgccattcttgtagcatacagccacctgccagccgtcctcagcaagcgccctgcatatctccgagcctatcccaccagtgccacctgttaccaatgctgtttttttcataaaaataccccccgcagatcatgatatactgtaattatatcacacctgcggaggtttttcaacggctacttttcgttctcgtctacccattttctcgcccagcctgcattctgctcctgacgattgtatactctgccgtttggcgcagtgtaattgtccgtcacaacatattcctgacctgccgagataacgtcatggggcttgtatacctttgtgccgtctgaagcctgcggaaaacggctcttgtcacgctttttcatggctatcactctcctttttatgttattatcctgcccgaagcttttgtgattatcagatgaaaaatctgcataacagttgaaaatatcacgataacgtggtataatcatcttatactatttttatcgggagtattaaaatggaaaaatacaacaaacaaaaagctatactcaccgcactgctgaaatgggttgaaacagagttcttcggaattttcgtattcctcttttttatcgcagttgcaaagcctttcggtgcattggcaaatataattttcggtcttacaggacttctcacagtggtctgccttatggctgactttggtctgaaacagggagaggaagccagaaataaggtcacattccacggtgaaaaggattgccctaactatggcttcacacttggtcttattgcaagcataccatgctacataacaatgatactgctgatgatatcaaaattcagcggttcgttcaatttcatgcctgcctataagcttctcgacgcctgcttctatcctcttatagattgggctgcccactctgccgacgtgaaagatatgtcaccatttgttttcatcatgaccgccatattcccactactctatccatttgccacatggataggcttcaaaatatcctacaagcagatagacgtaaaagagcgtgtggtctacaagcacaaataaaatcaagcctgccgtatcagtccgatacgacaggcttttatctttttatcgaaaaaattcagttctcccctacacattaaactatttcattactgaaaatctatctctatatcttttagcgtcacatagtttactacattgcagtttttatcgcttgcagtgtttgcgataagcgttatctttgccgtgcctttcacatagtcggcaccaatatccgtcttatagtcatacgtgtagctctctccggctttgagcaaagtgttcatggtgtttctgtcgccattttcgccatagctcgtggaattgcccttactgtcctctgtggtgatatactggtcagtcgtgaagtcaagcgccatgtccttgtcccagttgcttgtgtaggtaatatggcttatgaactcgcctccgcttacctcataggagtatttcgccgtgagcctgccgtcctttgttgtaaaggtattgtccccaacgtcctcaaaatagtcgatatatccaatatcaacttcgtcggccatatcaggatcgtccttggcgacagaagtcaccgctttctcactagggtcaacatcgtcagcgacctcagcgtttttctttacgtcagtgtattcgcagttctcattgagccagttttcaagcttttctgccttttcaccgcctatatcaaattttaatatatctcctgcaaaaagctgaacatacagatctccgttagcagtaaaataagccgtaccgttggcgtcaagtctttctacatagaagcttattgttattccgccctcaatgtaatattcatcatcatttgttaccgacaaattaatatcagggtcgctctcataagcatcgccctcatagaccgcattgtatgaaccattatcgtcctttaacaagtcaagcagctttgagatgtcagtattagtatactttctgagcctgcccgtttctgcatcattgtaagcatagtccacatgagccgttttttcaagacttacgtcatttattatgtcatcaagggtcatatcggtcttgcaatcaggtgagtatttccaatcatcataccacgacacagagccgtcatcaaagaccaccgccaaataaacgcttggtgacaagtcctttattgaataaatatccgcttttgttgtttcctttttgtttgtctcatagttttccgtttcaagagtcatggtggtgagcttgctgtcaagaaaagacttatcaacatgacccattgaaacatattccacatcgttatattcaaacgtctcatattttgcattcattgcatattcgtcccaaggaactctatatgacactgttgcttcctcgtctgccatctgctggtcagccgcagactttgcctttatatctttgtccgatctgcctgcaaacatcataacacccgtcgccgcagcgataacaccgcaggccgccacagccgcccactttgtccatatggtttttatctttatgccgctgccgctctgtctgcattcttcaatgtaatgctcgtcagcattttccaaagccttgaaaatatcctctcctgttgttttcataaaagaactccctccttttcaagcaaagcctttaacttatttctgcttctgaaaaggctcgccttaactgtgttcaggttcatagcatacttttttgatatctcttttataggcgttgcaaaccaatatcgctggagaaatatatttctgtctctctcctgcaactcgccaagaaattcgtttataagcccctcaagatgtctgccgtcgcaaagactctcggtggtgtcattgtcaggtatgcactcgtcaagctcctccaggaccgccgctatctcaccttttccacgctttgcggcctttgacgcacgatatctgtcaaatgcgatatttcttgttatccgcccgaaaaatgccgacagcattctgggtttctgtggtggaatggagttccatgccctgagccaagtttcgttcacgcactcctccgtgtcctccctgactccaagaatattgtagcccacagaataacagtatccgccgtattttatatccgattgtgaaatagcctgctgatctctgctttcataaagctcgattatcttgctgtcctccattttccgcccccctatacaatatacttcattgaaagtcctttcacctataatgacgagatgtccgccaaaaggttttatgaaaacgcaaaataattataacatatgataaaaaattatgcaacaaaaaacgacgtcccacatcactatggaaacgccgtttataggaagaatgattttatgacaactcgttaagaagatccatgtacaattcgttgtaatctgttctgttatccttcagaaaagcgatagccgcacgagggtggcggttgagcgcacctgtgagcatataaggcacgtcatagccccactgtgaaccctttgccctctcctcagcaacgtacttttcaacaaatttcagtgtaggagtaagcttgtagttagggtttctcaggaagctgagcatctgctccataaagcagtttcctgcacctctgcccattccgctcattgtagcgtccgcaaagcttgcgccgtgagaaatgctctcgatagtgtttgcaaaagcgagctgctgattgttgtgcatatgaacgcccacctttttgccactagcctcagccacctcgcaatactgcgcagtaagtcttctcacctgctcagggaaaagtgagccgtagctgtcaacaagatagataacgtcaacagggctttttgccacaaggtcaagagcctgtgcgatatcgtcctcacggcttgcagaaacagccatgatgttgatagtagtttcatagcccatgtcgtggcagtagtttatcatctccagcgcaccaggcatctgatgagtatatgttgcgatccttatcatgtcgataacgctctcactctttggcaggatatctttcttgaaatcacatctgccaacgtcagccataacagaaagtttcagagggctgtcattctcaccaacgatagctctgatatcctcctcatcacagaacttccacttaccgaacccattgacgtcaaaaagctccttagaagccttgtagccgaactccatgtattcaacgcctgattttatgttagttttatagagttcttttacaaactcgtctgaaaatccaaaattatttacaagtcctccgtcacggatagttgcgtccagaagctttatatcaggacgatatgacataaggtcacctttctgatttattgtctttgcctgatttgccattgtgattacttcctttccaaaagcaggtacttatcacgcctgtataaaatttatcactttaaaggttttatgcttttaagcttttatgtattaaagtatagcactatttttcttccctgtcaatagccccaaagccctttaaacacattttttacattttaataatatttccctccacaaagcctgaacttttgtacatttccaactatcaaaacgatgcagtattgtgaaaagtgctgaaaaatatccacgctccttgacaaatcagacttatagttgtatactctaagtgtactacaacagataatacagttagtacagcagaacaaatgaaacgaaacaacaaaatcgaaaggaggtattcaaggtgataacgcttgatcttacaggaagagcacctatctacgaacagatatgcagccagttctcaagccttatatcaaaaggcgtgctgaaagaaaacgataagctgccaagctcaagaatgttggcaaaggaactgggtctgaatccaaacacagtcgccaaagcctacagcagacttgagcatgacgatataatctattctgtagcaggaaaaggctgctttgtggcaaagcagaaaggctctatagagaaaaaattgctggaagaatttaagctccatgccgccgccgcaatgcaggcaggcataagccttggatcgcttacctccgtccttgaagaactggcggaggaacagaaagaaaggagtgacaaagaatgatagaaataaaagacctgtcacttacattcaaaaacgcagacgaagatcacgaggcactgaaagccatcaccctggatatccccgagggctgcatatacggctttgtaggctcgaacggtgcaggtaaatccaccctactgcgtgttataagcgggatctaccgccccgacagcggtagcgtcaccattgacgaaacagaggtctatgaccggccgcaggctaaggagaacatcttctttgtgagcgacgaaacggtgcagttttcaagactgacagtgaatgacctgaaaagtttttaccaaagcagctacccgacctttgacgacaaggtgttcgatgaccttatttcaaagcttgacctgccacggaagaaaccgctgtcccagttttcaaagggcatgaaaaggcaggctatcgttgcggctgcacttgccagccgaacaaagtatatcctccttgacgaagcctttgacggccttgaccctgccatgcgcagacttatccgcaccatgatagttgacgatattttcgaccgtggtgcgacccttatcgtgtcctcccacaacgttaccgaaataggcgagctttgcgacaaggcaatgctcctacacaaaggcgaagtcattttcgccaaggatatcgacgacgtaagagagggctttgaaaaggtgcagatagccctccctgacggtgagcttgaccgcactgttatagaaaatgcaggcgtagaagtcctgagcttcaagaccttgggcagagtttccacagtgataacaaagggcgacaaggcggatatcaccgccaagctttccgccctctcccctgccgttttagagcttgtccccctcaccctggaggagatcttcatatacgaaatggaggtgcatggatatgcaaacagcgaagaataggataatagagacctcacgccgtgacttcaaggtgaacaaactgcttttcgtcatcacaaaccttgtgctgttcatgaactttatcatgcagatgtccatacgaaagttcatcacccactacatcgaaagcgaaacgaactattatgagggctatgccattgcatatgtatgtattgcggcgatagcgctgtgcgcagtgttcacagttttcacccttttccgtgagcttttcagcaaaccccacgcagaccttgcgtattctctcccagtcggtgcaaaagaacgcttcttctcaaagcttctcactctgctgaagctgcatatcctgcctgtgatattctggaacatcattcagtttatcgccatactcctcacaacggatatcacactgaacatgttggcaagatattccgccgtatttatgttcttacagctttccacaagcctttttgtgatacttgcggtgcttttgtgcatgatatgctgcggcaggcttgcagaaatgctctacacagcggtgataataacagcctgcgaggttgctctccctgcttgcatacactactccaccattaacccatacaccgtacagtatctatatgacctggaaaacttctttaactactgccctgtatggagcgctctcccagcaaagcttatggacctcggctactccacaaatctcctgcttcttcttattggaagcaccattttctcagcactgctcatcacactgctgtactttctctacaaaaaacgtgacggcaaagacacaggcaagccattcgtattcagcgcctaccgtgagattatccttatcctagccgtagtcactgtcacgacctacgtcctctccgacacaagcaatctgatacttctcccatcgcttttcttgagctatctccttgtgcggatactctcctcaaacagaaagctcacaatagtccgctttgtaaaatgggtaggcattttcgcagtgtatatgattgtcatattcggcgtgaacattctcgcatacttctgtgacggcttcacaggcaagataaatggatcaagactcagcgacgctaaccgtgtgtgtgtaatgaattcaacaagcgacggcgtaacgttccactatctttccgacacactctcaaaagacgaagccatgcagataatatatatatacaataaagcacttgatacccgcaaaaagagttttgctgactatatcgaccacttcaagccgcatgagatttcgccaaattctgtaggtgtagcaatagatgtttatacctcaaaagatgaccacactaaccttgactttatcgacgtctctttcgaagtaacaaatgccgaagtggacaacgtcacagagaagcttaaatccctaagctttgttgaacccgaacagacgtcatatgcctactagaattattatatcggccacgcaaaccgcttaaatacgccacttgtgtaggttcaaacagcgttcgcccgtcgaagcaacaaaccaactcccctaactatgtgtaaaagaacaaacaataaccccctcagagccaagctccgagggggttttatctttcggttctctattaatccatgaccgcattagcaagcataagcttgatacggttctcctgattgacctttgtcgcacccgggtcatagtcgatagcgactatatttgcgtccggataagcctgcttgatagttcttgacatacccttcgcaacaatatggttaggcagacagccgaatggctgagtgcagattatgttctttgtgcctgtttctgcaagagccgccatttcagcagtgatgagccagccctcgcccatttttacgccctgactaatatacttatcagcacactttctaaggtgttcaaaatcatgaggcggctggaaaatgccctgctcgttgatgacctttatctgctgcttctggaacttgtaaagcacatcataaccaatgccatacataagagtgcggctggttttcttgtcgtaaagcttctcgtcattgatagcgtccgacgcacagtaaagcacgaagtccaacagtccaggcacgttaggctcacagccctcagacagcaggaagtcgttcaggtgattgttcgcaagaggtgaatacttaacgtatatctctcctacgataccgaccttaggcttcttctcctttgtccttggaagcgccgcaaagtctttgagcatagcattgtaaatgctctttgtgtgcatatatctgctcggggtagcaaacagctttccaagcctgtgctgccaccttgccaaaagctcgtccgtagaatttttctctatctcgtaaggcttgcactgattgtacaaaagcatgagcatatcaccgtaaagcacagcataaataagcttcattgcaatggcaggggtgatatctatggaagcgtccttttcaagtccgctgaaattcagcgacataacaggtacttcagggaactgcgttgacagcgcctttcttataaggtggatatagtttgaagcacgacagccgccgcccgtctgtgacataagcagagccgtgtgttcaaggtcatacttgccgcttttgagagcgtccataaactgtccgataacaagaagcgcaggatagcaagcgtcattatgtgtgtttttaagtccctcgtctataacgtttcgtgagcagttttgcaaaagctccatgttatagccgtattttttgtatattgccatgataagcttgaagtgtataggaagcatatcaggtataagtatagtgtattcctcacgtcttgacttgtcaaaataagacctttttactctgtccgagcctgcgtgttttatctctttttcagccattacattgcctccttgtccattttcttctcagcatttgcgctggcttctttttcctccagtgccgccgccaaagacctgagtcttatcttagccgcaccgagattcgttatctcgtctatctttagctgagtgtaaagcttgcccttttcttcaagtatagctctcacctcgtctgttgtaacagcgtcgataccacagccgaaggatacaagctgaacgagctgcatatcatcattctcgcatacatactctgccgctctgtaaagccttgaatgataagtccactgattgagtacgtcaagtgcgggtgtatccactttcatcgccacgctgtcctcagtgataacagcaaagccaagagaagcgataagcttgtgtatgccgtggtttatctcagggtcgatgtggtaaggtctgcctgccagaacgattattttctgaccctttgctcttgcctcagcgattatctcctgcgccttagcctcgatatccctatggtatctcacctgctcagaataagccttgttaagcactccaagcacctgctttgcagtgatgttatactttgaaagcgcccttgccattgcctttgcaacgtgctttttaatgtttatgtcaagataaggcatgatgaaattatcatcattcagcttgtcattgttagcctttagaagctcaggataataagcaacaacaggacagttatagtgattgtccgactgaccctcgtcagcattgtagctcatgcaaggatagaatataaagtccacacccttgtcaaggaggctctctatatgaccgtgacaaagctttgcaggataacataccgtatcagacggaatagtttgctgacccttgtaatatgtatctctcgttgactcctcagacagaaccacttcaaatccaaggcttgtgagcagtgttgagaaaaacggcataaggtcataataagacagcgcaagcggcagacctacctttgcaataggctttgcaggcttgttgtcagcataagagagtatcttgttatacttatactctatcatgttttccgttctgtcggttatctttatgcctgcacccttttcacagcggtttcccgaagtaaatcttctgccgtcattaaatcttattatagtaaggttacagtgcgcaccacagccaccgcactgaacggctcttgaattgtaagcaaattcttcaagctgagcctttgtaagaacgcctgacttgccgtccctgccctgagatttttcttttgcgaaaagcgcacagccgaacgcacccataagtcccgcaatggcaggtcttataacgtttctgccaagctccatttcaaatgacctgagcacagcgtcgttaaggaacgttccgccctgaacgactatattcttgccaagctcgtcaatagacttggctcttattaccttgtaaactgcgttcttgatgatagacgaagaaagtcctgcagagatatcctcaacggaagctccgtccttttgcgcctgctttacagatgagttcatgaacactgtacatcttgagccaagctccacaggtgcttttgcaaacagaccgagccttgcaaactctgcaatgtcatatcccattgcacctgcaaaagtctgaataaacgagccacagcctgatgaacaagcctcgttgagcataatgctgtcgatagcgttgttttttatcttgaagcactttatatcctgtccgccgatgtcgatgataaaatcaacgtcagggcagaaataagccgccgccttatagtgcgcaacagtttcaactataccatagtcaacgcccagacctgcctttataagatcctcaccgtagcctgttaccgcagaagcttttatgttaagctcaggagtagcaaggctgtagatctcctcaagctttgaagcgattatatccagcggctgacccttgtttgagcagtagtgctgataaagaagctttccgtcaggtgtgataagcacaagctttgtggttgtcgagcctgcgtctatgccaagataagcgtcgcccctgtaagttctgatgtcttcatatttaaggtcagacttcttgtgtctttccacgaaagcattatattcctcacggcttgcaaacagtggcttgcctaccacgatattgtcagtagcctttgcgttcactatcttgtcaagagcttcgtctatagtcatttcctcagcaagagtgtcagcatgaagtgccgcaccgaaagccatatagcaggaagaattttcaggaagtatagcgtgttcctcgtcaaggttcaaagtagttctgaatgcctttctcagtgcactgagatatgtaagcggaccgccaaggaaaagcacctgaccgccgatctttctgccctgtgccagacccgaaactgtctggtcaacaacagcctgaaagatagaagcggcaatatcctcttttctcgcgccctgattaagaagcggctgaatatcagactttgcgaaaacaccacatcttgaagcgataggataagtcttttcagccttaagagcaaggtcgttcatctcgtcaggggtaacgcccaaaagtcctgccatctggtcgataaaagcacctgtgccacctgcgcaagagccgttcatacgctgttcaacgccccctgtgaggaagattatcttagcgtcctcaccgccaagctcaaccacaacgtcagcctttggatacttcttgtttacagcgataaaagcagaaaagacctcctgcacgaaagagatcccgcttgcctcagcgatgccaagacctgccgagcctgttatggctatcctgaacttgtcctcaggataaagctctctgatagcacgcagctgctcagcgaccgtttccctgacctttgaaaagtgtctttcatatttgttataaataaactcgccctcgtcaagaattaccgtcttgaccgtggtcgaacctacgtctatgcctaaatcataaatcttgcccatagtaaaaacctcactgattctcgtttgtacactcttagctattatatcacactttttcgcaaattacaagctttttatattaacaaatatgtatctgaaaactacctataaagctaaaacgggcgaacactgttcgcccctacaatgcaactattacaatgtatggcaaaatgcgttcgcccgtaaatattcattttttatctatgcttattcctgctctaaaaggcaatcagtaagattaaggtcatagagattgttgtaggtaggctgctgaacaggctcacctgcaagtctgtagaactgctctgatccgtacttcttgatgaagtttgtggtgtggcaatttattttcagctcctcgataaacttcttcataacattgctgtcagcgccataagcattctcaaggaagtcaaaagcgtatttcagaccattcatagactgctgtgtaacgttgtttgcgccatggagcagattgttgaaggagttctgcaaaataacagtacagcggtttttgttatctcttccctcgttggtacacttatcaagataagcttccagattgtggagtatccagtgctggatcttcttgttagatggcgagatgtttcttgctcttaccgccttgtcaaggctcttgttgcagtccatgatgtgttcactgattatctgacggcatgaaagaccattgtttatcttcacaaggatatcttccattcttgggtggataagtcttatcatcttctccatttggatacagcttctcattgtgtatgtgatgccgtccataagcagattcataagagccacagcttcctcagtgcctgccgctcttgcgtcagcaatgttctgagcagttatgccgccctcgaggatagcgtcaacgtcatatttctcacgatagtagttgaatctgtcataatattccgcaaagccctttgagaactctgggttctgtacatactgagcagccagagcgtggtcaacaaggataccgctctcctcataaagctgcatcatttcagaaagatcctcccagccacgggcagtaacaaagcggtagttgttcttatcgcttgcgtctaccatataatagtggtcagggtaaagctcaagatatgatatgatagctgggtgaacgcctgcatagtaagcatattctttccaaacgtcgaaatcaggctgacactcgaccctcttaacacggtcgagagtaacgatatcgaactcagaaacagacttgttgaactcaggcgggttacctgctgtaacaactacccaacctgccggaacctgatgaagtccgaaaaccttatactgcaagaactggagcattgcaggagcaagggactcggaaacgcagttgatctcatcgaggaagagaataccctctttaatgccagtagcttcgatagtgtcataaagagtagccacgatctcactcatcgtgtactcggatatctgcacgtcagcaccagtgtagtttctatgtacaataacaggcagaccgagggcagactctcttgtgtggtgggacatggagtaggtaacaaggttcacgccagtttcctgagctatctgctccatgatagcggtcttaccgataccaggtgcgccaagcaggaacacaggtctctgatgttctatgctaattcggtaatcgccaaattcgtctttaatgagataggcttgtattgcattaagtatctgttgttttgcttctttaatattcataatcatttctcctcagtgcagtctgaagctgtgaacaaaaagcactgcacaattaaataatcttaccattttattatagactatctccaaattaaagtcaatagtcatcacaagttttgtcagcttacacaaacaattgaaaatattttagttattctgtatcaaagtcataaaatttaactgttaaaatattcatatcagaacagaattttcaacagacttttaagttttttcaaacgttttcgtccataccccagccgacctcacaacctcactgctcacttggttttgacatctcccaaacaatgtgctataataataaggtataaaatttttctctcggaggtctgatctatgctttatgaaataaaaaatgataaactctctatctcagccgacactttcggtgctgagcttcactctatcaaactggacggcaaagaatatctctggcaatgcggtgacgcttggaaacgctacgctcctatcctcttcccgttcatatgctcccctaaagaccgcacctacaaggctggcggtcaggaatatcacatggctgcaaaccacggcttcgcccgtgacagcgaatttacatacgctggaagcaccaaaaattcactgagctttctcctcaaagacaatgacgtgacacttgctcaatacccataccactttgagcttgaagtcacctactccataaaaggttcaaaagtcaccgtcacaaacacagtaaaaaacactgatgaaaaggctatgtacttttatctcggcggtcaccctgcttttatctgcgatatccaaggtggcaaatgcacagttgagtacgagaaaaacgagcatatcgttcagcctatcccaaacggcgagaggactattcttgacggtgaaaagactatcactctcacaagagagcttttcgactatgacgttatcatgaaagaccaccctgcttcaaaggctgtcaccctgaaaaagtctgacggcggtttcgtaaagctgtcattcccacactctgactgcattgcagtatggacttccaccggtgaccctgacgctcagtttatctgccttgagccttggactagcgtgcctgtttacgaggacgacgcttttgaggatatcgaaaacaagcctcacgctatcaagcttgcacctgaagctgtttactcctacagctacaccgtggaggtgggctgatgagagcggtaatacagagggtcacaagtgcaaaagttgaggtcgagggcaaggtcacaggcgagattgaaaaaggttttctcatacttttcggagtaggtcaggaagacactgaggctgactgtgacaagcttgccgacaaaatatcaaagcttcgcattttcgctgacgagaacgacaagacaaatctttccataaacgatgttggcggagatattctttgcgtttcacagtttaccctttatgcagattgtcaccacggcaaccgcccgtcatttatctatgcaggcaagcctgatgaagccaacagactttatgaatacttctgcaaggtctgcggtgagaaaattacaggcaaggtagaaaagggcgttttcggtgcagacatgaaagtttcactgctcaatgacggtccttttactatcattcttgaatgtagaaacggagagataatcccatgaacatacagatattcggcaagtcaaaatcctttgacacaaaaaaggccgagcgttatttcaaagagcgtggaataaagttccaatctgttgacctgcctacaaaggggcttagcaagggcgagcttaactcagtgcttgcggctgttggggatattgacaagcttatcgacccaaaggcaaagggcgagcaggcaatgctcataaaatatcttggaagcaccgaggagaaaatagaaaagcttcttgactatcccgagctttttgccgcacctatcgtaagaaacggcaagaaagccacagtaggcttctgccccgaggtgtggaaaagctgggaatagccctagatgaaaatactgtgaaaattgccgatattcgttgaaagaagcttgaatgtgtggtataataccatatggaaaagtattttcagaaagagatgttttaaatggtaattgattttcacgttcatgcctttaatccaaaggtagcggaaaaggctgttgaaaagcttcaggcttgcagtggaataactcctttcacaagaggcactgcagaggaaaccatacagcgttttgacgaatggggcattgacaagggcgtgctgttatcagtggcaacaaaacctactcagcagagagttataaacgattggtgtgcccaacaggacggcggaagatttataagcttcggtggaatacaccctgacgctgaggactatgagcaggagatagcccacataaaggagcttggacttcacggcataaagcttcaccctgactatcagggctttatgatagatgatgagcgcatggacaagatatatgacgccattgaaagagccgacctgcctgttatattccattctggctatgactgcgtttcccctgaccttatccactccacacctgagagggcgctgaacatgataaaaaagcaccctaagctcaaggtcattctggcacatcttggtgcaaacatgatgtgggagcaggtgtgtgacgttttggcaggagttgacggtgaagtttatttcgacaccgctttcacaagtatgtgtcctgacgagcttatgcaggctatcgttgaaaagcatggggctgacaggatactttttgcaagcgactgcccttgggacagttcctaccttataaaagaaaagatactgcgcttgaacatttccgaggataacaaagataaaattctcggtggcaacgcagaaagacttcttggcttaaaataaaattgtgtaaattctgaaaagaggatataaaaaaatgagatcaaaactgcttgcggctgtgctggcttgttctgcggttttcgggcttgcgtcatgtggggcaatgcttccagaaagctcctccgaaacggagaccaccacgggtactgccgcccagagagttatagagaccacaaagaccgccacaatgggcgacgattatgatgaggacgatgaggattacgagggctacaccaccaccacttctgtgacggcaggcacacttgaaaacccagacgtaagcattgacgaaggctacgaccctgacataatcgcaacggcaacaaagaggacgaccaccaccacaaccacaacatctgccgaaacaaaggcgactaaaaagaccaccaccacaaagttcaaaaaggacacacttttccctttgggtgatgatgtgaaataccctgattctatcccatttcttgtaaagtcagacacctcttatcttaatctcagatacggtccgtcaaagaaatatgacgtgatagaaaagatacctgacggcaagaccataaacggctatggcgagagaacagacggtgacggaaacatatgggtatatgtaaaatataacaataaaagcggctgggtaatgaaagagcttctcagcggcactgaataaacggaggacaaataatggacagcttcaaggaacagatagttcgcaagattcccacaaagaacgataagatacagaaaattttcatcatgatagcaagcgtggcacttgccgcactgtgctttatcttccctttcggcacgcagttttctgtaataggcatttttcttgccgccgccgcactttatggcggttattatcttacaacaaaactcgatgtggagtatgaatacattttcacaaacggagaaatagacgttgacaagataacggctcagcgttcaagaaaacgccttatcacattccgttgcggcagtgcgacagatttcggcattgctgacgagaatttctctgtacctgagggcgcaacacaggtccttgcctgcgcttgtgacgatagccttacagactactacataacattcaaccacaaaaatctcggacttacaactgttatattcacaccagatgatgatatgctggcacttataaagcctgcacttccgagaacactgaggaaataaaaatgaaaatatttgtcggaactgatcttattgagatcgaacgcataaaaaaaagctgtcagagccgacgtttctgtgaaagggtttactccgaaaaggagctgacccttttttcacagaagaaaaacccatacgaatccatggcggcgaattgggcggctaaggaaagcttcgcaaaggctttaggcacaggggtcgagggcttcgccttgaacgaggtgtcctgcttgcgtgacgagcttggctgtccttatctggagcttacggggaatgcgcttttggcggctgaaaatagagggctgacctttgcggtgtcactttcccacatcaaggatatcgcttcggcagtggtaatagcttatgaaaaggaggataaaaatggataggatattaacagtggagcaaatgacattttgcgagcacgaggctgaaaaatatggcgtgagccttgctcagctcatggacaatgcggcggcacagcttgcggaggtcattgcgagcaactcgtctgcgtcctcaaagatagtgcttcttattggcaagggaaacaatggcggtgacggacttgtggcggcaaatttacttgcggaacaaggtctcaagcctgcggtggtcctatgctgtggcgagcctgacactgacctctcctcggcagcgtatgctaggcttgataagagcgtagaggtgctgaaagctgaaaatgcgctggattttatcgagggtgcagatgtgcttgtggactgcattttcggaacgggttttcatggcagtttgcgtgaaaatatcctgccagcgttcagagcttgtgaaaaatgtgaaggcatgaagatagcctgcgacatgccgtcgggagtcaatgcacggaacggtcaggctgacaagctgtcgttcaaggctgacgtgacagtgacctttcatcgtggcaagctgggtctttatttacagcctgcggtggacttttgcggtgaaattctggtaaaagatatcggcattgacgagcgttgcgagaataccctataccctgtcgtaacgccttttgacgtggtaaaagcaagggcttcactgccttttagacctgctgacggacacaagggcacattcggcaaggtggtgagcgtggcagggtcagagagctatataggtgcggcggggctttcagcaatggcggcaatgcgaacaggcgtggggctttttgagctttgcactgcaaaaagcgtagtcaactccctgtcggctggtatgtatgaatgtacatactcggcaatgaaaaccgacaaggacggctttatggtggctgaaaatgcggagacgatactgaaaaagtgcgaaaaggcaagctctttgctgataggctgtgggcttggtcacacggctgaaacggaaaagctggtggcggagcttatagaaaaagcggagatacccatagttttggacgctgacggaataaattcactttgtccgaatatagatgtactgttgaagaagaaaagtacagttatcctcacccctcaccctgcggagcttgcaaggctttgtggcgtgacggtgggcgaggtcatgtcggacagacttgggtttgcatataggctgtcagaaaaatatggtgtgacagtgcttgcgaagtcggctgacacctttgctgtggacggtgggaaagtttatctttgcaccgaaggcacaactgcgcttgcaaagggtggctcaggggatatgcttgcaggcattgtttcctcctatgtggctcaggggtgcgatgctcttgatgcggcggcacttgggtcgttcacacttggctcgacggctctacttgcaggatacaaaagatctgagcgtggaatcattgcaagagatgttattgacgctttgccacgatttttgtatgaccttgaaaacgccgactaggctgtactaaaaacaaagaccttcttcttatgaagagggtctttttttatggagggcaaaatgaaaagaacaaaggcattttttctcacgattttggcggtaatgggcttatgctcatgcggtgaaagctccgaagtcaatcccgtaaagctggcagaggattacaagaccccggctgagtttaccattgacggcacggaatacgtcgcaagcttcacccgtgagggcgcagatatgtgggagtgtgagataactgcgccagaaactgtcagcggtatggtgataacctgctcaggagaaagcgcacgaattgaatacaagggtttgacctacgaaactgaccgagggaacatacccgaaagctccgctgtcacaatgactgccgctgtgcttgacaagcttatttcgcagaaaggcgtgacgtatctcaaaaatgacaagggagacatcaccgccacgggacagataaaagggcaggatttttcggctaaaatcaaaggcggaaaggtaaaaagcttgaagatatcaggggaggtaagcgtaaaattcacataaaaaaaggtgcagagaaaatctgcacctttcttatgtatggaaatgaattatttaccaaagtttgcgcaagcgataacgttaccgtcctcgtcctcaaatctgaggtcagcaatgtagaaatcagcctggtttggaatgccccatctcataagtgaaacatactgtggttcagttgagtttacaaatgtagcgccgtccttgataccaggtctcattgtaagctcataggaaccccactcagaagtccactcagcctcgccgaagtcatagaggtcgttccaactgttttcaccttcacctgttgtaggctgtgtaacgaatgcacccatgaagttaccaggaacgagtgattttgtgccgtcgtcacctgtgaactcgccaactgcctttgtaactacatcagccttgatagtgaagatcttctcaagatcagcctcgtgaccctcaaagaacttctccatgtggaacttgatcttagggatcttgtagttgccctgatcgtcctgatcaagaacctcgaccttgagcattggaacgcctgcaagctcctcaacagagaggtttacatgagactcatcgttctcgtaatccttctcagcgaaaggctcaacgatagaagcaacgtccatatccttcttgaaatatacagaagcctcctcatagttcttcagagtagctggcatttcagaaatatcctttgcagcctcgccctcagactctgtgccggaagcggctgttgaatcagctgttgactcaggagcggctgttgttgtagtagcctctgttgttgtagcagctgtagttgttgttgtagtagtttttgcctcagcctttgatgaagaatcatcagagctgccgcaagaagcgaacatagcacttgtaagtgtaagtgcaagagcgcaagctaaaaactttttcattttaataacctccgtttaattgtcatgctatacacatagcctgacctatatttacctttgtattataacacaactgtcacatattttcaatatactatttgcacaatttaagcacatgatttcatatgttttgcacagaaatcgtttacaaattagtgcaggttacacaaacgaacaaaaaaaacagagcttcccgaatgacagaaagctctgtataaattcacttattcaagtgtgttatctgtgagagattactttctcttagaaataacgatagctgcaccagcaagtgctacgccagcgagtgcaagaccagctgttgcgcctgtagctgctacgttgtcagaagctgctgctgaagaagtagctgttgttgttgtgccagactttgaagatgtagctgctgttgaagtagctgctgcagaagacttgtcgtccttcttagaatcgtccttcttagaatctgtgcctgaaggtgttgaatcagctccagagcttgactcctcagctactggcttcttctgaacttccttcttgtccttgttagaaccagcctcgaagagaacgttgccgtcagcgccaagaaccttcatacctacaacgtcgatacccttaaggtctgctgcccagttgttgataccaactgctgcgaaattatcagcatcgccgtctgttgttgcgaaaacaggagcgtcgccgaggtattcaagaacgtatgtgccttcctcttctgttgtgtagcagagagtatcctttggcttatcgtcctcaacccatgagccgccagcccagtccttagcgttccagccaccagactttgagttgaagttgattgatccgccaccgccgatcgtgttccaatcgttgttgtcaaccttgattgtgaatgaagcaccgtaaacagctccaaggtcagagatagcatccttgtttacagcaccctctgactcatcgccattgaagaatacagcaaaaaggtcatcctgagtctgtctgccgatcttagcgaggtcatcgcttacgttgagctttgtgcctgctgctgatgctgggatcattgccatagaagctacgatagctgctgctgacataccagcgagaatcttagaaattttcatcgttaatctcctccatatgaatatagttttatgaattgtcattcaattctagtcttattatagcagactttctccctaaaatcaaggggttttcactttttttattccaaaaagtgttgaaatttctaacaatattgtcacacttcttttgtgcattaatcacagaaaacgttatcattttttgctttttacaacaattgtcagtcctatctgtcattgaatctctgcaagaactgctttgttctttcgttctgggtctgaccgaaaacttcctccggagtaccctcctccacgatatagccgtcgtccataaagataacatggtttgccacatcacgggcaaatgccatttcatgggtgactattaccatggtcattttctctttggcaagctcttttattacctttaaaatctcccctgtaagctcagggtcaagggcggaggtcggctcgtcaaagaaaagtatctgcggcttcaaagccaatgctcttgcgatagaaacacgctgctgctgaccgcctgaaagctcgcagggataagacttgcctttagtttcgagtcccattttctttaaaagctcctcacagttggcttttgcctcggcttttggctgtttaaggacatggagaggggcttccattatattctgatttacagaaaaatgcggaaaaaggttgaaattctggaacacaagacctattttcaggcggatatccctgagggtcttagagggtgcatatactgccttgccattttctgtatggaacatattcacgccgtcaacgtttatctctccgccgtctgctttttcaagctggtttatacagcgcagaagcgttgatttaccgcttcctgacggacctattattgcgactacctcgcccacctcaacgttaaaagaaatatctttgagcaccctaaggctgtcaaagcttttagaaatatttttcacttcaagaatagccatatgagttctccttatttataataatcgaatttcttttcgataacggcaaatgccaccgtcacgatagcgttgagtacgaaatagaatgcgcctgcgataaaaagcggtgttattgaactatacaggttcatttgctgttttgccttcattgttatttcagcgaatgcgataacgtttgcgagagaggtatcctttacaaggacgatgacctcattcgatgtggcagggataacacgctttgtgacctgcggcaggattattctgaaaaatgtctgcatttttgtcatgccgagcattgaagccgcttcgtactgtccctttgggatagcctcgataccgcccctgaatatctctgcgaaataagccgcatagttaaggacaaatgccgtaacaagggcgataaacatatagttctcgttgttttttatattggtaagcacgtcatagataccgcctgttttgccctgctttgcagcacttgcgataataagcggtactgcatagtagatagcgattatctgaagcatgagcggcgtgccacgcatgacaagtatatagagatttgtcagccacgagataggcttgaagcggcattttttcagcattgtcacaagcactcccacaggtattgaaagcacgattgtccatgcgaaaagcttcagtgtattaggcaggaactccagcaggatctccgtgaccttttttacttcctcaaaagtcataaatattcattccttaacaaaatattacgataacacgtcaccgtatcagcgtattaatacattatactacatattttgcgacttgtcaaacggaaagagtgaggaatgaggagtgaggaatgaaggtatcgcctgcggcgatgattttttcattgcgaactgcgttcgcacaattaactcactaatggtcttattaacttacctcttggagtatctcaaaccacagctatgctaattcctcattcctaattcctcatttgtcattcctcactcctcactttaaatcagttctcttcgttctttaaagccaaaaccgcttcacggactttcgccataagctcttcgggggtttcgccattaggataaataggctcaccgtaaacgacttttactttatatttgctaagacgcttccagttgaaaagccttgggagctttctgtctggtgggaatatctcgtgtccgcctttgatgtaggctggtactataggtacattggcttcgatagcaagaacggctgcaccgcttttgaacttgcccatttcaccagttttgcttcttgtaccctccgggtgaactagcacaccccatttctgaccaagctttttacgcagagccgccattgtttcgtctactcttccgcccctgtccacaggcaccataccgcctattcttactataagtcggctggctaaactgccgttgaaaagctcttttttcgccatacagcagaattttgcaaaacgctcgtatctgaaattcagggtgaggaagataaaatcaaaatttgaaacgtgatttgcacagattatataaccgtccttatcaggtagatttttctcgttggagaccttgacttcatagaacgctgtcacaagatttctgtaaaagcggtaaatacgatagtctatctttttcttgtccagaggatagagcattgatttcactgtttgcggctttatgcggtttgggttttgaacgagggcgataagcttgcccactgtcatgttcttatccatacagccgtcaacacgcacaccactgaactcctctatctccaatgcaagctcgatagctgagagggagtctatggtgaactcctgcaaaaattttgtactgagcttgacttcatccggctgaacgtgtgctatttttgccacggcgtttctcaccattgacgggatatccgacgggtcgatactatttttcgcctgctttgtaaggctgtcaaggttatcctccatgaccattttcttcagcagataacgctttggcttgccgatagctgttcttggtatagaatccacaaaatgtatgccgcttaacttcattgcctgacctgcggaggagcttatttcttttagcttttcttccgtctgctcacgcttatcttcagcacagaccacaaaggcgtgtacctcatcatagcttccctctttcgcaggcactccgcagaccacaagctcgtcaacgctctcgatacccctatagacctgttcgatatcgtcaggggcggcttttttgcctgtggataggacgatattttctttacatctgccgagaatgacgatatttttatgcttatcgaactttgcaaggtctcctgacttgaaccagccgtcaggattgaaagcttcatctgtggactttttgtcgccatagtagcctatcatcatataaggtgactttatgagaagctcaccgctgcggtcgattttaacttttatatcaggatacggcttgccgcaggtgtcagcatagacgtgcttgccatatgtgccgatagttggtatgctcgtttcggtcgcaccgtagttgttcacaatattaaagcctgtgccatagaagaaatcaaatgtatcctttgacatcggtgagcctgcggagcagagaaatctaagttcgccgcccaagactttgtgtatctttgcgaagatctttttgccgctgtttatgccgtagatcttacgctgatgaagtgcaacaggaaacattttcttgaaaagtactgaagatactttgcttgcgttgatctgctgcattatctgggttttcaaaagctcatagacctttggcacgcccgggaaaactgtcggcttgaagttttggaagcctgcggaaagaccctttgcggagagggactctataaagcacactgttccacctgtgaggagaggggctaagacctgtgcgaaaagcccgtagatatggctgtttggcaggattccgagatagcgttcgttatcggttattccgttgcactggcagaccattttgcaggaatttatctgagaatcgtgggtgtgcatgatgcctgaggctgtccttgtcgtaccgctggagaagattatcactgcgatatcagggtcgcctacttcaccttggcggagtatattttcccctgaaccgtcaagtctgtcgagctggttttggatatcgagaacaggcatatttttcacgcttgtaagcttctttgccgccttttgagaggcgacaacgcacacaggctgtgactttttcaccagtgcgacaagctctgccgcaggaagcgaataatccaaaagaacggctgtggcgtttagctttgcacaggcgagaaatgcgatattccactcaggtctgccctcagaggcgatacagaccctatcccctgccacaacgcccatggctttaaggcgacagcaaaaaacatcagcctgctgcaaagtttgtccgaatgtatattccgttgtttcaccctcgtcgttcatcatcacgagagcggtcttgctatagcggtttattgccgtttttctaaattcgttataaatgttcatggcagtttcctttccgcacctcagactttctgagagttgcccttcattgtatgttcaagtgcctcgacagctttttcggagctgtcaaggaggtttttgagattttcctcacccaatgcgtcaacgaacacgctgaaatatttttcaagacgctgctgcttttcttcaatggacttttcaccttttgggaggagtttcacctgaacacggcgtttatcctcagggtcacgcacaaggctaacaaagccttttttctccattgcactgagcactgacgttgctcgctgacgtgatatcataaggtcacggcttatatcagagggatagactataccctcggctgtgctgagatagactatcactttgctttcgccctgaaaaagctctgcaaggtcgtccatatatcctgtttcaaaaaatcgtctgaaaacttctccaaaacgctgggctgttttatcgttcattgttattcctccaaatgtcaaggcggttgattgtcaacactgttgattatacaccctgttaatgaatttgtcaagtgctatgggcggtatggtacaaatgcccttgacaaaatgtctatatcatactataataatatggtataattctttcggcaaatgccgaaacaccgaaaggaggatatgcttttcaaaggtcgaaaggcatgatctggatatgattaaggacgtacaggaaaaaattcttcagttaaagaaagaaaacgatatttgtatacttgcgcacagctatcaggctaaggagatagtagagatagcagatattacgggtgattcatacaagctaagcgttgaggcgcagaaggtctcaaacaaaaacatacttatgtgcggagtgcattttatggctgaggcggcaaaaatgctcaaccctgacaagaacgtatatcttgcaaatccatcggcaggctgtccaatggcagagcaaatggaacctgagatgatagaaatgataaaggcgcaggagcctgacagaaaggtagtatgctacataaacaccacagccgcactcaagagggtttgcgacgtttgcgttacttcctcgtctgcggtgaagatagtaaagaacatggacgctgacaagatactgttcattcctgactgcaatcttggtgcattcgtaaaaaaagcctgtcctgaaaaggatataatgcttttgcagggcggatgtcctgttcatgcgtcggtaacaaaggctgacatgatagcggctaagacggctcaccctgatgcactggtgctttgtcaccctgagtgtatccctgctgtaagcgaaatggctgattatgttggttcaacttccggaataatgaattttgcggctgagtctgacgcaaaggagttcatcataggcactgagatatctattgcggagcatttacagtacagattccctgagaaggagttttacatactctcaaagaagatactttgtcctaacatgaagctcaccactcttatggacgtttacaagacttgcgagggcatcggcaacggcggcggttttgagataaagatgacagacgaggagataacctctgcaagaaaatgtatcgacgaaatgatacgtcttgggggctgatataatggaagattacaccataaaaatcgcaaaagggcttgcaaacaacgcagacgccagactcataagacagcaggtattcgttgaggagcagggctttgtgaacgaatttgacgatatcgacgctaaggcttatcatgctgttatctacacaggaggatatcccattgcaacaggcaggctgtttgacgaaaatggcgaagcgcacattggacgtatctgcgtgagaaaggcatatcgtggcagagatcttggcagaatgatagtggaagcccttgaaaagcaggctgaaaaagcgggctacaaggaagtcagcttatcggcgcaaacgagagtacagcaattttacgagaagcttggctacagggcatatggtgatgtttacaaggacgaatactgtccgcacattgcaatgaaaaagaccctttcaggggaatagatatgaaaaaggacgacttggggtcgtccttttttttgtggcgtttaatgaacaaaacagtttgtgattgaaacgaacgagagtggcgggacgtcgagggcgccgtcccctacacaaaaaaattgcgccgctcccctacataaatgtattgataaaaaacgataataatataaatttttgtaggggcgaacagcgttcgcccgtttaccgcaagattgcccaccgctcgcaagatatcaatttgccccacaaaaattgcacataatttgcgcacaaaaaaaggacggaatcgcttccgtccttgatttttttagctatttactgtttccttgatagcgtcgattatttcagggaaataccagccaccctcggatctgttgagaagtccgaagttctcaccgtttcctattcttgtgccgttatcccaccaacagcatggtacgccgtactgctttgcggtgctgagataatcctttacacactgaactctcgcttctgtattaaccttatttacagagccgaactcaccgattattacaggtattcccttgctgaggaacacttcattgatatcggtaaagagtgttgtgatagaagagtcgatacttgtatactgatctgtgcctgcggtatcaagtgcaaatgaatatggcagataagcgtggatagaaactattatcttatcgtcgccctgcggaacttccaaagcttccatgttctgctttgttgatgatgcggcatatggtgtcaccattatacatctgttaggattgtttccgccagaagcacggacagtttcaacaaacgcctttgcgtactgatttacaacctctcttgactcagcgtcgcctatccactcgttgccctcgcctctaagtctaggctcgttcacgccctcgaaaatgaggtgctcgtcataaccctgaaatctgtcgcatatctgtttccagagggctttgagctgctctatatccttatcggcacggtctttcttaggcatataccactcctcgtggtgggtgttgaggataacgaacattccgttgtcgataccgtaatcgacaatttcctgaactctgttcatccatgcctcgtcaactgtatagttctcgtccatgtgagtaccccatgaaacaggaagtctgaacacgttgaagcctgcgtccttgacctggtctatcatcaattttgtggtttccacatttccccatgaggtttcagcgtcaacgcctgagccgcctgtggaatccatggtattgccaagactccagcccactttcatctgagccacaaggtcttttgcagtggtcactgtcatagggtcatcggtatgcttctgagtattttctgtagctgaagaatcgttttcagcctttgaggagctgtccgaactgccacaggctgtcatcattgacacgcccattgcaagggaaagcactgctgcaagtagtcttttgattttcatattttggttttcctttctcaccatataaaataataacatttatattttagctcattaatgtggatttgtcaataggaataataaaattagataaacgcacaaagttctgttgaaatgtgactatatatacaaaatttgttttttgttatttattttgcccattgacaattataatcataaactgtataatttaaacataggatatttaatttgaaaattatatgggggtacaactatgaaagctaaacacgttggtataataatatgggtaattgttgccgttgcatttatattttgtttttggtattttggcataaagaacatagtttcttctgatgaacctgaagatgatgaaagcggaataaatacttttaactacagctgtccccatgacgatacctatcaggaaccaacgctgaatatgggaaaatattatccaaacggagatacaagcaaagattattttataataggagaaaacaacactctgaaatacagcggagattcggaatatctttgcaataagctgtttacgttttatgacgagaccgcaaagcaggatacgataaaaatgtggtctgaaaccagaacatatactattaaaacctatcacgaagcaagagatcagatactaattgaatttgactatggaaaacatgaaaatgctttcgctttagcatttaattatgttgatgaaaacacattcgtcgccgtagatacttacattcgtgttcccgacgattctgccgctgaatcggaatcttattccgacgatgtttcggtaaatgaaagcaaaatttcatagtaaaaaaacttcaatggcgaaaaaacgtcattgaagtttttatttatgttttatgtttcagccgacttttccggaattatcggggtaagctttccgtcacggagaaattctatgtaatcttctatggaattgataggctcgtcagttgcaacaccgctgatacggctgtcctccacccacaggtggtgattgtccgtaccgcctgtttgcttgaagccgaactgttcggcataccactttgcacgctgattatagacctctttgccgttgccgctgttatagacctcaacgccgtctatccacttcggcaggagctttatttcatggatataccaatccgcttcacgaaaagggtgggcatggactaacactccacctgctttatgcactctgtcggcaaactgataaaagcttatatcactgatgttatcattggcaagaagaaagtccttgtcgataccataggtcaaaaggtctgcaccgaagtaggaatactccagaccgaaaaagactttcagacctatcttgtcacccacttctttggcattctcataacccttgcagaatttgttcactctgtcctcccaactgtcaaagttggtaacagcacagttgccgttgaaaaagtgatcggtgacgatgatcccgtcatagccaagggctttataacgtcttgcctgctctgctccgcttgcagaggcacaggcgcttccctcggcggtatgcaggtgtgtttcatacctgaacatcagaagtccacgcctctgttgatgacctccatgcacattctgccgttatgataagggcatttccatggacctactatctctttccaatcatgtggcttatggtcataggaaacctcggcataccactctgagccttctctcttgtcgattatctcagccttgatatattcccacacgcttcttgcactttcaaggaacttcttttctccgctgtgctgataagcgttgatgaagccaacaacagactcggcttctacccaccatacacgcttcttgtctatcttatcgttctcacgctcgttgttcagtgcgccgttatcaagggcgatgttctgaatgttatgagagatcttaagatccatttcagcaaactgctttttaagctcctcgtcccccaaagtatcgcaggcaagatccatgagccatgttgcctcgatatcgtgaccaaatgaatggatatctcccacaagatcgaactttgtgtcaaagaaaactttcagagcgttagtttcaggggtatagacgatatctctcatctgaccaagctggaatttaagtctttcggcaacttcctcgttatggtctgccttataaagctcggtataagcctcgataaggtggaggatagcgttcattgtcttatcagcatgcaagccattctcagaaagagcgtcatttgataccaggttccactgtctgtcaaaagcttctctgtagccgtactcgtcgagagtgttgttctcgatgtcgtggaaaagcttatatgcaagctccagagcttccttatctccgcttgcgttatagtagcatgacagtgcatagatagcaaatgcgatgttgtatgtatgcttcatagtgtcggcaggctcgcccttatagttcatcatccaataaactccgccgtactcatagtcgatacagtggtttttgataaactcgtaagcgtggcgtgcgttgtcaagaagtgtcttatcgcccagagtgatatacgcttttgaatagaaccaaagtattcttgcgtggaggataacgcccttatcagcctgcttatccagcttgaggtcatagctcataaaaccgtaaaatccaccgttctcatcatctctcagcttgttccagaagggaatgatatgtcctgtaagttcctttttgacttcttcaattatcatcgtaaaaactccttttaaaatatattgtctacgatttttctatttcaacatttctttattttttctatttcaatattttccttgcctcaacataaaatctcttatcctcggcatgacccatggagaacgtttttcttggcagtgcgccgtcaacgataactgtagggaaaagctcttccttgcccatgtcagggagcataaagcctatggaattttcctttgcggaaagctctcttatgacctctgcaccgtggatatagtccaccttgccgcccttttccttgatatagctgtcaaggaaattctgcaatgagccgacagtgagctttgaagttggcttatgtatatagagagtcttttcctcgccattgtcgcagacaactattgcctgctctgacttttcctcagaaagctcaagagccgctgtcatttcgctcataagagcctttgtatcaacatctgtaactatcctatggatagcttcaaattcaagtgcaggcgaatggagattcactatctccacaagggcatatctgcaaagagcattgctcatgtccttatcagggttctctctcttctgctcctcgtaaaattcctttgcagtagcaagagaatggttgccgtcacccattgcgtagacaagaggtgaagtttccttaagaccatactttgtattgaaagcgtcgatatcaccaagcttttcaagtgcggctattatcttttcctgcataggcttttcaataagatagcctgcgatatgaccaccctttttcataaggtcaaagtcatagagctttttcatttctcccttgtgggcttcaagcggctcaacaacgcttttttctgtatcgtcaacgagtatcatgatatgcggcagctcaacaggtgcgccacgtcttacctttattctaggcggtattctctccacaactgtggcttctgttgctcttacggcagacttcgagcctttgcggtagtcatactcttcaaggtcgatagcgccaacgatgcccgctctgacctttccgtcagactgtgttctttcaacgtatatcatagcgtccttatactcttcaaaaacgccctcgctgatatagctgtccatattcttatgtatgtcggctattctttcatcaacgttatcgtcctccagatagacctcaggcaggataaggttaagtgcgctttttgcaccctctgttatcttttccacgtcagcccaatactcaggctcagaggtatactggtcgcaggcaactactgcccactttgacatatcggcgttcttaggcagaagtatatctgcgcttttaaatgctgttgacatttcactacactcctattattcttatatccaaaacaggacggctgttttcaccgtcctgcatattgtttttatttctcagagctgtcagaactattctctgcctgctcggcttcgtcagcctgtacaccgtttccagcaccacagcagttcttatacttcttgccgcttccgcatgggcaaagatcgttcctgcccggcttcttagcctttcttacggtcatgttatgatgctcgcccggcttaagaacgtcctctctctttggagcggcgctgttcttccttacctgaatggtgaacaacattcttacagtatcttcacggatagaagctaccatatcgtcgaacatatccataccttccatacgatactcgactactgggttcttctgaccgtatgaacgcagaccgataccctttttcagctcgtccatatcgtcgatatgtgccatccactttgtatcgacaactttaagcaaaacgactctctctatctcatgaagaagctcctgtccaaggtcttcctcacgctttgcgtatatcttcaaagctctgtcttcaaggaggtcaacgatatccttctttgttatctcgtcaagctcctgtggggtatagttgaagtcgtcctcaactgtgattatgcccataagtctgtccttaagaccctgcaggttccagttatcctgaacgtcctcgtcagtgatatacatatttacagaatcctcaacgaactcctttatcatgccgaggatattttcatggagatcctctccgtcaagcacctgctgtctttgcttatagattatctcacgctgtgtgttcataacgtcgtcgtagttaaggacgttctttctgatgttgaagtttctgccctctatcttcttctgtgaggactcgataacacctgtgagcatttttgactgtattggagtattctcgtccaccttgagagtgtccatcatggctgttattctctcgccgccgaaaattctcataaggtcgtcttcaagtgagaggaagaatgtgctttcgcctgggtcgccctgacgtcctgaacgtcctctcagctgattgtcgatacgtcttgactcgtgtctttctgtgccgatgatataaagtccgcctgcttctctaaccttttctgcaagctcctttacctcttctgaatactttgcatagagcttcttatattctgctcttgcagccagaacttcctcgtcctgagtatttgagaagcctgctgcctcgacagccacttcctcagaatagcccattttctggaggtctgcaagggacttatactcagcattaccgccaagcatgatatcagtaccacgtcctgccatgttggtagcgatagtaacagcaccatatttacctgcctgtgcaactatcatagcctcacggtcatggtgcttggcgttaagcacttcatgcttgatgcccttatttttcagcagtcttgaaagatactctgacttctcaacggaaacagtaccaacgaggacaggctgtccctttttatggcactctattacctgctcgataacggcattgaacttgcccttttctgttttgaaaacaacgtctgggtggtcaattctgataacaggcttgtttgttggtatctcgataacgtcgagcttatagatctctctgaactcgtcctcctcagtaagggcagtacctgtcatacctgacagcttgccataaagacggaagtagttctgatatgtgatagtagcgatagtctttgactctcttgctatctcaacgccctcttttgcttcgatagcctgatgcagaccgtcattgaaacgtctgccctgcatgatacggcctgtgaactcgtctacgataagaacttctccgtccttaacaacgtagtcgatatcctttttcataacgccgtttgccttgatagcctgattgatgtgatgagcaagggtcatattatcagcgtccataaggtttataacgttgaacgccttttctgctttcttaacaccgctctttgtaagagttgcggtcttagccttttcgtcgatgatatagtcgccgtccagaaggtcgttatctgccttatcgtccatttcaacaactgtaacaggtttcagggtctttgcaaatctgtcggcaagtgaataaagttttgttgacttgtcgccctgacctgaaatgataagcggagttcttgcttcgtctatgaggatagagtccacctcgtccacgatagcgaaagcgtgctctctctgaaccttatctttcttatagatgaccatgttgtcacggaggtaatcaaatccgaactcgttatttgtaccatatgtaatatcggcgttataagcttccctcttctgctccttgttcatgcccgtaagcacaacgccgatagaagtgttcaggaagtggaacaccttgcccatttcctcagactggaacttagcaagatagtcgtttactgttacaacgtgaacgccatttcctgtaagggagttagcataagccgccagacaagcaacgagagttttaccttcacctgttttcatttcggcgatacgtccctgatgaagaacgatagcaccgattatctgaacagggtaaggctttttgccaagcactctgaacgcagcttcacggcaaaccgcaagagcgtcaggaagaacgtcatcaagagttgaaagctcgtccagcttgcccctcagaatggcagtctgtccgcccagctcctcgtcagacatatcggcatacttactttcaagctcgagtaccttattctttataggctcgatcttggcaagctcttttttagaatagttgccgaatattttatcaaataatcccatgtttcaatccacctttatttattctccagccagaatttatgacaggaaaaagttaaaaaatatactatgctataaatacactattatattatacaatatccccttttaaaagtcaagcaatttatgtaacgttttacaaacaaaaaacgacggacagtgttttctcactgccgccgcaccaatggactatttctgcattagcctgtattcgctgatacctgtcagcactgtaaatgccacctgacgctgatagtcctcattctccaatttctgagcctcctcagggtttgaaagaaaaccgcactctatcataaccgcaggatttttggtattattaagtagataaagctcgtcgcctaccggcttagtttctctggtattgtcgggctgtaaaagggaaacgaactgcttttgcatcactcccgcaagcttttcaccctcggcattgtctttagaatagaacatctgcgcaccgctgtagcggctgtcggtaaactgattttggtgtatggaaactgatatgccgtcggaatatttcgagaatatggcaaggcggtttttcatatcggactttttctgctccccaagcccctctgtgcctttgtcatagatagatatatcgctttcacgggtgcaaacaacatcatagccgagaagcttcagaccgtcacggaggctttccgccaccgcaaggtttatccccttttcaggcgtgccgtcaacggatacacagcctccgtccagaccaccgtgacctgggtcgatgaccaccacaggcttatccatggtcgttttcaccgccccacctgtcatgacggcttcaccgttgtttttgccataccagcacactgccgcaaagcctgctatcaccacacagcacaaaatattctgcaatcttctgaacatatatccgccctcctagtttttgtcctttgtacaagttatgcggacaaaggacggcttatgcaaaaaaaatcaccgcaccacgaaaacgggtactcgtaaagaagtttttatgatttgaagatgaggttgcgtaaccatggcggttacgcaacctttctctttttgtcgtacttcatactgtcagcgaccgcagttgatactgcgacatcgaagcgataataaatgtccatctgctgtgtgcggtgaccgctgctcttatcgggagcatgaacaacgatcttctcaataagttcatgcatgatctcaggagtaagctccgtgatacgctcatacttctgcaccacgctgatgaatgcggtcacatcggctgacttctgctctgccgtttcgatgaagtcagtaagctctgctacggttgctctcagtttcttctgctcgtcctcatatcctgccgacattatggaaaatcgctcatcggaaatcttgcccgatacgttatcctcataaagccttgtgaacagtctgtccagttctgcgatgcgcttctccgattctttcagcttcttcctggacttggaaagctccgaggactgcttctgaacggaattatccatagccatctgcacaaactcgtcctcgttatccttgacaaaggcaaccatcttatttagttcaccgagtatgatctctttcagcactattgtcctgacgaagtgaattgtacagccgttcttgtcttttgcataggtgccacatttcagatgctcttggtcggcagtcatggttgtcgctcggcacagatacaacttctttccacagtcggcacagtaacagatgcctgaaaacggattgacttcttcgtgctttgtcggacggcgtttgttcttgcgaagctcttgcaccaagtcaaactcttgctgagtgataatggcttcatgggtattctcaaagattagccaatcctctttcgggttatccacacgtttcttgtttttgtaggacttcacatgagtgcggaaattgactgtgtgtccgcagtattcagccttttcgagaatatgggcaattgtctcattgccccaacggtgcagcttggcattcttatgaccattatccctgccctgcgacaatgcgtaggcagttggcgtggggatgccttgttccgttaatatgcgagcaatctgcgtcggaccatagccgtcaatgcaaagatgaaaaatcttgcgaacgacctctgcggcttcatcgtcgatcacccataagttcttatccgtttccgagtgcttgtagccgtagattggattggaaagatgtttacccgactgcccatttgccttgaaaacagccctgatcttcttgctcgtatcacgggcgtaccagtcattaaaaatgttcttgaaagccatcagctcattttcagactttaaggtatccacgccgtcattgatagcgatataacgaacatcatgatccggaaagattatctcgatgtactcgcctgttttgagataatcacgtccaagtcttgaaaggtctttagtaatgaccgtaccgactttgccctcctcaatgtcagccagcatcgctttgaagccctcacgctcccacgtcgttcccgaaactccgtcatcaacataaaacacgggattgctgaaaccattatcctctgcgtacttcttgaggatagccttctggttggtgatgctgttgctctcaccctgtaacatatcgtcctgcgaaaggcgacaatataatgctgtgatcttgtctgtcataatttacctctctttccgacagatacagcaagctatgttatcattatagcgcgcaccgacaataaatacaatgcgccgatatcacaaagttacacagcctgcttctcgggttcttgtccggattcaccgaggagtatttcactctcccggataataagccttttcagaatatctgaaaggctctcctttgaagcagggttgaacacggttgtcaccgtgtaagtggtatgtccgattctgtactcggacgttgcgttaaaagttgtctctgccttttctttctctacggcagtaacttttttattcatagcgaattttactcctttagcttctctgtctctatgctttagagtcgagggcttcgctttctatctctcaccctcataatagccgtaaggtcggctcagtgttttgagccgacagagtattttacggctacattttttgttaccggatagttttaatcctcatagggattcgctttatccgtaaagctcatttgctgaccgaagtcagcgggaagatcggcggtatcggttttctcattttcagcatttccgccaccgaccagtttcagaagatcttcatcggacagaccgcttgcacggagtttctgcaacagcgaatgctccgaggtgatgatctcatcaagctcacggggctcgcagttgtattcttcttccatagccagacgggaaacttctttcagcttgtcccccagcgttttctttttcgcagtatcgcttgcgatacgcttttccaaacctttgatcttctcgatgagctgcgctcttttctctgtatagatgcccatagaaaaatcacaacctttcttttgtgttattagtaggcagagccgagtgaccgaagctcacctgccatgatccaattatagcgcgctctacatttgaaatacaagccgcattgcacacaaactttggttcatactttgtcaacaaatatccggggaatttttagattcaaaaaactgaaattacgctatttcgacgtttatgctatccggtcattttgacgaaacaattttgagcgattataaaaaaatgaaatttattattgacgtgatcgggaaagtgcgctatattgattatggggagcgacgatatagagaaagtcgcacagcttcaattctcggaatcgagaaaaaagaccgagccgaaaggctcggaaatgacattcgccccacagggggcgaaactagagtagcaagcacggtgaagtgtgggcgcaaaatgcggctacacacgcttcacaaggcttggcagagggcactgcccctacgaccccgaattgagaaaaataaaaaggagaacaagagaaatgaaagacgaaaagaagcgtacattgtacctgaaagtccgtgtcagccccgaagagatggcggctataaagaagaagtttgagaacagcggtatgagcagtctcagcacatttgtgagagcaatgatttttgagggatacatcgctcaggtcaacgaaaacgagctgaaagaactcacccgcatcgcaaataacgttgccaacaatatcaaccaaattgcccaccgagcaaatgtcacgaacaagatttataaggaagatattgaggaagtcaagagccttgccagtcagatcattgaccctatgctttttctgcaaacgaaggtcttgcagttgaagcattgacagaaaagtgctgtcaggagaaatcccgacagcaccgaaagccggatatgtgcgctctgtaccggatcagcgtttgaaattgctgcgcgcttcacaagaatggttacaattataccgcagagctggactctggaagaattatccgctataatggattcacaataaatctttttgggggaacagctatgttgaaaatatccgaattggcaatgccgagaacacgcaaggtcacgactgtctgcaacggcagacgtgaggtctggacggactacgaagaagcgaaagcctatttccttgaacttatgatgattactgagggcgaggagcatgaacgtgcggagtgcgtttacattcagctacttcacgggctgggtgagtgtagtgatgaggacgaataatgaggggctgtaaaaaaagtccccaagaaaaaaggctgcgatcttgccaaaaagcaagacagcagtctttttttgtggtactcctgtttctttcttttattataccactgtcacgatgttttggcaattttgtgttcagtttctagggtacattataaggtcttttccgatctcagggctaaaatccttcagcgtgtgctttgttccgttgagtgctacatctgcgtaagataccagccattttcggtctccgttgcgaaatacttcataaaaagaccgattcagcatttcttccacgggcacaccctcaactaccgccatctccttgttgcagtagcggaaaataaagtcaacaccgtgaccatcctcatcgaatacaagctcgataacgcagtaagccagaggcatttcgtccataatactgtacttctcgtagaaacccaacggcgggtcgaattcctccttaggcgacggaacgtcaagcccaagttccttacgcagccgatgtggaggggctgaatggcagctttgacaagaccgagtttgatcttgcttctgcagagaatacaacaattgaaaacgccccaacagacacaactggttttggcatttccggaggtgcgatcacaaaagatcagaagatcggaactattacagtaaagatcacctcagatacctcagacaccactatggtgaaaaatttggaggatctgcgcggtgtatttgaaaatggtggcaaggcaaagctaaacagcgaccttaacggagcatacgagatgctgacggtttcgtcaggaaaagatctggagtttgatctgaacagaaagacgctgagcgtcgaatctatttcactctcaaatgatggcaacgaaacgctgacgctgcgaaacggtactatcggttgttatgtgcagatgaatggaagagctgaacaacatctgatcgttgacaattgtactctgaatgggttgggcgacaataataattactcagatgtgaccttgagagattgtgtcatcatgaaagattgctttaccagctatggcggcatttggaaattcgaaggagtcaataatattaccggaacaatgaaagttaagaaagatgtcaccatttccggcgactttacgttagggacgcttaaagttcccatggttactaccggtacgccgaccttaaaactgtcgggtaatattcggataggcaaattctcctttgatagtgtttatagagaagaggcaaagatcatctgcggcgtgggtacatataactttaagccggatgaatatgaaacaggcagatatggaggtattcaactagcagagggatgcaccgtcagcggacctgatgagaacggcatttacaccgttacagcggaataagtagggcagaaaaatgaaaaaagttattatatccatactgtcgctggcaatgacagcctctatggcggtccctgcctttgcggacaccactgccgacgtgcagggcaaatatgtggcaggtgcggaatctcctgtaactatatccgccgacattacttgggaagatatgaccttcgattacaccgagggcgaaaagacttggaaccctgaaacacatcaggtcgatcaggcagacggcaaatggactagcgacacaaaggctatcacagttacaaatcactctaatgtgggcattatggcgaagtttaattttgcttccgagggtgatattgagggcagtttcactaaagacggcacctcaactgacaaactttcgcttgacactataaagaatttggatgaaggctcagccgctccgtctgacacgatgaacttcggtattactggtggtgctatcagtgaaaattgcaagctgggaactatcacggtgtatatcgctcctaatgacggcaaaaactatatcttcacagaaactgaacttactgaagccgctgtaaaaaacgcacaatgaaaaaagactgctttctacctcggaaaagggtagaaagcagtctttttttggtataatactatgcactgttttgtatgtttcaaattttattatacaggatcaactttatttttcgccaataagtttacgctgctttatatgctttttaccagaattggcaaaaaattaggcagccgttaccgactacctaaagaacttattctactctgcaatgaccttgtatatgataaatgcccatagtgcaagagaaattatcatcaccatataaaaataccaatgttttgttttgtgacggaaaaattccatgcccagaaatcctcctgtaaagccgccaagcaggctcagaccaaggagcgttttctcaggtatccgccatttgtgtgctcttgccttgtgcttatctgcaccaaaaagtatgaacgtcaaaaggctcattgcggaaagatatattataatgtatttcagcatatctttgtcctcatataaacaaagggcggaaaagctccgcccttgtatttttgtttttttacttgaagtaagctacgccgctttcaaatattttctgatccttttcaccaggaacgttctttgatacgcagcagcccttacgctctgagtgacccattttaccaagaacacgtccgtcaggtgaggtgataccctcaatagcctggaatgatgtgttggggttgcaatgaatgtcaaatgtaggttctccgtcaaagtcaacatactgtgtagcgatctgtccgtttgcagcaagctgtgcgatttcctctgctgttgcaacgaaacgtccctcaccgtgtgagatagccacgctgtggatatcgcctacctcacagcctgcaagccatggtgacttgttggaagcgatccttgtgtttaccattttagactggtgtcttgcaatggtgttgaatgtcagtgtaggggagtcatctctcatatctcttatctcaccatatggtacaagaccaagcttgataagtgcctggaagccgttgcagataccaagcataagaccgtcacgatttttcagcaggtcatggatagcgtctgtaagtcttgggtttctcaggaatgatacgatgaacttgcctgagccgtcaggctcgtcgcctccgctgaatccgcctgggagcattactatctgtgactcttttatcttcttctccattgcgtcaacagactccttgatagcctgttctgtgaggtttcttacaacgaagatgtcagcctcagcgcctgccttttcaaaggctcttgctgtatcgtattcgcagtttgtgccagggaatacagggataagcacctttggctttgccaccttgatagcaggtgcaactctcttgtctgccttgtagctgtacttttcaggcttttcagcaggctccttcacatgaacaggatatacaggctcaagcttgccctcccaaagtgtctggagcttgtcaaggcttattgtgtagttgtctgactttatctcgtagctttctgttgtttcaccgataactctctcgtcagtgtcaacgccctctgcaagctcgataacaaatgcgccatagcaagctctgtaaagctcttctgctgtgagcttgtctgtgaacttaaagcctatcttgttaccaaatgccatttttgcaacagcctcagatacaccgccgtaggatacagcccagcatgaaagcaccttgccctcagcgataagcttttctaccttttcaaatactgccttaagtgaatcgaagttcacaagcttgttgtcgtcatattcaggcttgataaggatcaccttagagcctgctttcttgaactcctgtgaaactaccttgtctgcgtctgttactgatacagcgaatgaaacaagtgtaggtggaacgtctatttcctcgaatgtacctgacattgagtccttaccgccgatagaaccgcatcccagctctatctgtgccttgtatgcaccaaggagagcagacataggcttgccccaacgctcaggatcgttctgagttctctcgaaatactcctggaatgtgagccagcacttctcatatgtaccgcctgttgcgatgacctttgcgatagattcaactactgcactcattgcaccgtggtatgggcttacagatgaaagatatgggtcatagccccagcccataatggacgttgtctttgtattgccgtgaagaacagggagctttgcagccattgcctgtgtaggtgtgttctgatatttaccgccaaatggcataagaactgtgtttgcaccgattgttgagtcaaatctctcaataagacccttctgtgagcagatgttgaggtttgatatcatagactcccagcggtcagcagtgtcagcgtcgttgctctctgctgcgaaaacaggagcagggatagagatatctgtgtgcttttcagctccgtttgagttaaggaactctcttgtaaggtcaacgatagtgttgccgcaccagttcattttaagtcttggctcagcagttactcttgccaccattgttgcttcaaggttttccttagcagcctcagccatgaacttttcaaggtcgctctttgcgataacaacagccattctctcctgtgactcagagatagcaagctcagtgccgtcaagaccgtcatacttctttgtaacagcgtcaaggttgatagaaagtccgtcagcaagctcgccgatagcaacggaaactccgcctgcaccgaagtcgttacaacgctttatcattgaagtaacttcagggtttctgaacaaacgctgaagctttctttcctcaggtgcgttacccttctgtacctcagctccgcagttttcaagtgagtggaggttgtgtgattttgaagagcctgttgctccgccgcagccgtcacgtcctgttcttccgccaaggaggataacgatatcctcaggctcaggtctttcacgtcttacgttctcagcaggagcagcacctactacagcacctatctccattctctttgcaacatagccagggtgatatatctcgtgaacgtgaccggtagcaagacctatctggttgccgtatgaagaataaccatttgccgcacctacaactatttttctctgcggaagcttacctgtgatagtgtcctcaacaggaaccagcggattgcctgcacctgttactctcattgcctgatatacatatgaacgtcctgacagagggtctctgatagcgccaccaagacaagttgccgcaccgccgaaaggctcgatctctgtagggtggttgtgtgtttcgtttttgaacatgagcagccagtcctcaggattgccgtcaacgtcaacagttatcttaacagagcaagcgtttatctcctcactctcgtcaatgtctttgagcagaccagcctttttaagctgctttgcgccgatacaagcaagatccataagtgtaacaggcttgtcagttctgcctgcataaaggtcttttcttgtgttgatatagtctgcaaaggtagcagctatgtagtctgagtcgatagaaacgttatcgacgatagtggagaatgtagtatgacggcagtggtcagaccaatatgtgtctatcattcttatctcagtgatagtaggatttctcttttcaacgttcttgaaataatcctgacagaacttgatatcgtcaaagtccattgcaagacccaagtctgtgagcatgaatctcaggtcatcgtctgttgaatagataaagccctcaacagtcttaactgtggtagggatagtatacttgatatcgagtgtatcgaagcaatcaagggaagcttctcttgactcaacagggtttatcatatagtgcttgatctggtcaagctctgcttctgtgagtttgccagaaacaatataaattctcgctgacttgatagtaggtctttttcctccagtgagaagtgagatacactgtgcacaggaatcagctctctgatcgaactgacctggcagatactcaactgcaaaaacaaactcgtcagcttttacagcaggaaggtgatcgtaagtaacgtcaacagcaggctcagagaaaacgactggtgctgcaaggtcgaaatcctctcttgaaagaccctctgcgtcatagcggtttataactctcagacctgtaaggttttcaagtcccagagctgactttattccgccgataagtgaatttgcttcaactgcaaattcaggctttttttctacataaatacggtaaacagacatggctacatctccttataatagttacctctattatactacatttttcgcatatttgtcaataaaattattattattcggcagggcatataattatgtgtgaataagcgttggctcacttgttgattttttagttcataaaagcagaaataccgcaccattacagtgcggtatccctaaaatattaatctgcaaacggattttctgttggataaagcataccctttggctgattgaagcctatgtctgtcatgccaagatatgtcataacactgtggagtgcctttccatagtgaccaaaagcaacagcaccatggtgaggatagttcttctgaacgagaacatggcggtaaaatctgcccatttcgttgatagcgaaaataccgatagagccaaatgaacgtgttgcaacaggaagaacttcgccctctgcaatatatcctttgagctgtgcgtcagccgttgactggaagcggaagaatgttatatttccgtcaacgatatcgccctcaagagtacctcttgaaatattaggctcgctgtctggctcaagatttctcttcatgatacgctggaacttcatctcaggctcttttacaaggcatgaagctgtgtttccgcagtggaagcccatgaatgtatccttatgtgtgtaagggaactttcctgcaatatcatcattgtatatgtccgcaggaacagtgttgttgatgtcaaggagcgtaacaggcttctgtgatacacaaacgcctatgtattcgctgacagcaccgtagatatctacttcgcaggcaacaggaatgcctatctttgtaagtcttgaattaacatagcaaggaacgaagccaaactgcgtctggaatgcaggccagcacttgtttgcaaatacaacatattttcttgagcctttgtgagcttctgcccagtcaagaagagtaagctcatactgcgcaagtcttggaagtatgcctgccattttattgcccttgccaagctctgcttccatgtcagccacaacagcagatattctctcatcgccggcatgggcgttgaatgactcgaaaaggtcaagctctgagttttcttctatctcgatacccatgttgtagagctgtctgataggtgcgttgcaggcaagaaagtcctgcggacgtgggccgaatgagattatcttcagatccttaagaccgaggatagcccttgcaactggaacgaactcgcttatcatctttgcgcactcgtcaggtgtaccaacagggtactcagggatataagccttgatgtttctcagtgcaaggttatagcttgcgttgagcattccgcagtaagcgtcgcctctgttgtcgataagtgcatcaccgcatggttcttcagcagccgcaacgaacataacaggaccgtcaaacttctttgcaagaagtgtttctgaggactcaggtccgaagtttccaagatatacaacaagtgcgttacagcctgctgtgtttacctcgtcaagggctttgagcatatcattctcgttctccacaactgtaggacattcgtagatatctccgtaagcctttttgtactcctgacagaccttgatacgtcttgattctgaaagcgacatagggaagcaatctcttgaaactgcaacgatgccaagttttacttctggtatatttttcatgttttaacctccgattttcatttatttatgactttattctagcatacctttgtgctgttttcaatagctttttgtgcaaattttcgtgaaatttagttagctgccaagcatgaaaaagtgcgttagcccaagccactctctcacccaatatgtgaacaggtatcgtggctcggtgtaggctgaataagcggtgacattctccacgccctgagcctttgctataaggcttgcacggtattgatgaaagccgtctgtgacgatagtcatatcatggctcatgccgagttcatcgagtatcttgagagagttttggatattttcgtaagttgaagtggacttgtcctccattattatcctgtcgctgtccatgcctttttcaagcagatagtttttcattgccaaggcttcgcttattttctcatcatcacccttgccacctgaaactatacaaagcgtatcgggattgtcgttcatagccgtaattgcagcgtcaagtcgtctgcgtaacattcgtgaggggcgttcgccttttacctgacagccaagcacaactataacgttggctttttcaggacggttttcctgtgctttgtacataagtatggaaagaatgcccacatatattatcccagcaagtatcaatgtgcttacaaagataagcccgaatttacctgcgccatgtccccatatttttgatataataccgcagaattttgtccagtttgccgttatgagcattagcatcaccgaaacgatgatgccaagcaggttgcccgaacatataactggtaatggtacaagaaacagaaacaacagcaaagtttccagtgcaagcaatattatttttacgctcattagttatctccttgtcttttttgtactattataacatatagctctcgtgattacaagggcaaaagagaaaagcgctccgcagcagcagaacgcttttataaggaatgatctaagttgagatcagatcaccgaatttttcgagaaaatcacgcttgtcgtcatatttagctaccagcgatacagttttctttgtgccaagaccgaaaatacccataagtgattttggattgagtatttttgttcctgactgcaccaccagatcgtatttgcagcttaaagccgcttcatgcaaagtcttgatgtcatttagatcgtttatcctgatataagctttgatcatgttcgtgattatgccctttggcatatcctcctttcgtaataataacctctgaaaaactaaaaaagaaccgaaaatttctgagattttcgtttctttttacattggcaacagcagttctatacttatatgtcacatatcttaatccatatataattatatgcctgtgtgaacaaatagtaaacagatattgtgtaaaatattatatacgaagatattaatatgaattttacttatttcatgttaatttattatataaaatttggataattaatcatatttaaacgttttagttaatgtggaacttatgtaaaagatataacaaatcagctaaaagttttcttattacgaaaatcttaaacgttttatatgcgttttgaatgaaaatacaacaaaagtagaaagtgtatattcgtaaatatattaaactatatgatgatattttgcaaaaatacgaaatcgtttaaattttgcaataaaaaaagcactgagcttttaaaactcagtgctttcgtgatatcaaagtttagtcaacaataaattctttgatttcgtcaaggaatttagtagcgtcgtctgtgtgtgctacgagctggataggatttgaaaggtcaaggctgaaaatacccataattgacttagcgtcaactgcatatcttcctgacgcaagatccacatcaaagtcgtacatagaaactacgcttacaaacttctttaccgctgcaatggaatcgagcatgatttttacctttgtcataaatattcctccttcagaatgatcggtatatccgatcttgattcccacataaattctgtagatcttttctctacaatttatattataaacgatttttttgatttgtcaatggatatttgcaaaaaaatttaaaatatggtacaatagtcaagagtgataaaaatcaaagtttagatttatgcaatatgcacatatattgttgtgatttattgtgcattataaacatttggctactgaaaggaaatcaaatatgaaagcctttttctatacattcggctgcaaggtaaaccaatatgaaacagaaaatataaaggaagcaatgctgtccgaggggtatgaggtcactgaggactatgctgatgcagaggtctgtgttgtaaatacctgcactgttactgctcagtcggactcaaaatgccgacagcttatccacaagataaaaaaagccaatcctgagtgtctgatagttttggcaggctgttttccgcaggcttttgaaaaggaagcttctgctcttgacgagtgcggtatcatagttggcacaggtgcaaaaaaggagatacctgtccttataaaaaggtatattacaagtggcgagcgtattatcaggatagttcctcgtgagaggggagaggcttttgagaaaatgacaaactcaggtgctgaccaaaaaactcgtgcgtatatcaaaattcaagacggctgtgatcagtattgcacctactgtattatccccactgctaggggacacatctgctcaaaacctttggaggatatcgctcccgaagttcagcagctcgttgactcaggtcacaaggagataatcctcacgggcataaatctttgctgttacggcagagacttcaaaaacggcacacggctcattgacgctgttgaagccgcctgcggctgtgatggcgattacagagtgcgtatcggctctgttgagcctgagcttatttcagatgaagatatcctgcgaatgtcaaagcttgaaaagctctgtccgcattttcatctttccctgcaaagtggctgtgacgaaactttgaagcgcatgaaccgccattatgatacggcggagtatgctgagctttgtgagaagcttcgcaggcattttccaaactgcgctataaccactgacataatggtgggctttccccaggaaactgacgaggaatttgaaaagtcgctggcatttgcaaagaagatatcttttgcagaaacgcatattttcccgtattcacgcagacctaccactgttgccgacaaaatgaaaggtcagctcgaccgcaagaccaagcacagtcgtgcggctcaaatggcagatgtatgtaacgaaacaaaggctttgtatctcaaaagccttgttggcacagtgcaagaggttttatttgaaaaggaaacaagccctcagtggcatcagggtcatgcaccaaattatgttactgtgaaaattccaagggacagcgaggacgtttctttgcgccgacagcttttaaagatagagataacctcgtcagatggcgagttttgttacggaaaacttatatgagtacaaaaaagaggaccgcaaatgcgatcctctttcgttatatcagatttttctgtgctcagccaagctttgcaagaattatctctttcatttttccagggttagccttgccctttgaagccttcatgcactgacctaccagatagcccagagcatttgtctttccacccttgtagtcatttacagacttttcgtttgcggcaagaacttcgtcagcgatcttttcaagtgcgctgtcatcggaaacctgtgcaagaccctgttcctcaataatgtcgcttacctttttgtcctcttcaagaagaactgcaaaaactttctttccgccagcgttggaaatggtctttgcctcgatagcagcgacgaggtcagtaagattgtcagcagtgagctttgtatcttcgagagtcttgcctgttgcgttcatgtacttaacaaggtcgccaagtatccatgttgtatagcactttgcagggaacttgtcctttgccatgcaatcgtcaaaaagctttgcaagggaaacagactctgctataaacgttgcgtcctttatgttcagaccgaacttctttacatatctgagtatctttacgtttggaagctctgggatactctttttaagctcgtcaacacgctcctgctcaacaactatagtgagcaggtccggctcagggaagtaacgataatcctgtgcgtcctcttttgaacgcattggaatgctcattcccttttcgtcgtcccaacggcgagtttcctgctcgacctttccgcctgcttcaagaacagctatctgtctttctacctcgtagtcgatacctcttacagcggcagagaagctgtttacgttcttcatctcagaacgtgtgccgaatggctcgccaggcttgtgaacagatacgtttacatcacatctgatagagccttcctgcatcttacagtcgcatatgccaagatactgtaggatagatttcagtgtttcaagataaacctttgcttcctgtgaggaacgcatatcaggctcagaaactatctcgataagcggaacaccgcagcggttaaggtcaacaagtgatacaccatggaacttgtcagagtggagcagcttacctgcgtcctcctcgatgtgtattcttgtgatacctattcttctttcctcgccgtcaacaaggatatcaacataacccttgccgcagagaggaacttctgcctgtgatatctgataagcctttggcaggtcagggtagaaatagttctttctgtcctgcttgcagacacggtttatctcgcagttgagtgcgtgacccatccttattgcataatcaactaccttttcgttaagagtaggcagtgtgccaggcatacccatgcagatagggcaaacctgtgaattgacttcaagaccgaactggttcttgcagtcgcagtatattttagactcggtattaagctcagcatgagtttcaagaccgattacaacttcgtagccttttaccatttttgtgacccctttccttaaagctcaggcattttgaatccgccaacaagctgctcataagcataagctgtgttaagcagacgctgctctgtaaactttccgccgataagctgcataccaacaggcagacccttgtcgtcatatgcacaaggaatgcttattgcaggcagacctgcaatgttcactgtaacagtgcagacatcgtttgcgtacattttaagtggatcgtcagtgttttcaccgatcttgaatgctgttgacggaactgtaggagtagcgataacgtcaacgtcagcgaactgagatgcgaactcctgcattattctcttctgaacgagctttgctttcttgtagtaagcgtcatagaaacctgatgaaagcacgaatgtgccgagcattattcttctctttacttcgtcgccgaagccctctgaacgtgttctctcgtacatatcaacaagtccgtcatattcctcggctctgaagccatatcttacaccgtcaaatcttgcaaggtttgaagaagcttctgcagaagaaatgatgtagtatgatgaaagtgcataatctgtagacggcagagaaatctcctttacagttgcgccctgcttttcaagctctttcacagcgttcattacagactgcttaacgaatgggtcgataccctcgccgaaatactcttttggtataccgatcctcagaccctttacgtcagctttaaggtcagccgcaaaatcaggatactctctataggaagaagtagcgtcatacttgtcatgaccaacgatagcagactgtaccatagcaacgtcctttacgcacttgccgagaggtccgatctgatccagtgatgaagcgaaagcaacaagaccatatcttgaaacgctgccgtatgtaggcttcagacctacaacgccgcagtatgaagctggctgtctgatagatccgcctgtgtcagaaccaagggtaacgatagcctctcttgctgcaacagcggcagcagatccgcctgatgaaccgccaggtatcctctctgtatcaaatgggttctttgttggcttaaaatgtgagttctcggttgatgaacccatagcgaactcgtccatgttgagcttgcctgttacaacgatatcgtcaagcttgttcattacagttgcattgaaaggcggaacatagttaccaagcatttttgacgcacaagttgttctcagaccctttgttgagatattgtccttgataccaacaggtataccagccaaaggtgaaagctcctcgccctttgcaagcttttcatctatctcagcggcttttttcatagcgttttcttcgtcaagtgtcagataagcatctaccttgccctcaactgcttttattctgtcaaaaacagactttgtaagctctgcggagcttatttccttgttctttatcatttctgacaagtcgcaggcatttctttcaaaaagttccaattataacactccttactctactgttttaggcacgacaagacagcctgcctttacctgaggagcgttctgcataagctcctgtcttgtgaatttatcctgaacagccacgtcttttctgagtatcatcgggttgtcagggtcaagggtcatttcgtcctgaatgtcggggagcttttcaaccattcccacgatgttttccatttctgactcaaacttatcaagctgatcgtcttcgatgcgaagtcttgccagcttggcaatgtgtttaatgtcaatgttcattttacattcctcctgttttatttatataaaaagatattatcttattttatcatatccttgaactgttcttcggtgattatttcgataccgagctgctgagctttatcaagcttgcttcctgcttcctcacctgcaagaacatagtccgtttttttggacaccgagccgcttgccttgccgccgtatttctcaatgagtgcttttgcttcgcttcttttcagcgtcggcaaagtgcctgtgagaacaaaagtctttcctgcaaagcggtcgtctatctgtatcttctcatactttgtgtttatcccacattctttgagcctttggataagctctatcatatgctcttcatggaaagcgttgtaaacgctttgcgccattacgccgccaaagccgtctatctcggatatctgctctgcggaagcgttcatgatgttgtcaaggtcgccgaacttgtcgcacagaagcttcgcagaagcctgtccgatatttcttatgcccagaccaaacaccaatctgtccaaggaattggactttgacttttctatagcactaagcagattgttcactgatttttccttgaagttgtcaagctgtaaaagcttgttttcactcagggtgtaaaggtcagccacagaggtgataagcttgttgtcaagaagggtgtgaactatctgcggaccaagaccgtcaatgttcattgcgctctttgaagcaaagtgaacgatgcttctgaatatctgcgcaggacattcaacgttcggacaccttaccgccgcttcttcctcggacttcacaagctttgttccgcatacaggacagcactcagggagcgtgaaaactccgttgccatgcttttccacagagccaagtacctcaggaatgatatctcctgccttgcgcaccttgatgatatcccccacggaaatgtttttctctcttataaaatcctgattgtgtagggtcgcccttgaaacgctcgtgcctgcaagaaaaacaggctcaaacacggccacaggtgttatagcacctgttctgccaacgttaagctctatatcaagcagctttgaggtcttttcctcaggcggaaacttgtaagccacagcccactttggcacttttgcagtcgcaccaagtatctcacgctgtctgaaatcgtcaacctttataacaacgccgtcaatatcgaatggcaggtcaaaacgcttttctccgatagcctttatgcagtctatgacttcatcagcggtagacacacgcttgtaatcagggatagtcttgaatcccagtgttttcagatagtcaagagactccttgtgggaagtaagctccttgccctctatctgctgaacattgaacacaaaaatatcaagctttctttttgccgctatcttagggtctttctgtctaagagaacctgcggcggcatttcttgggtttttgaaaggctgctcgtcattatcctcctgctctttaacaagcttcagaaaaacatttctcggcatatatgtttcacctctgacttctatcaaaggcagttcctcatttatttttataggaatggactttacagttttcagattagaagtaacgtcctcgcccacaaatccgtcaccacgggtagaacctatggcaagctcaccgttatgatattcaagggataccgaaagtccgtctattttaggctcaacaacgaattgcggtttatcaacagcctgctgaactgtctcaataaagcttctcacctgttcaaaggaaaaaacgtcctgcaaagaacccatttgcacacggtgtgtgactttctcaaatattgatatcgccttgccgcctacacgttgagtaggggagtcgcttctgataaactgcggaaactgctcctcaagaccctttagttcctgctggagcatatcgtatttatagtctgtgatctcgttcctgtcctcaacatagtaaagctgagagtgataattcaaaagcttcacaagctcgtctatacgttttttagcgtcctgttcgttcaaaataacacaactccatttctgccaactttttacggcatatcatacgcagggcaataccacataaggattgtacgcaagatgcgtagccagatttttcgttagcttgtatagaaacgacgcaggaatacttccgtatttcaaggagtttctgtgcgagataacggaaaatctgcaagcagattgcgtgcaaagccgttaggcgtgccttatgcggtattgccctttatattataccataattgctggtgaaatacaagccttttttctataaactgcgaaaaaatcagccttttcccttgtctaagtacatatcaggtatctcccctacgataacagtttcgcttacgggatagtcatagctcaccacaatatccgtagagtgtgcaggaagaatggctgtcatttctatggtcacagtgagatagaggctgtattttgtctgatttatccctgcttccgttaaatcgcttttaagctctgtttttgccgcacctatctgatgaagccgcagtggtatgtcaaaacctctgcctgtgaggatatttattcctgaaagtgtgccgatgggtacgctgagttttgtaccctcaagctgtgaaaggttttcgttcacagcttttgaaacactgctttgaagcctgttcacagcgttcgtgtcgctgtttatggaggttatcctgccgtcagtttcggatatctttatataactgctctggggcagtttttcaagctctctgcttatggctgcatttatcacgtcaagtgccgcctgcttgctttcaaactcgcttatttcgctgatgtgccttgaaagctgtgcaaaaaacaccgtcgtgagcagtgcaagaataataacgacagcaagaattatgtatgaaattctgttcttgaaagaacgcttgtggacgctcaaaaaaatcaccgcctttggcttattatatagcaaaatgcggtgatatgtgattattttactttaattcaacgatagttacgccgtcctcgccctcgccgtaaacgccttttctgaatgattttacagacgggtggtgtttaagcgcacgccttatggcgtcacggagaataccagtgcctctgccgtggattatggtgagcatcgtcacccctgacatgatagcgtcagaaataaactgctccatttcatgaacgccctcgtcagcggcatagcccctgatatcaagctcggtggatacctttcttgtcatgcggctctcaatgccgtttttagatactccgccttttttcgcaggcttctttgtctgcttttgcggctgttgtttttcaataagctgaagcttctttacatctatcttggttttcattatgcctgcctgaatgaagcacattccgctgttgtcagggggcgttataatgataccctttctgtttgtgtcaacgataagcacgttgtcgccctttttcagcggtcttggcagcacatatccctcgttcctgctttcagaaacagggttagcctcgctgtaaagcttgttcattgtggacttctgcttgtgccttgcatcaatggctttctgagtgaagttcggattttctttctcttttctcagcttgtcaagctcatcaacaagcgcctgcgactcacgctgaacacgatttacgatctgctgagcctcacgtcttgccttttcaagctcggcttctttctgatcgtagaatttttctttctgctctgcaagctcttttctgagagcctcgctttccgcatggtatttctccgcaagcctgttgttttcttcaagctgtattcttgtgcgttcaagattgtctatgatagtttcaaactttctgttatcctcagaaataagcgactcagcgtacttgattatatccttgtcgataccaagactttcagagatagcaaaagcgttggacttaccgggtgagcctatgataagcctgtatgtcgggtgcaaagtctgcacgtcaaactcgcatgaagcattctcaacgtcaggagtgtcgatagcatacattttaagctcctgatagtgagtagttgtaactagcgtcgcaccgaatatccttatgcgttcgatgatagccaccgccagtgcagcaccctccacagggtcagtgcctgaaccaagctcgtcaagaagcacaaggctttcgctgtccgcttcgtcaagtatggtctttactctgcttatgtgagaggagaatgtagacagattgttttctatagactgctggtcgccgatatcaacaagcacgtttttatatacagatatcctgcttccgtctgacgcaggaatgagcagaccgcacattgtcataagcgtgagcagacccacagttttaagcacaactgtcttaccgcccgtgttaggacctgttattatcagggagtgatagtcagtgccaatagaaaagtttataggcacgacctttttggtgtcgataagagggtgacgtgccttgttcagcacgataacaccgtcattggatatctcaggaagcattgctctcatttttgctccgaggtttgcctttgcaaaataaaggttaagctctgttaccgcattgtagtttgaaatgagctggtctttcatttcggcacattccatggaaaattcagcgattatcctgtgtatctcgtcctgctcctgaccctgcaaaattctgatatcattgttggcttccactactgacataggctcgataaaaagggttgagcccgttgcggaggtgtcatgaacaagaccgctgacattgcccttgaactcagtttttaccggaagaacgaaacgtccgtcacgcattgtgacaatgctctcctgcaaatatttctgagtgctcggggattttatcatcttgtcaagggtctctcttatcttaagccctgaacgtgttatcttctgtcttatgcttctcagctccgcacttgcgtcgtcagaaagctttgtgtcatctatgatagccgtttccaatctctgctgcagatacttgtttggatagagcatttcaaagagatatgaaagggaagtgtccttgttctcgcactgctcataccagtggtgaagctcataggtctgcgcaagcaagcgtcttatctggataagctctccaagagaaagcacaccgcctgcttcggctcttttgatgtaagttgatacgtcatttatgttgtaaaaattcggcgtgccgtatctaacgctgagttcaagtgcttcggcggtcttgcctgtttctttcttgaccgtgtaaagatcagaacaaggctttatccccaaagccatttttttcgttttttcgttggagcattcttttgaaagcatttcaagaattttgttcagctccaatgaatcataaaatctttcgttcattatatatacctcaaaatatgacaataggcaaagctacgcaatgcctacaaaagtctgtaaaaatcaagcgacggaaacttgcctttcagattatatctaacaaaccgctctgtaaaagctgtcagttttttctgatatctttcgcttatcttgaaagcaaaaagccgctcatattccgtcagtgcaataaatcggactatgtatagcatagtcctgtctaattcaatatcgtaaatactgtcaggattgtaacagcatttgtcacactccaagacccctgttgacagattgaagtgcataatgtcagcttcatacgccatgcaaaccgaacagccaagaagcgcaggtcttaatcctgcttcacacagcagacgaaactcaaatatagatttgagaagttcgttatccctgtcgcccttatcgagaaaataaagtgtgttcagcgtcagccgcattatctcgtcacagccgctttcctctgttcgtatatacatgagaagctcagaaaagtaagaggcaagagccgtttttttagggtcgagcctgatgttgtaaaaaagcttctctgattcactgctgttgagaaaaaacattgattggtctttagagttcttcttttcctcaacgcacagcttagagtatgcaaaaagctgcgttgatgacgcatttttcgtgcttttcctgcctccacgaacaaatatatctatgactccacgctctgctgtgaggacagtgatggatttgcttgtttcacccctgtcattttccctcagtatcagtcccataaaggtcagcattgtcagtatcctcttttctgtgtgcggcatatgtgagataatcctctatcctgccgctttcaaagaacttgtcccataaagtcatgatattcaccgccttactgatattatcagcttttttggcggtcattataagcggaaaaatatgttgcctttattccaaaccgaaattctttatcatgccctcacggtttctccagccctcttttaccttaacccagcactggagatttacttttatctggaagaaatcttcaaggtcagctcttgcttcctgacctatctttctaagcatagagccgccttttccaataagaatacccttgtgcgactctctctcgcagtaaatagtagcggtaacgtcaagtatagcttcaccgtttctattttcacgctcgttgagctgttcaatagtcacagctatgccgtgagggacttcgtcattaaggttattgagtgccttttctcttattatctcagccattatgaccttttcaggctggtctgtgaatttatcatcagggaagtagtgcggaccctccacagcattcttttcaagatcttccataataatatcaaggccatccttttcaagaacgctcactggtacgatatctataaaatcataaagctttgaatactctgctatcactgcgataagatcctctttgttttcaagaagatctatcttgttcagcacaagtatcaccttagtcttgcctgtcttgaagccctttacaagctcacgctcgttttcggatattttctttgtgcagtcagccataaggataataaggtcaacccctgcaacagactcgttcacagcgttgagcatatgctcggaaagcttgtttttagccttgtgcataccaggtgtgtccatgaaaacgaactgcgtttctccatttgtgagaacacctgttatctttgttcttgttgtctgcggcttgtcgctcactgcggctatcttttcgcccacaagtgcgtttagcaatgaggatttgcctgcgttcgcacgtccaacaatggtgacgaacgcattttttgaatttgcatttttcttgttcatatatatttttccttatcttttttatctttgtcagcaggcgttttgaacacccatacgagccacagtatcacacctgcggctaaagctatccctagccatatgtttcttgcaaaataagaggctatagccataaaagcataatagtcccagaatatccttattcccacagccacagaagctaccgccgcaatgagaacagcccctgccgcacagtctttagcctttttagcaagggggtttttatctttacacgccatatccacagcggcttcaacagccgtgttcacaagctctagtgaaataacaagccctatgcagatataaactgcggcagtttcggcggcgctaagtccgtaaaatcgcataagcagtatcacaagcactgcaacgccaatgtgaaaacgcatattgcgctctgtttttatgcagctcacaacgccctcaaaggcataaacaaagcccttgaagaaacgtcctatccctgttttacctgtgttcatgctcgcctaagaaagtggcgtcacgggatatgcccagattgccaagtatagcttcttccttttcacgcattatcctctcctgaagattgctttcttcatggtcatagccaaggagatgaagcattgaatgtactgtcaaaaagcctatctctctttcaagagagtgaccatatatctcagcctgacggtaagccgtttcaaggcttatgactatatctcccagcaggaaagcacctgtttcgtggttcatgtcaaaatcaccgttctcgccaagaggaaagctcagcacgtctgttgagcggtctatgtttctatgctccttgttaagctcatgtatctgctcgtcattcacaaaagatacagaaacttcaaaatcatcattgtggccctcatattccaaaacagcatggcaacagcgtcttacaagaagccttatgccaacaggtatctttacctctgtctggttgttggttatcattacttttaccttgcccattactttttcacattccttttttgttatatttttcataagcaaggattatgtcctgcacaagcttgtgacggacaacgtccttgtcggtaaatctgtttattgatatatcgtcaattcctttgagtacgttcattgcctgaataagtcctgactttctctggtcaggcaggtctatctgcgttatatcgcctgttatgactatctttgagttgaatccaagacgtgtgaggaacatcttcatctgctcgtgagtggtgttctgcgcttcatcaaggataatgaaagaatcgtcaagagtgcgtcctctcatgtatgccagcggagcgacttcgatacagccgcgctcctgctgtttagcgaaagtgtcaggaccgagcatttcaaaaagtgcgtcataaagcggtctgagatatgggtctaccttacattgcaggtcgcccggaagaaagcccagtttttctcctgcttccaccgcaggacgtgtgaggattatcttctctacctcgtgcgccttgaaagcctttaccgccattgccaccgcaagataagtcttgcccgttcccgcaggaccaatgcccatgacgatagtctttttccttattgcttcaacatatcttttctgaccgagagttttcggcttgacgagctttccgctcaccgttacgcacactccgtcatcagacatatgctttatctcatactgcttgccctcacgcacaagtgtgaaaacatatcttatagtctgctcagtgatagcctcgcccttgttgataagagcaataaggctatttatagcttccgaggcgttaaatacgttctcctcgtcgcctgttatcttgatatcgtcacctctgccgagaatcacaacattatactctttttggataagattaacattctcgtcataattgccgaaaaggctgagtacagtttccattctgtccacgctgataagtttttccgccattagcacaacttcctcttttttttgttctgatatacctattatacaaagctattatatcacatttttcctctgattgcaacaatctcagtaagatttaacactttttttatgcaccttttcacactttttgatcatttcttaataaaaaattccacctctctgcaaagctcgccatatagggtgtatgttacagtagcggttactccgttttccgtcacattatcctccgcttgccggtctttaatctcatagtctgagagaaaattttcctcatataaatacgccttttcatgaacggcgtcaagtgcctgctgttctgttagggtgtcttgtgaaaatttatattcttcaagttcgcaggtggttatgccaaaaggcatttcaagcccgaaaagcgacagaggagaatatctctgctcatttttccagtaaccctcaggctttgagaaaaaaagagggatatcagcgtcaaacacagtgaaaaaacgctttgtatctttcttgcctgtcgtcttttctgccttgttctcaaagggctgtgtgaatgtgacagtgcgctcaaaagtgcctagtatcttaccctttgagcgtgcatagcttgtctttgtttcaacgttttccttgccgtctatccagcttgattttgatgtgatgatctcacctcctacaacgatatcgccctttgtcacaccgcttcccacaggtatctttagctgtccgtcataaacctcgattttttcgataactccgttttcgcaggcaacaagatttgagggatagcggtttgactcacgctttgtgtcgccctcagtttcgataacgtcgattatcagcgtgtcacccttgcgtgttatgcctgcccatgatatgccctccactttttgctttaacgcacgttctgtgactatgagatcaatgcttgggatataagtgccggtttcaacgccctcctctttaagcaccgacataacgccttttctgatattttcatcatcactgagtatgtcaaacctcaccaccacgtttgatagatagaagcatgaaagcatgacagccgcagtgcctatgacaagtcctcctcttccgaaaaaacgttttgcaagaacaaagcttccgtgacgttttgtggcggtgtattcaagcccaagttcatcgcatagtctttcaagtgccttacagtgttccgcaggcatacgcaaagtgagctttccgttcttttcacacattttgctaacgggaagcttttttgacattatcctgcggaaaaacttggtaaagctgtcccctgtgataacataatctatataaccgaaaatcattattctctctccctgatacttcttgacacaagcttgaccgactctatttttcctcttatctccacgctgtcggagcagaaatttgacattgttagtccgctgccccatatctctatctcaaaagagcctgtcagcacctttgccattatctcactgcactcaactatctgcttgcagttttcgataacggcggctctgtcgtcagttatgcttatgtatgagcttagtgcggtcaattcttttgtcatgccgaaaaagcttaaaaatggtatcttcttcatttttgcgtcctccgttcattgccttatgcttaattatattattggacagactgacatatacttaaaaagtaaaagtagggaggtaataaaaatgttgaaaagacttgcaaaggagctttgcgtatacatacttgcgggggtggtcatatggttatgcattatcaccatatcaggtggcgagagcgtaaagcttggtatctccgaagcagttgaccgctgtatgaatatcataatcccgtcgctgtttgtttttatggcgctgtcgcagatacttgtttcaagtgggctttactactgcgtttcaatgcctttttatcctatatcgagatttataatgggcataccgcctcagcttttctttgtatttcttcttggcaataccgcaggctatcctgtgggagtgaagcttctttcggatctgtgtcagagaaagataatatcccagcgtaccgcaaagataatgtcatgcttttgctgctgtggaggacctgctttctattctggtacagtgggtcttgcggtgtttggttgtacaggagcaggcattgcaatgttcgtatccatattagcggcaaattttctcactgcacttgttctcggcagagctataaatgaggataagaaaacatcaaagccgactttaagacttgacggcagaatgttcaccaacagtgttatctcagcaggaaagtcactttttgttatctgcgttatgatagtcttttttggagcgtttatgtcctctcttgaatactgcggagcgttcagctttttgaaagatgtgttttcactgtcagaaaacggacttgtgcttgtgaaaagctgtcttgaaataacctctctcactgagctttcgggaagtccattttatcttctgccatttatagccgctgtctgctccttcggtggtctgtgtgtgattatacaaatatctgcacttggcgtggatttctcccttgtgccgttttttatctcacgtttgacatcagcctttttgtctgctgtcatatgccgttttatctatcctttctttattcctgattcagttttgacttctgttacaaataatgttaaattcgtcaaagtgaacaattttgttccctcgttttgcttgattatgatgattttattactaactttgaagaaaagactagcattttctaaaacagtatgatataattaataacaaatgaaaaaagattaacttatcttaaaggagttgtataaatcatggcaaagaagagctattttggtaacagaatttcaccgtcatgttcttactgccttttcggcaacagatcaagagaaggaaataaggtcctttgtgagaagcagggtctggtagacgctgattatagctgtaagaagtgggtctatgatcctatcaagcgtgttccaaagaaacagcttaacattccaaatcaggaagacgatgttatctgatacataaaatatgccgtacattttttggtgtacggcttttatattgcaaaagatccgcagagcgttttgtttcgccctgcggatctttctatcttatatccttatatcttttttatcttcgtgtaatttgccattatcttctttgtgccacgattatcgaatgctatctcaacaagagtatcgttagccataggctttgaacttaaaacagtgccttcaccgaatatcttgtgcaaaactctgtcgcctggtgcgaaagtttcagtattaacagaaaaattgctcttatcagcctttcgctgagccaattgctgttgcaggctcatgctgtgaggcttttcatagccgttgagataaggtgaagccttagtttcctcggcttgcttttctatgcaatcggcaggaagctcttttataaagcgtgatatcctgtttctgtcagtgcgaccgtaaagcatacgttcctctgcgtgggtaagataaagcttttcctttgctcgtgttaccgcaacataggcaagtctgcgttcctcttccgtgtcagcttctgattcaagacttcttgatgacgggaagatgttgtcctccatgcctaccacgaaaactatggggaactcaaggccctttgcagagtgcattgtcataagcacaacatagtcagcgtcagagtcgagattgtcaacgtcagtgtaaagtgatatttcctccaaaaatcccgacagcgacggctcgtcagcattttcttcgtagcttgacatggtggatttaagctcgttgatgttttcaagacgtgtaagaccctcgtcgccctgcatttcaagatgacgcttgtagcctgtcatatcaagaagcttgtccaaaagctccgcaagtggcagagtgtcagaaagctcagtaagctctgagagcatatcgcccacaggcataagctgttttgaacgcttcacaaggggagcaagcatatcggcttcctgcatgatgtggataggtgaatccccaaggtctgaggttatctgctcaagagcgtttacagtggcttcgccgataccacgtttcggctcgttgattattcttctcagacggagaaagtcaaaatggttgtttattacagaaagataagcgaggatatcctttatttcctttctgtcatagaatttcagaccacctattattttatatggtattccactttgtatgaacgtctgctccaaagcgttcgattgtgcgttcattcggtagagtatagcatggtcattgtattttctgcccttgtttatgtcctctaaaatagtgtcagccacgaattttgcttcactgcgctcgcttgaagccttgtatactgttaccttttcaccgtcacccgaagctgtccacagatttttgccctttcttccctgattgttgcttataagttgatttgcgcagttaagaatgttctgggtcgagcgataattctgttcaagctttataacatcagtgtcagcattgcagtcgaactgctcctcgaagttgaggatgttctcgatagtcgcaccacggaacttgtagatactctggtcgtcatcacctacaacgcacagattgtggaatttctgtgacagtagcgaaacaagtctgaactgagccttgttggtgtcctgatactcgtctaccattatatatttatacaagttctgatagtggtcgaggacgtcaggaaactgctcaaaaagcttgactgtgtggcagatcatgtcgtcgaagtccatagcgtttgcggctttgagcttcttctgatagtgcttgtataccttgcctatggtcagattacgataatctcctgcggctgaggcgatatattcatcaggctcttggagcaggtctttagcgtgggatatctcgctgagtatcgttctcggtggaaacatcttctcggatatgccaagctctctcaatatgctttttacagttctctgagaatcgtctgaatcatatatggtgaaactgcttgaaaatccaagcttgtcacattcacgcctgagtatccttgcgcaggctgagtggaaagtcgccgctgttatgccttgacctgcctctcccaacattcctgcaagacgttctttaagctcgcctgccgccttgtttgtgaacgttatagcaagtatgctccacggctttatgcagtcatatgccacaatgtctgcgagggtagaagcgtcatttgtcttgccatcaatgtagtctttgagaaactgtatgtcctgctcagagggcgtgccgtaggtctgctctgtgttgtatgcgttgccgaagtatatcatgtttgcgatgcggtttaccaaaacagtggtcttgccgcttcctgctcctgccagtataaggagaggaccctttattttgaacacagccttgcgctgttggtcgttcattcgtgaaaaatatttttcaagtgcttttcttttaagagccgtaaactgctccattatatacacctccgtaaaatttcttttatgccgtaccctacattatagcatattttttctatcttgaaaagggcggcggcaaatttttttcacatgaataacagtgggtatgttttccaataatacattaaatcaaatattatgaacggaggaacatatatgaaagctgttgttttatgcggaggacgtggagaaagattgatgcccatgacagacagacgacctgcggctcttctgagattatgcggaaaagaaattttgctttttactcttgaaatgctggagaaagcaggctttgaagaagctgtccttgcggtgggctatggctctgaacaggtagaaaggcttcttgatgaaaaatactcaggtaagataaagctccatatgataaacaccgcaggcaaaagcactgtgcaggctgttagaacagcaatgtgcgatgaaacagaaattcttgccgtggaatgtaactgtatctgcactcaccctcttgatgagattataaaagttcatttgagccacgataccttttgtacggctctgacttatgatactgaaaacaaacctgctggcatatatatagtgaaaagagagctttttgaaagtcttaatcctgaaaagcctacggatatgacggaggatattatccacgaagctgtgaaaagtggcgaagctgtcctgcttgacggaaaaggctattataaaaggataaccacgcctgaggcttttcttgattgtcaaaggcatatgctttacaacgaaaatatgtcacaaaggctgacggaaaataatttcagcggtgcggcaataggtgagcctgtttatataggagagaacgtttctgtcatgtcagggtcggtcatagaaagcggaagcgtcatagacaataacgctgttgtaaagggcggcaaggtgaacggatatgttggcataggctcggtggtatctgaacgctgtgatataaacagtgcagtggtatgccgtggtgctgtccttgacagcggtgtgaagtgcggtgaatattccgtcataggcgaaaaggctcatatcgcaagcgaagccgtcattgaaaaaggcgtgggcatatggtctggaaaaaatgttgaaaagggcgcaaggctttatgaaaacgtgaaaagatcatctgacagccgacttgtcatagacgaaaacggcgagtgcagtttgtggggcggtgaaaccacagcgcaaaaggctatgctttttggactttgtgccgcaagcgctgcaaaaaaaggcggaagtatagtgacagcctatggctctgacgaaagccttttgctcaaacaagcccttgactgcggcatatgtcaggctggagtgaacgtgtacagtataggcagagcaggcatttcagagctttcttatgctgtgaacagatttggcggagagtttggcatactcataggcgcaaacatttcaggtcatgcatggcttatttcggctggtggaatgttgcctgatgaaaagcttcttgaccgcattggaagcatagctgacgacagagcttatcgcagtgtggggctttctcagacgggttgtgtgacagatttttcagcggtgagggagatatacgtcgcagagcttgaaaaaatactccctgaccgatttaaaggcgtaaatgtggatatccgcacatatgatgttaaaaaggcgacccttgccgacagactctttcacggcaggaacgatatagacggagagcgtataatattcaatctttccgcagacggcacaaaagtatcagcttacagtgagaaaacaagctatgtcatgtgggaaaagctggtggcaatgtatgcaggggtgtgctttgaaaaggggcttgcggtggcattgcctgagaatttcccctctattgccgatgccgctgctgaagaccactgtggcaggctttaccgatacgaaaacaatgctgacatagcaaaggacgttgccgtttcgacccataatatgtttgcctatgacggactttaccttgcgtcagcggtgacgtcttatctgtcagagcaggggataacgctgcaaaaagctctctgtgatgtgcctgacgcatacacttcaagccgatttgtgggcataacaatgagccgtgaaaacaaggaaaagatattttcagagcttggctgttcggcagagggagagataacaaggggcaagacccacgcagttatcagaccgctgagggataaaaaaggtataacagtgtttgcagaaagtgtgagctgcgagcaggcggctgccttttgcgaggatataacaagcaggataaagggcatatttagataaatgtaataaattgctattgacattgaggcgaaaatggagtacaatataatcagatatttttgttcggacaaaggcggctcatgccgctgtatttaaactgcgttcatcacaacattttgtctttctttgaggctttaagcgtttttgacagcacatgataataaagcccaaacgcagcggtatattgaatctaaacggaaaaatcgaatattatttgagcatgataaaatgcagcaggaaggagataattgctcctgccgtatgtttgtgctgcttttttgcggcattttgtgcctttgaaggcttaaaagcggagtacagcagggcaaagtacattattttatgaacggaaagaacaacacagtaaaaaatcctacacaaaaacgttttttcagaaaaaaacagaataagagcgagatacctctggctcaggcttcaaaagagcttgaccgtgtaaaaagtcagagagcttcgggcagtgtgaaaaaaacgcttcagccgagaaatgaaactccacagagaaaaccgcagaatactcagcaaagacgtccaagacctgcggcgaacagagtgaaagagcctgtaagaagaacgcctgtgaagataatcccattgggcggtcttaacgagataggcaagaatttcactgttatcgagtgttcaaacgatatgttcgttatcgactgcggtttggcattccctgacagtgaaatgcctggcgttgatatcgttatccctgatttctcatacgtcgagaaaaatcaggaaaagctcaggggcgttgtgcttacacatggtcatgaggatcatataggcggtctgccgtattttctaaaaaaattcaacgtgcctgtttacggcacaaggcttacgcttggtcttgttgagggcaagctgaaagaacatggacttctaggaactgtaaaactcaacgttgtaacgccaagacagacagttaagcttggctgtatggcggtggagtttataagagtaaatcactctatccctgatgctgtgggaatggctatccatacccctgctggtgtgcttatccatactggcgactttaaggtagactatacacctatcgagggcggtataatcgacctgcctagatttgcagagcttggaaacaagggcgttttggctcttatggctgactctacaaacgctgaaagacccggctataccatgagcgagcgcaaggttggcgaaagctttgtgaagcttttcaacaaggctgagggcaagaggataatcattgccactttcgcttcaaacgttcacagagttcagcagataataaataacgctgtcacacacggcagaaaagtggctgtgtcaggcagaagtatggtgaatgttatctcaaagggcatcgagcttggctatcttaaagtgcctgacggcgtgcttgtggatatcgacactatatcgagatatgcacctgaaaaaatggtcatcgtcacaacgggaagtcagggcgagcctatgtcggcgcttacaagaatgtcggcaaacgagcataggaacgttactatcactcctatggactttatcataatctcggctaatcctattcccggcaatgaaaagtatgtcacaaaggtagtaaacgaccttatgagattgggtgcagaggtaatatatgagtcaatgtacgaggtgcacgtttcaggacacgcttgtcaggaagagcagaaattgttgctttctatcacaaagccaaagttctttatccctgtacacggtgagtataaacatcttatgaaacacagagatacggcactttctgtgggaatccctgagagcaatataatcattgctgatataggcaacgttatcgaaacagacggcgttgacatgaagataacaggacaagtgcctgcgggcaaggtacttgtggacggtcttggcgttggcgacgttggcgcaatagttctccgtgacagaaaacatcttgctcaggacggacttattattgccgtggcaactatcgacagggcttcgggagatatacttgcagggcctgacgtggtttcaagaggctttgtgtatgtaagagagagcgaggagcttatgactgaagctcagaagcttcttaccgaaacacttcaggattgtcttgacagaaatatgaaggattggaataccataaagggcagaatgaaggacaatctttcggactttatcttcacaaagacaaagagaagtcctatgattttgccgataataatggaattatgaccgcctgacaacagtgcggttgtttatagaaatgcaggagctttaaaatgaaaagtaacaacggattacagatcataataagaataacagtgtgcgttaccatgctttcgtcacttataggcgcttttatgctgcattctactccgtctcacagagagtcgggcagtgtgcttatcctagtgtctgtggcggcggctgtattgtgggtgcttgaagaagtggttttccacaatcacactcgtaagtatgtggcaaagctttccacgatgatctcaaagacggagagagattctctcctgaattttcctgctcctgctataataatcgacagcgaaaatataatcgtgtggtataacagactttttggcagacaggtctactctgaggaagaggcttacggcattgacctcactgagcttatgaacattgatatggacaagatatattcctctgacggcgaccttgtgtgcataaacgcccatttttataaggcaaaggctatacacaccgatgtgaacggtgagctttcaatggtctatttcaatgacgttaccgattatgtggagcttgaatatgagttcagaatgtcccacaaagcggtaataatcataactatagataactttgacgagcttatgtcaaatatcagagagagcgaaaaggctcacgtggttgttgagatagaaaagctcatagaggaatttttggagaatactactgcggtgtcaaagaaagtagcaagcgacaagttctatgtttatatggaggaacgccaccttgcacctataatcgagcagagatttaagatactcgagcaggcaagaaaaatagccgttggcgagcgttctaaccttacattgtccataggtgtgggcagagatggtgcaaaccttgcggagagcgagaagtttgcaaagcaggctctcgaaatgtgtcttggacgtggcggagatcaggcggctgtcaaggaggacggtgagttcaagttcttcggcggcatttcttctgcacctgacaagaacaataagacccgtatccgtatggtggcaaaggctatgctggagcttatctgcaaccacgataaggtgctcataatgggtcaccgatttggcgatcttgacagcgtaggctctgcaacaggcttctgctgtgctatcagaaacatggtaaaagaagcttacgttgtggtagaccctgagcagaatttgtcgaaaacgcttataaattacataaacgaaaacgagtcagagcattattacataacccctcaggagggtcttgaaagacttgacgataacacgcttcttgtggtaactgatacccataaccctgcactggtggagtcaaaggagatacttgcaagggcgaaaaatgtggtagttatcgaccaccacagaagaatggtgaacggtatcgagccgactatcatgtcattcttagagccgaatgcgtcatcagcctgcgagcttgtgaccgctcttatcgagtatttcggcgaggattccaatatcacagtccatgcggcggaagctctgcttgcgggaataatgctggatacaaagaatttcattatgaaaacaggcgtaagcacttttgaggcggcagcatttttgaagaaaaagggcgctgataccatagctgtcaaaaagctttttgcaaactctatcgagacttatcatcaaaaatcgtcgcttataaacagtgctcacctttataaagagtgtgcagtggcttatacagaggaaagcttctctgaaataagaatagcggcttcacaggcggcagacgagctgcttggtataacaggcgtaaaagcttcgttcgttatctatgaaacgaacggtgtgataaatatctctgcacgaagcatgggtgcttgtaatgtgcagatcgtcatggagtctctgggtggcggcggtcatcttactatggcggcaactcagctcaactgttcaatgaatgaggcgagaaaacgccttgcagacgccattgacgaatactgggaaaataattcgcaggaataaaaaaagaaaggcagagtgaataatatgaaagttattttgttaaaagatgtaaagggttcaggcaaacagggagatatcatcaacgttgcagacggatatgcaagaaattttcttatcggaaagggtcttgcacttgaagctacagctaaaaaccttaatgaccttgcaggcaaaaaggcttccgctcagcacaagatagatgttgaaacagccgacaataaagctatcgcagagaaaataaaggataaggaagttctggtaaaggctaaggcaggtcagggcggaaagctctttggcgcagttacagcaaacgttatttcagattgcctcaaggctcagtatggcgttgttatcgagaagaagaagataaatcttacagccgagataaaggctttcggtgactatactgcacagataaagcttactcatggcgtatcatgcagcattaaagtaaaggtcgttgaggagtaatcatggctgataatttccgtgggcttaccacaggagcgacccttggcagggagctgcccttttctcaggaggctgaggaagccgttctgggaggagttcttcgtgatccttcggtgcttccgaaggtcattgagatactaaagcctgaaagcttttatcgtccacagcaccagcagcttttcaccataatagtgagaatgtttaccacaggcagcaaagaggaccttatcacggtaattaatgaagccgtcacaatgggtgtttttgaaacgtctgcaatggctaagaattatcttcttggtattatggaaatggtgccgtcaacggataatatcgagagctattgcaagataatcgaggaaaaagcaagggtaaggtcgcttataaatgccgctaatcagatccttgaaaaggcatatgacggcgttgaggattctcagacgcagcttgacgctgccgagcagtctatatttgagataagacagggcagagatgttcagggtcttacacgaataagcgacgttatcgttgatacattcgagcatttgcaggagatatcaggtcctgacgcaggcgaacatcttggcgcaaagacaggctttggccagcttgacgcaatcacaacaggtcttaacagaactgaccttatcattatcgctgcacgtcctgcaatgggaaaatctgcatttgcgcttaatattgcggtgaatacctgcaaggcgacaaagcgtgacgttgttatattctctctcgaaatgggtaaggaacagctcgtgtcccgtatgctcgcttcagaggcacttgttaataataccctgcttaggtcgggcaatcttgagccttccgattgggagaagatagcaggtgcggcagatacgctgtcacagcttcctatatattttgatgacggtgcaggctgtacagtgccgcagatgaaagcaaagctcagaagaatgagaaatcttggacttgtggtcatcgactacatacagctcatgcaatcagcaaataaaaacgccagccgtgttgaggcggtgtctgagataacacgttcattgaagcttatggctaaggaacttaatgtgcctgttatcgcactttcacagctttcccgtagctcagagaagcgtgacgataaaagacctatcctttctgatctgcgagaatcaggttctatcgagcaggacgctgatatcatcatgttcctctatcgtgacgcttactacagcgatgagggcgacaagtcggtggctgagtgtatagttgcgaaaaaccgtcacggacagacagataaggtgcagcttggctggataggcgaatataccctgttcagaggtcttgatttcaggagagatgatgaataattttcttgtaaaggtagcttctaccatagagaaatttaatatggcaaataagagcgaacgcttgcttgtgtgcctctcaggaggtgccgacagcgttacgctccttttgtgtttatatgagctgggctatgatgtatgcgcttgtcatgtcaatcaccacctccgtggggaggaaagcgacagagatcagcatttttgtgaaaagctttgcgagaagcttggggtcgagctgaaggtgtttcatgccgatgttgtgggctattgcaaggaacattctgtatccactgaggagggggcaagaaaacttagatatgactttttcgacagtatcggcgcagacaagatatgcacagcacacagtctttcggactgccttgaaactgccatattcaacctcgcaagaggtacaggtctgaaaggtatttgcggaataccgcctgtgaggggaaatatcataagaccgcttataaattgtactcgtcaggaaatagagggctttctcaaagagagaggacaggactttgttactgactccacaaatcttactgacgattataccagaaataagattcgccaccttgttgtgccaaggcttgcggagcttaacagttcgctttttggctcatattccatgacagctgacaggcttagaacagacagcgactatcttgaaagtcaggggcttggagcctttgagaaagcggtcttgccaaagggttatgacgcattgtgcctaagacagctccatgaaagtgtacgccgtcgtgcaataatgcacattcttgagaaagaggggcttactgtgagccatgatagtattgaggatatcgacaggctgatacttgatgttggcaaggcgaacatcaagggcggagtttttgcggtctgctcaaaaggtgtgctcagctttgcaaagggcgagatgcttgaaaacagcactctcaggagcgttaaggtaagcgacgagggcgtttatcagttcggcaataaggagatagagttcaaattctatccttttggcggaaaaatcgcaaatgttcataaaaagtttgcaaattgttgcctggattatgataaaataaagggtgagattgttgtcgaaaatcgcagagagggcgagaagatacgccttgtgaacagagattttgacagcgatgtgcgaaagctggtgaacaagtccttcagacttgaggacaggggcagtgccgttatcctaaaagatagtcagggcgttgttttcgttgaaggaagcggtgcggctgaaagggtgaagatagactctgaaaccgttaaaatattggcttttaccataaagtgagatgaatatcaccctaagctgaaaagttttttgtgtgaacttgtattttttcacttttctgtcacattgataatatataatcagagaggttgttagttaatgaacaatatatcggttctttattctgaggaagagcttgcattgtctgtgaaaaagcttggagcagagataactgaagagtataaaggaaaaaagcttcttgttgtgtgcgttcttaagggagcgttcgtgtttactgctgatcttgtaagaagtatcgacaacgatatgcagatcgcttttattactgcaaagagttatgttggcacaagctcaacaggaaatgtttcaatttcaggagatcatgattttatgggtcttgacctgagagagtgggacgttttattggttgaggatattctcgacacaggaagaacgctttgcgagttaaaaaagaagtttgcgtcaatgggtgcgccaagtgttaagatagctgttatgcttgataagccgtcaagacgtgttgcagacataacacctgatttcaaatgctatgagatcgaggacagattcgttgttggctgtggtcttgattatgatgagagatatagaaatcttccttttatcggtatagtttccgaataaggagccaaatataatacagaacaaaaggttgtgattgattgaaaaacaataataatggaaagaccctgttgatctatctgctggtatcggttgccataatctgcggattggtctatatgctaacaagcatgagcacaaaatcttccgacaaaaaatattcggagataatggaacagtttgacagcctgaacgtgtcacagtttgagcttgatcttggctccggacagcttaagtataagctcaagggcgaggataaggtatatagttatacagttccaaatgtttcactgtttgcaaatgaagtccttggcggtgaggatgctgagaactatcgtaagaaatataatactgaaaatccagacgatcctttgcagtataatcttataccgatatcggataacagcttctggctccatctgataccgacgctgcttatgcttggcgttatgatattcttctttgtgttcatgatgaagaatgcaggcggcggaaagatgtcgtctttcggaaaaacaaatgccaaaatggcaccaagcagcaagaaagctacctttgatgatgttgcgggtgcagacgaggaaaaggaagagcttaaggagatcgttgattttctccgtgataataagaagtataccgagatcggtgcgagaatacctaagggcgttctgctcctcggccctccgggtacaggtaaaacgcttctcgcaagagccgttgcaggcgaagcaaaagttccattcttctcaatctcaggttctgacttcgttgagatgtttgtgggcgtcggtgcttcaagagtaagagatctttttgagcaggctaagaaaaacgctcctgctatcatctttatagacgagatcgacgcagtgggtcgacagagaggcgcaggccttggcggcggtcatgacgagcgtgagcagacccttaaccagcttcttgttgaaatggacggctttgaggataacgattctgttattgttatggctgcaacaaacagacgtgatatacttgaccctgcacttcttcgtccgggcagatttgaccgacagatacttgtgggctatcctgacgttaagggcagagaagctatactgaaagttcacacaagaaataagccgctcgctcctgacgttgaccttgaaactattgcaaaatcaactgtaggctttacaggtgcagaccttgaaaaccttgtgaacgaggcttcgctccttgcggcaagaaagaataaaaaggctatcacaaaagatgagcttgaggaagcttctataaaggttgtggcaggtcctgagaaaaagtctaaggtcatcacagaggacgaaaagaagcttaccgcttatcacgagggcggtcatgcgctttgcacatactacagcaaatcacaggataaagttcatcaggtatctatcatacctagaggtcaggctggcggtttcacaatgagcctgcctgtcaaggataaatcttatgttagcaagaacgagatgtacgaaaatatcgtggttcttcttggcggacgtgttgctgaaaagctgattcttgacgatatctcaacgggtgcttcaaatgaccttgagagagctacttccacagctagaaacatggtaacacgctacggcttcagtgacaatcttggccctgttgtatacggtcagggcgatcatgaagtatttcttggcagggattacactaatacaccaagctactccgataacgttgcggctgagattgataatgagataagaactcttattgaaagtgcatttactgacgctgaaaagatactcaacgagcatatggataagcttcatgttgtggctaagtatcttatgaagtatgaaaaggttgacggtgcaacatttgagaagcttatgaatggcgagcttacagaaagcgagtttatgggcgaacctgataaaacaccagaaatccaggatactcctgagatagttgatgatatttcagttgacgataattgatacggaaaatcagacgtgtaaaagcgtctgattttttttgtgatgtctgcttgattttgcagtaaggatagtgtataataagggtaactgtaaaatgcagtatagaacggagatagcaaatgaacttactttttatcggagatgttgtgggacaaagtggctgcgattttcttgaaagcagaatgtataagctgaagcgtgaatatgatatagatgtgaccgtggtgaacggtgaaaattctgctcagggcaatggtatcacaccgcagtcttacagacagcttctcaacatgggggctgacgttgtaacgacaggaaatcattctttcagacgacgtgaggctgaggagctttatgacacaaacgagcaactattaagacctgccaattaccctgagggcgttatgggtcatggagtgacttatatcgatatgtgtccttataagatagccgtggtaaatcttatgggaacgatgtatatggaagcagtggaaaatcctttcaactatgttgacaagcttcttgaaagcattgatacgcctaatataatcgttgattttcatgcggaggcaacttctgagaaaaaggctatgggcttttatctgcaaaaacgatgcaccgctgtgcttggcactcatacccatgttcagacggccgatgaaacgatcttaggcggacataccgcctatatcaccgatgttggaatgacaggccctgagctttccgtacttggggtagacagtgatatagtcataaataagttcaaataccgcacccctgtgaggttttcagaaagcaccaacgattgctttataaacggagttgtggtaaaatttgatgaaaaatcgggaaaagcaacaaatatacagcgtgttattaagcgataataacgaaaagtattaataaagcttgaaattttattatgtatgtagtataatatagtgtgtataataagtggggtaaattctttgaatttacttatggaggtattcaagtggaaattctaaaggtttcttcaaggtctgtccctaattcagtggcaggagcagtttcgggcgttatccgtgacagcggtgcagttgaggtacaggcagtgggcgcaggcgcagccaatcaggcgatcaaggctatagcgatcgcaaggggctatcttgcaccattgggcattgatcttatttgtatccctgcatttgcaagcgttttgatcgacggtgaggaaagaactgcgatcaagcttatttgtgaagaaagataataatgcggcagcaaggcgtgttaaagtcttgctgctttttgctacaaaggaggggacagcatggaaactgttttgcagacttatgggcttacaaagcagtatggaagctttacagcgctgagcaatcttgaccttgcgctggagaggggtaaaattattggtctgctagggccgaacggaagcggaaaaacaacatttatcaagctttgctgtggactcataaaacctacggcaggggatatactcatatgcggaatgcctattggcgtggaaactaaaaaagtggtttcctatctgcctgacagaaatttcatacctgacgatatgaaagtaaatgagatgcttaggttttttcaggatttttacagcaatttcaatgtatcaaaggctcaggatatgatgaacaggttggggataaaccctgcggcaaagttcaaaacaatgtcaaagggcacaaaagaaaaggtgcagctttgtcttgttatgagccgtgaggctgacgtttatcttcttgatgagccaattgcaggcgttgatcctgcggcgagagattatatcctcaacaccataatctcaaattacaacgagcgggcggctgtggtaatttccacccaccttattgcagatatcgaacctgtccttgacgacgtggtgatgatacaaaatggtatgctaaggctgcataaatctgttgacgctatccataacgaaaccggcaagtctgtggatcagcttttcagggaggtgtacagatgttaggcaagcttttgaaatatgagcttaaacgctcggcaagaaaatttttccctcttgtggtgggatatatgatagttgcactgatattttctctgatgctccgttatggtgagagcgttaaaagccctaattttctgatgatattcattgttgtgagcattgcctatggtattgccgtgggggctttgttcactgtgggttttaccatatcgctgacgaactttcacaagacccttttcactgacgagggctatcttatgctgacaatacctgtcaagccatattatcatattttcacaaagttcatctcttctgttatatggtcggcggcaagcatgatcgtttttgtgctttcgctgttgcttatcgacccaacagagtatcttgactctgtgggagattttataaacgctttgggtaacggctttgctgaagaaccgctcacttcgtttctgatatgcttgtatactctgacgctgtttgcaggcttgcagatattcttatattttgttatctccctttcaaactgtttcaagcacaaagttcttgtaggctttgctataatcttcgcttgcaatatgttatcctcgatgataagcaatctggcaggcgacctttctctgtggaatatgctctttatgccaacgtcacgcttgcccgatacagaagcggcattcaacctaagacttgtgtttatgacaatgtatcagttcgcatatatcttggcatatttcctgttgactaattttataataacacgcaaacataatttgcagtaaaaaaaggcagacgatgagtctgccttttttgtgttgtgatctttagttaagtatccaaatctgagctgagttttcaggctcaaggtcagcgaaggagagctttccgccctttgagtttgcaagcacctttacatagtctgtggactcagtggatattctgaaacgtctttttcccagcgcagtgaccctgaactgaacaggcttgccgtctattttcagatagtcatagcccttgcatgaagcgtttacatatccgccgtcgcctatctttaaaccgaatgtgccgtcctctgtaagacagaccgtcagcttctgttcaagctccttgtcaggtttttcaagctgcaatccctttggggtaacagtgaggataagtcccgatatctcgtttttgaaagtgtaagccttgccgtcaagtatgtaattgccagcgtcagcggtgcaatcgtcatagaatttcagaagaagcgctgtgacattctgctgtgtgaccggcagagtgttctttgcaacgtcatcaaaagctcttgggtcaaggtgagaaatggtgtcaacgaacttgcctgcatattttacaagcttgtttgaagcctcgccaaagttatctttgccgtagtatttcagcagacgcttgtcaaagctgtcggctgtgtgtcttgtgcaggtggtggaaacgtgcttctcaaaagcgtaatgcacgttgtttgccttgtcctgatatttcatgtttgcaacgtgaacagtgcagcccatgtctgaaataaaatgtgcggctctgccgagaacacgcatggcgttttttatgtcaccgcttttgtaaagagatactgcggcggtgtagttttcttcgaggcaagttcttgcgctcactgcaaggtcaccaaagcggttgcggtaatagccgttagtttcaggaagctccttgccctttggattaacgcaggagtaataatgcttgccatgacctttgtccatatcgttctcctcgtcaggctgtgtgcagcctttgagtatttcgctgtgatagtctttatagaatgtcacctgcttctgctttttctccttttccagaagtgcaagtgattttttcacaatgtcctcgtgagtagtgccgctccatgcgtacgctttgataggtctgagcctatagcatacagccagcgcaactgcggctgtgagaatttttttcataactctattttccttttctgatatttttgttgtttttctttttccttactgagtagccgaacgtgccaagctttttgccaagaccgtaatactctccgtgagcgtaggcaagaagcccagctttgtcaaggcaaagctttcctttttcgtcaagcaattcttttgcaacgtcaagccccacaatgtccgcaatgaacatatcatgtgtaccaagactcacgacctctcttactttgcactcgatattcacaggagattctgccatcaaaggtgccgatacctttgcggacggctctgcggtaaggtgcatttccttgaatttatccacttttctgccggttttcacaccgcaccaatccacagctttcacaagctctctggtcggcagatttatgacgaactcaccgctttgagtgataagctcgtgagaatatctctcaggtctgacggagatgtaggtaacaggcggctgagtgcagagaatgcctgtccacgcaactgtgaacacattgggtttatccatactgccgcaggtaacgagagtaggtggcaggggagaggttatgacgctgcctttccactgctccttggtgtattttgtgtactccattatttcacgcctttctcgttgtcaagtccaaaattatgtactcgtctgtatattttgtcatagtccttataaagaagctgagtctgattttcaagaaaatagtagtgctttatataaggcacaagcagtacgagaaacgcaatggcaaggggtatgagtatcatgacctgccaaactgcaatggcaatgaacgtcatgacagtacaaagtgcaaaaagcaccgtcacgataagatgtatcagccgttcgtgctgaaaaaaagcgatatgctctttgtgataatcaaggagctttgcaaagtcgcagtctttatcatcaagacagcttgcaacaaaactgcggtaacgcttgaaatattccgtcatgatatcacctacagttcaataaactcagcgtcttgtatctcaaggtcacggagcttggtcttgtatgaatttttctttttaagagccgcacgttcctgctcttttttcttgacgtcctttgcaactgtcataagcattatattgtcgatagttttatagtgctttgaaacacgctgagcaaagtttttgcgctttgcaggctttttctttttgccgtcaaaaataatggcaagaacaacggatatcgtcattgcgataatagttttctctgcatttgagttcacagagataactccttttttcatactatcaccattccttctgcctgagttttcctatcaggataacaacatataaagttattatactatattatcccgaagatttcaagtattatctattaataaaaaagtaacggtgttattaatgtgagctatcgtttttgttgtgctttaacggtcacggagatgttgaactgtcaaaaaatgaacgccatatgtatcaaaaaaactaccgcttgtgcattgtttttaccacttgtgcaaatgttgttgactttttgttaataacaatgtatgattattgtgaacattaatgctatttagcaggaatgtctggctaatgcacaagcaggaggaaaatgatggagaataatgagaacaaagcaaaaaaacaaaggatcataatagctgcacttattctgggcatgatgttttgcataggcattacgatttgggctgtgtttttcagaaagtcagaaacaaaatctcttgtacctgattatgcacctcagcagacagagcagaatgctgaacctttggatgacaacagcagaagtcttgatgtgcctgagggtggcggaggaatttctcttgaatacgaaaatacagtgaatatcaagctttctgataaaacagcttattttagttataagcatccaagcagttcaactcaggatatcgtgctttgtatcgaggtaaatggtgagatcatcgcacgctcaggtactataaaaccaggtaatcagcttaaaacgcttcctttgcttgagggcgaggcggacaaacttagtgaaggcacttatacagacgcaaattttagagttttaagttatgatccgcaatcaggtgaaaaagcaatggtcgatacggtggcaaaaataactgtcactgttgaaaaataaataacgggggaatttatcatgaaaaacaaatttgcgatcatcaccgcattagtgcttgcaagcactagcgtggttacagcatatgcggtaaattcagaaaaaaatgacggcagcgaaccaacaaatatcaaggttacaggaagctatattgattccaagtcaacgacaatgtctgtggacgttgagtgggaggaaatgaattttacctactttggcggacataaggtatgggatcctgaaacacatagctataccacagagtctgcatgctggtgggatgagcctaaggcgataactgtaacaaaccattcaaattcggctattaaagcacagttgaattttgcatcaaaggtcgaaggacttaacggcatgttttatgaagatattattttattggaaacagccgaaggcactgctgttgacgccgcacctaaaggttcaacatatttcagtgtaagtggagcagggatagaaacaaacaatacagatcttggcactatcacaataacgatctctgaagacattcagtaagtaactgacgcaatggttgtttctacccatgttgatacaactctttattatgtaacaggatcaaatggagcatggagggtagtaagaaacaatgatattgggattgtaccgatagcgtaataaaaaagtattcatatcagggggcttatgatggataagcaaaaaaatgacgggaagctgatcgtatcagtgcttatggtctgttttgcagttaccattggcgtgatgatatttgcattgtgccgtccaaatgataaaaaaagtgcagaatttactcaaccgccttttgaaagcacagcacagtatggcaagcctgaggtttcagaaaatttaggctatagctctccgaacagagatgatatgagctatgattttgcggtgtgcggaaacgtcactatggaaggcgataaggcaatggtatatcttacaaatatcgagggcaacaatgcctggataaagctcagagtgtttgacgaacagggaaatatgctcggagaaacgggtcttatcaagccaaacgagtatgtgaaatatgttacgctctcaaagacgctggaggtcggtacaaagataaagcttaagatcatgggttacgagccgcacacttattatagtgcaggtgcggcttccttgaatacacagatagggggtcaaatagaccaatgaaaaaaatgacttcatttcttgctcttgtgcttgcattaagcataccttctggtgcttatgcggccgagtcaaagcttgatgataataatacaactgcaaatggaaatgtttatgcggtctatacagaagatgttccatggaacagtgtgcctgttgacgacgatggaaatgctgttattgattttccagatggcacaagcgtgaagatcgagaatgccgataaagataaaaatcttgtggtggatcaggtcacagagaaggaagctcttgactggttaaacagcgtcatgggaaaaaagtctgaaaacaccgtagcatttcatatttattacattgacggagattctattctgccggcaaatggaataaaggtaacgataaacatagacaaagatcaggtgaattccgttaaagctgatggtacagtaagcagtcttaaatgtgaagagtctgatgcagaaatatcatttgtcacagacgatgcacctttctatgtccttggtacaaaagcacctgaaagttcatcagatatatcaccagacagcactggtaaaaaagatgatagcttacaaaacagttcacagacagcagttcaaaatgtaaacaaagacggtgataagtcacctaacacaggcataggagcaggtgcagcattgacaatgttgctgcttggtgccgttgccgtaagcgtgtcaaaaagaacaaaggataaatgatctgatattcataaggttcgccgtttgcattggtgttattaagcaaaaaaagactcgcacgaaattgtacgagttctttttttatgtagcagatatataaaatacacttatatttcaatataatcccaaagctcggaaacaagtttttctgtaaagcccttgcacaaaagaagctcgttagggctttcgtaataggatataagctcacgaagttctatgacagcattcgccttgtccatatcaattagcagcttgtctgatatctcctgagcgtcagccttgtttatgttcactttctgcctgactttctcagtagtttcagccgttgtaacagtttgctcctctgtggtcgtaggctctgttacagtatcagcagggatttctgtctgaacaggctgagtttctgtgactttcgtttcctgcggcatatcatggtagtctgcactgtcaacataaaaatagcctttgagaagtgcaagtgtagagtctccgatgccgtttacttcaagaagcatatccatgttgctgataacaccaactctgtcacgatatgctattatcctgtcggctgttacctcgcctatgccgctcaccgccataagcatttccttatcagccttgtttatgtcagcaggaaatctgtattcctcttttgtttcagcaatactgcttgtgacggcttttgatgtcactgttttctttgtggtgtgtgcctttgcagtcttgctaatgaccttttcactgcctgaattgtccaccttgtcagcctgagagctgtcagcaggcggtgtgagtatcaccacatcatcacgctgtggtctgttaacaagtgcagaagcgatcgctgtagtaatggcgatcgcaactgcgatcaagcctacgaaaagttttattctgcttgtttctacttttgaagcatcattttctgtcacattcgatttttcgtctttgttgctgtctaacttgctgtccataattgattatttttctgcaagcatttcgttgagattttccaccatttctgacatcttcgctcttgtgatgtctggaacatttgtaaatgtaacaagggttctcagtggcatatctcttatcattgcttccatcatttcctttgcagaagcgccaagatcgtcggaagccgtgtcgccaaaaccgcagtctattttgcttaaaatgtcctcgaacatagctcttccctctgggatagaatttatctcgccacaggtggtgttcaaggtgaaatgcactgggagttttgtatcggaagatacataaacagaagtcgaaagtctgatatctcttgaagaagagcctgcctcgataataaactcaccatattcaacgaaccaatcgtgtatatcaggctcgtagtatgcaaatgaacgcttatcaaggtggaacacagcctttttggtctcgccagctttaaggaaaagcttttcaaagcccttaagctcacggacaggtctgcgcactgagctttccttgtcggaaacgtaaagctgaacgatctccataccgtctctgtcgcctgtgtttgttacgtccaccatgaccgtcagggtcttgtcgtcttttatctcgttttctgaaacagtaagattgctgtattcaaaggttgtgtatgaaagtccgtggccaaatgggaacagtggctttatgcccttttcatcataatatctgtagcccacgaaaattccctcggcatagtcaacatcgtccatatttcccgggaaattaagataagacggattatgtgaaagcttttcagggaaagtttccgcaagctttccgctagggttagcttcgccaaaaagcagagccttttcagcagtgccgatgttctgtccgccaagatacatttcaagtatgcccttcaccttatctgcaaacggcatttcaacagccgagccgttgtggagaacgataacaacgttttcatttaccttagcaacttcatcaataagcttgagctgacaatcaggcattctcatatgctttctgtcaaagccctcagactcaaagctttcgggcagacctgcgaagataacggcaacatcgctgttcttggcaagctccacagcttcatcgagaagctcgtcaacagtttcgtcacggtcggtgacgaagccctgtgcgtatgtgatattatccatgcccttgacagcttcaagagcagatgttaccttaaatgaatttatgtgagagcttccgccgccttgataacgtggcttgtcggcaaattcgccaatgaaagctatctttgcagacttgtcaagcggcagtatcttatcatcatttttgagcagtaccgcacactcagactctatcttgcctgcaagttcatgctgtttttctttatcccactttgttgcaggggcatagccgtcctcggctttctgaataagcgtaagcacgtttctcacagccttgtcaaggtctttcattgaaagcgagccgttgtttacggcttctatgataagctcgtcattcttgccgttgctggtaggcatctcaaggtcaagacctgcggcaacgccaagaggtctgtcatcaactgcgccccaatcgctaactacaagtccatcatagccccattcgtttctgagtatatcagtgagcaaaagcttgttctgcgaggaatattcgccgtttatgcggttgtatgaacacatcactgtccaaggctttgcttccttgactggtgtttcaaaggcacttaaatatatttcatggaacgttctctcatcaacgttggcagaatagctcatacgtcttgtttcctgattgttcatagcaaagtgtttaagggaagttcccacgcctttgctctgaacgccctttatgtgtgctgtggcaagctgtgaagcaagataagggtcttctgagaagtattcaaagtttctgccgcaaagtggtgaacgctttatgttacagccagggccaagtataacggaaacgtcctcagcctgacactcctcgccaagagccttgccgagagttgtaagcagctttctgtcaaaagagcaggcaagtgcgcaggcacatgggaagcatactgccttgatagcttcgttaggattgtctgtatcatcacgcatttttctaagtccgtgagggccgtcagacaccattatgcttggtatatccagcctttttatttcctcagtgtgccagaagtcagagcctgagcacaatgaagctttttcttcaagtgtgagttccttcaaaatcttgtctatgttcattgtgaaaacctcttttctataaaactatagtttgattgtaacacaattttctatgaaattctatatattttgtgcatattttacataaagttaatattatcttcgattagtttggtgagagccaccctgaaatcctcgtcctgctgtttggtgcgctttggcggacctttgagcctgccgccgcttctgcgtatcttctttgcagtatgtcttgataggaggagtgcgtcaatgttggagctgtcatatatcctgccgttctggtccagagcaaggacgtttcttgcaagacacattgccgcaagcccataatcctgcgtcacggcaatatcgccctttagagcgatgttcacaagtttcatgtccgcactgtctgcacccttgtcgacagttatcacctgtgcatagtcagagctgaaaatatgcgagctgtcacaaactatgatacattcaagcccatggcttttgcttatagaaactgcgatattcgtaacaggacagccgtcagcgtctataagtatcctcacgccttgccgccttctatataaaatgtagattccatatctgcaatgtgggtcgccagtgcgagaggatacatttcaagggcaagaccgatactgttcttgttttcttctcctgaaaagcccatgtgccagcgtatagccatggcttcctcacgggtcagtcgcatatagctgcttactatgtagaccgacttttcgccgtgaccatatggcagtgtttcgtgaaattcatagtatgggactttctcccacacgccctgttcgttcttggcgttgcggtagcttactctgtaaagatttaccttgcagatgtcatgaaggagtgaaacgatagcaatgctctcgtcagagtattccatgttgtaatcttcctttacacgctcacgctccagatagcttttcaggcactcataaacgtgtatgctgtgttcgcacaagccaccctcgtatgctccgtggtatcttgtagaagcaggtgcaacaaagaagtcgctgctttctgaaagcagataattgagcaacttttccgaacccgggcgctttatgttttccgtgtagatctcaacgaatttgtctttaagttctgttacctttgacatagttgacctcctgtaaaaatattatattatgataagctttagcgttttagttttaccaaactaattataacatattttttgtaagattaacagtacttttcgctaatttttgcatttgctattgctttttcatgcaaaatatgctatgatatattatatttatgtggatatggtttggaaaaatataagaaatttaatgatttttaacaaatgagaatgaaaggagttgcttatacatgtgcggaatagtaggctatgtgggaaaaaaggattgtacaaaggtgctgcttgactcactgtcaaagcttgaatacagaggttatgactcagcaggaatagctgtttttgagaacgatgctatcaagacaaaaaagacaaagggcagacttgctgaccttgaagaaaagcttaaaagagagggttggctcaacggtacttgcggtataggtcacacacgctgggctacacacggcgagccgtctgatataaattcacaccctcacggaaatgcgaatatttctatcgttcataatggtatcattgaaaactacagaactatcaaggattttctgctgaaaaagggatatgtctttgaatctcagacagatacagaaacagttgcaaagcttcttgattattattatgagggcgaccctatggcgacaatacagaaggttcttgctgagatagagggttcatatgctctcggtatcatattcaaggattttccaagaagaatatatgcagtaagaaaggattctcctcttatcgttgcagttggtgaggacgaagcttttatagcttctgatgtgcctgcaatactgaaatatacgaagaattattatcttcttgacgagaacgagatagctgtccttgacgatggcaaggtggagttctttgacgttcacggaatgccagttgagaaagagatgctcgttgctgactttgatatggaagccgctgagaaaggcggatacgctcactttatgctcaaagagattcacgaacagccaacagccataaaaacaactatcacaccaagaatagttgacggtatgccaaaccttgaagagtgtggtcttacatatgacagactcaagggctataacaacatcttcgttgttgcctgcggtactgctatgcacgcaggtcttgtgggcaagtatgtgcttgaaaagattggcagggtacctgttacagtggatatggcttctgagttcagatacagagatcctatcattgcaaagggagatcttgttattcttgtttcacagtcaggtgaaacagccgacactctcgcagcccttagaatggctaaggagaggggtgctgaaacactttctatcgtaaacgtaaaaggctcgtctatcgcaagagagtctgatatggtgctttacacccatgcaggccctgagatatctgtagcttccacaaaggcatatatcgttcagctttctgtattctatctgctgagctttgctatagcatacgctcacggagctatctcaaaagaggagtgtatgagacttacagcagagcttcagaacgtccctaatatgcttgaagttgtccttaaaacacctgataattgtcagtatgttgcttcacagcttgtaaataaggaaaatcttctttatatcggcagaggccttgactatgcgctttctatggaaggctcactgaagcttaaggagatatcatatatccactctgagtcatatgccgcaggcgagcttaagcatggcactatctcactggtaacaaacaatatgcctgttatcgcagttgcaacacaaagagagcttcttgacaagacaataagcaacgtcaaggaggtcaaggcaagaggagcatacgttgtccttgttactcacggatatatcaacgttgacgatgaggtggcagattataagatcggtctgccgacaatagacgatctgctcatgcctatgctgacagtggttcctttgcagcttatcgcttactatacctcagttctcagaggcaatgatgttgataagccgagaaatcttgcaaaatcagttacagttgaataaaatgcagggcaatccgcaaagggttgcccttgctgtttgaaaaggagtttattatgagcaaatacagatattttgttttcgattttgaccttactcttgcagactcttccgagggcattctggagtgctttaagcacgttttgaaagagtttggttatccgccaaaggacgacaggactatctacaacaccataggcatgacccttgttgacgctttcgacctgctgacagatatgtctgacaatcctcagcgtgaggatatgcgcaaggcgtatgtaaaaaaggcagacgaggtaatggtgaagaaaacatatttctatgacgatactatcgcaattttgcagactttgcagaacgcaggggtaaaagtcggcatagtttctacgaaatatcgctataggatagtcaatactttcaatgagcaggcaggctctttgcctgtggatatcattgtgggcggcgaggacgtcacaagggcaaagcctgacccgcagggacttgacctgataatagagcgtttcggtgcagataaatcggacgtgctttatataggcgacagctacatcgacgctgaaactgcactcaattcaggtgtggatttttcaggagtaacaactggctctactactaaagaggattttgaaaaataccctcatatctatatcggctcgtcactgttggatatatttcagaatatataaattttaagtaaatataattttaaataaatgtgaaaaactattgctatttacggagcttgatgttataatataatttgatgtactatgttaagtaccaagcggataacataaatattattatatgaaaggacgggtatgctatgataaaaagcatgaccggtttcggcagagagcatatcgtggcaaacggcagagagataatcgtagagatacgctctgtaaaccacagatattatgaatttacttcgagaactccgagagcctacggctatcttgatgaaaagctgaaaggctttcttaaaagcggtatttcccgtggtaaggtagaggcgtctgtttctatctataatcaggagggtactgacgctgagatagagcttaacaaggctgttgcaaagggctatcttgacgcactgagaggtgcggctgacgagcttgaccttgatgacgatatcacactgtcacatatcatgaagcttcctgatgtgttcacagttgttaagaaaacagatgatgaggaagtaatctggaacgaggtcaaggacgtggctcaggtagcgttggacagatttgttcagatgcgtgaaactgagggcgtaaagatgtatgacgatatcagcggcagacttgattatatcgaggaaactgtgggcaagatagaagatcagtcacctagcgttactgaaagctacagagaaagactttatgcaaagataaaggaaactctcggcgataaggacatagacgagcagaggatacttacagaagtggctattttcgccgataaggtggcaatagacgaggaaacagtaaggctcagaagccatatctcacagttcagagggcttatcaagtcggacgagcctgtgggaagaaagcttgacttccttgtgcaggagcttaaccgtgaggtgaatactatcggctcaaaggctaacgatctcactattacaaaaatggtggtggatcttaaggctgagatcgaaaagatcagagagcagatacagaatatcgaataacggcggtgtgagatatgcagcttattaatatcggttttggaaatatggtgtcctccgcaagggtcattgccatagtttcccctgagtctgcgcctataaagcgtatcattcaggaagctaaggataagggtactcttatagacgccacctacggcagaagaacaagagcggtgcttattatggacagcgaccatgtggtgctgtcggcagttgcacctgaaactgtaggcggacgtgccgctgttgacgaggaggacgatgacaatgacaatgtataagaacaatgcaaagctgtttgttatatcagctccctcaggctgtggcaagggaactatacttgcagaggtctttaaaaacagagatgtgttctattctatatcctgtactacaagaaagcccagagagggcgaaaaggacggcgttcattatcattttataagcgatgacagctttaagaaaatgatagacagcggtgaatttcttgaacacgcaggctatgttggccattattacggaacgccaaagaagcctgttctcgctaatcttgagcagggcagagatgttatacttgaaattgaaactaacggtgcttttcaggtgaagaaagcctttcctgaagctgtgctgatgtttatacttccaccgtctgttaaggagatagacagacggcttagaaagcgtggaaccgagtctgacgatgttatcgctgaccgtgtaagtcaggctgccggtgagatcggcaaagccggcggttatgattatgtgataatgaacgacggactagaggacgctgtggaagattttgttgcagttatgaactccgtgaaagccgaggacggcaaggcggataaattcagatcagaaaatgatgatacaaagaaattaattgacgaggtgcttaattatgatgcttagaccggccgtaagccagattttgaagaacaatgaaagctattattctctagttattgcagttgcaaagagagcaagagagatcacgagcgatgcttttgacaacaagctggtgcttgatgaaaagccagtaaagacagcagttgacgagctttataatggcgaatacaaaataatcgaggatccaagcctcagaaaataatcgaggctttttatggggaggtgtacggctgtgcgtggagtttttatcgtggcaaaggttgcaataagccgtgcatcatacagctttgacgcactgtatagctatagtgtgccggaggagctggctcagaaagtgaaaagcggagtgcgtgtgcttgtgccttttggcagaggaaaccgcaaagccgtagggtttgttgcgagaacgtatacggaagccgagtataacgataagctgaagcctattatttcagtggtggacggggaaagccttgttactgaggaaatgatgaggataataatgtggctgaaagaaaacactttctgcacctattatgacgcttacaaatccgttgtgcctacaggcttttcctacactttttcacagcattacagccttgtcaatacctacattgacgaggatactttaaatgaagatgagaaaaatgtggtggactttctccgatgtgcaaaaagtcagagggagatagacagctttcttgacgtgcataatgacgcacgaaagaagaaaactgtggattctcttgtggataagggctatgttgagatcagcgacgctttgaaaagaaaagtcggtgatgagaatgtcagcatggtaaggctttctgacgagtatgtgtcaggggagatacagaccactcttaccccgaagcagacccttgtggtgaagcttcttgaggagggcggctgtgcctctgtgaaagaggtctgctatatgaccaactgcacttcaagcatattaaaaaggcttgctgacaagaaagttatcgtgcagtataaatacgaggtcatgcgtgacgccataggtgagcttggcgaaaggcaggaccctgacgatatcatactaaatgatgaacaatctgccgcatatgagggcataatggggcttataaaagccgaaaagcccgcaggtgcgttgctttacggtgttacgggaagcggcaagacgtctgtgttcataaagcttataaaaagtgtaatggatatgggtaaaacagcggtcatgctcgttcctgaaatatcccttacaccacaaatgctcggcaaattcaagtcacttttcggggataagatagccgtgatgcactcgtcattgtcattgggacagcgtactgacgagttcaaacgtgtaatgcgtggggaagcaagaatagttatcggcacaagaagtgcaatatttgctcctgtcaccaacgtgggaataatcatcatggacgaggagggcgagccgtcatataagtcggactcaacgcctagataccatgcacgagatgttgccatacagcggtgcggatataataactgcgtgctgttgatggcttctgcaactccgtctttggagagcttttattacgctcaaaagggcagatatcacttgtttgagcttaaaaacagatattcaaagtcgcccctgccggcagttgagatagtcgatatgcaggaggaagcggcagagggcaatgacagcttgctcagtcgtgttatgtgtgataagctcacagaagtgcttgcgaaaaaagagcaggctatcctgcttctgaacagacgtggctatacaacgtatatcacttgcatggactgccgacagcctgtggcttgcccaaactgcaatatacccctgacctatcacaagaaaaatgatcggtatatgtgccactactgcggatataccatggataatatagagcactgtccacagtgcggctcacagcggctcaaatcaagcggtgtgggaactcagcgtgttgaggacgagcttgaaaggctttttccgcaggcaaggcttctgcgaatggatgctgacaccacttcttcgagatattcctatgaggagaatttcaaggcgtttgagaaaggcgagtatgatataatgctcggcactcaaatgatagcaaagggacttaatttcccgaacgtcacaatggtgggtgtcatatcccttgacaaggcactgttcacaggggattttcgcagctatgagagaacattctcactgctcactcaggtggcaggaagaagcggcagaggagataaaccaggggtcgcatacattcagacctttgtgcctgaccattatgtgctgaaccttgcggcagagcaaaattatgatgagttttataaagaggagatagccttgagaaagtcgctgacatatccgcctttctgcgatatatgcgtcataggcttttcagcaccccttgaaagcaaggtaataggcgcttcacgctgggtgactcagcttataaaagagtatatctcacagcatagggtgaattttccactcagagcgctaggccctgcaccttgcacatttgaaatgataaataatcgctacagatacagacttatcctgaaaacacgcaatactgcggattttcgggagatgataaagcatgttctgggcgagttctataaaaataaagattatcagacagttcgtatttatgccgacataaacggcgatatcgggctttaagaaaggatagttaaataaatggcactcagaaaaatacttaataagagcgacgagattcttcacaaggtctgcaagcctgttacagaatttgacgacaagcttggtcagcttcttgatgatatgacagaaaccctgaaaaacgccaacggcgttggtcttgcaggtccacaggtggcaaagctgagaagagtggtcgttataataatcgacgataaggtttacgagcttatcaacccagagataacatggcagagcgaggaaaagcagagagttctggagggctgtctttcatgcccgaacgagtggggctatgttacaagacctatgagagttaagttcaaggcgcaggacagacacggcaagtggtacgaaatggaagtatcagaactgtttgcacagtgcgtttgccatgagcttgcacaccttgagggtcatctgtttactgagatagttgaagaatttgtagaggtcgaggactaatgaaaataatcttcatgggtacgcctgattttgccgtaccaacgctgaaaaagctttatgacagcggatatgaggtgcaggctgttttcactcagcctgataagccaaagggcagaggctataagcttactccgccccctgtaaaggtgcttgcgcaggagcatgacacaactgtttatcagccgcaaagccttaaaaaagacggcgaggagtatgttaaaattatcaatgaccttgcccctgattgtatcgtggtggcggcttatggcaaaatgctccctaagtcggtgctcgatataccaaggcttggctgtgtgaacgtccatggctcgctgcttcctaaatatcgtggagcaggtccgatacagtgggctgtgcttaatgacgaagctgaaactggaattacaacgatgcttatgggcgagggcatggatacaggagatatccttgtggaaaaggctactcctatcggcgagaacgaaacagccgcagagctttttgacagacttgccgaaatgggcgcagaggtgcttgttgatacccttgaaaagctcgataagggcgagataacccctgttaagcaggacgagagccttgcgacttatgcaccaatgctctcaaaggagctttgccctatagatttcacaaagccagtgagaaagatacacaaacagatatgtggtctgtctgattggccatgcgctactacagtgcttgagggcaaaaggctgaaagtatatagatctgagatagcttccacaaagccttgcggaaagcctgcgggcactgtggtggataacagcgacttttctgttgcctgctcagacggagtcataagatttactcaggtgcaggctgagggctcaaagagaatggataccgctgattttctcagaggcagacatattgagaacggcactgtgctgggataattcggaggaactatgggaaacgccagaaaaacggttttaaggctgcttacaaggcttgaaaacagcggctcatattcaaatatacttcttgacgagggtcttgaaaggtcagacctttcacctcaggacaagaaattcgccgcagcacttttctacggcgttttggaaagacagataactcttgataacattattcgggaatattcacgcaaccctaagaataagcttggtactgaggtcagagttatcctgagaatgggtctttatcagcttttatatatggactccgtccctgacaatgcggctgtggacgagtctgtgaagcttgcaaagaaaaacagaaaccctgcggcaagcggatttataaacgcaatgctaagggagtttataagaaacgacaaaaagcttccaaagggcagaaatgctaccgaggagctttctatagaatactccgcacctgtatggctgacggagaagtggacaagggaatatggtaaggatatctgccttgaaatgctgaaaacctctgtgggacaggcacctgtcaccgcaagagtgaacacggtctttcattctcttgaaagcacactggatatgctcgctgaggagggcattacctttgaaaggctgtccgtcctgcctgattgcataaggatatgcggtgcaggagcggtggagcatactaaggcttacaaagagggcaggatacacgttcaggatctttcgagccagctttgctgtgcggctcttgatcctaaggagaacgatacagttcttgacctttgtgccgcacctggtggaaagacctttaccattgccgagcgtatgaacaacaatggcagagtgcttgcttttgatctgcataaaaatcgtgcagggcttattgaaagcggggcgaaaaggcttgggcttgactgcataagcgcaggtgtcaacaacgcaaaggtctatgacgagaaaatgccaaaggttgacaaagtgctttgcgacgcaccttgttccggatttggcgtaataagaagaaaacctgagataaagtataaagaaccctcagatttcgacagacttcctgaaatacagtatgatatactgaaaacgtcagcggagtatgtaaaagtcggcggaacgctggtgtattccacctgcacgctgtcaagggcggaaaatgatgaggtggcagacagatttttggctgaacaccctgattttgagcctgcaccgctaggcgaggctttcggcagcgacagcggtctttgcagaatgtctatcacacctgcaaaatataattcagacggattttttattgctaagtttatcaggctgaggtgatcttttggtagcatttgatgataatgggaaaatagatatattggggcttctgcctgacgagctggaagctgagatactaaagcttggagaaaagaagttccgtgcagggcagatatttgattggcttcatgtaaagcgagtgtcaagttttgatgaaatgactaatctatctgtacaattaaggaatctgcttaatgaaaaattttgtttaaaatcactatttgtgtcaaaaaagcttgaatctcataccgataatactgtaaaatatctatatgagcttgaggacggaaatcatgtggaatccgtaataatggaatacaactacggaaacaccatttgcgtgtcaactcaggtgggttgcaaaatgggctgtcgcttttgtgcgtcaactattgcaggcttcaagcgtgatctgacttcctcggagattctgggacagatatatgcttctgagcgtgacagcggaagaaagatatcaggcgtggtgcttatgggaataggcgagcctatggataactttgataatgtggtgaatttccttgaagtgctgtcctgtccaaagggctttaatatgtcgctaaggcacgtttcagtatctacttgcggcattgtgccgaggatatatgagcttgcagagaaaaagctgggcataacattgtctatctctttgcacgcttccaataataagagcaggagcgagataatgcctgttaatgacaggtatgatatcaacgagcttcttgccgcctgccgatactattttaaggtaacaggcaggagaatttcttttgaatatgctttgatagacgggcataacgattctatggaggacgcaagggagcttgcggagcttctgggcggatttgtctgtcatgtgaatataatccctgttaataagataaaggagcgtaattatcattctgacagaaagtcagccaacagattcagaggatatctggagaagcttgggataaacgctactgtgaggcggaccttgggtgcggatatagacgctgcctgcggtcagctaagacgagaatatgagatctgataaaaggtggtgaatcgcttgtttatagcgtctgatacagacatcggaaaaaaacgcagtgaaaatcaggacagagtgcatgctgaatttcttgctgacaatgttgccgttgcggtggtctgtgacggtatgggcggagcgtcatcaggcggagttgccagtcagcttgccattgacgcagtagtaaaacgtatcaaagaaaatttccgaaaagatatgaaaccaaattccataagaaatcttatgctcacttcagtgcattatgcgaatacgatcgtgtatggcaagagcaaggaggatattgacaaaaacggcatgggtactacctgcgttgcggcattggtggtggataagaccgtctatatggtgagcgtgggcgacagccgtggatatcttcttaccaaggacggtatagctcagataaccactgaccatacttatgtggaaatgctttataggtcgggtcagataaccaaagaagaagcgaaaaatcatcatatgagaaacgttatcacaaaggctgtgggcgttgaatcagatgttgaggtcgattatttcgaacttgaagaaaatgataattttgcggtgctgctttgctctgacggtctgaccaattattgcacagacaatatgatatatgaaactgtgtttggcaataatcttgacgaggctataaaacagcttattgctttcgcaaacgaatgcggcggtaaagataatattactgctgcggtaatagcaaattaatggaatgacaataaaacatgaataatataggagttgaattacatggattctaatatcggcaaaaagctagacggcagatatgagataaccgagcttatcggcgtgggcggaatggctgacgtttataaggcagttgacgttatggaaaaccgtactgttgcggtaaagatacttaagcctgagttttcacagaacgaggaatttctcagacgcttcagaaacgagagtaaggctatcgctgtactttctcaccctaatatcgtaaagatatatgacgtgggattttctgacgagatacagtttatcgttatggagtatatcgacggcatcacccttaaagagtttatcgagcagcagggtgtgcttaggtggaaagacgctttgcactttgtaactcagatactccgtgctttgcagcacgctcatgataagggtatcgttcacagagatatcaaaccgcagaacataatgcttttccctgacggaactatcaaggtcatggattttggtatcgcaagattttcaaggatcgacggaaagacactttctgacaagactatcggttctgttcactatatctcacctgagcaggcaaggggcgatatgacagatgaaagatctgacatatactctgtaggcgttatgctctatgagatgctcacaggcagaaagccttttgacggtgaaaatcctgtggctatcgctctcaagcatatgcaggaggatccggttccgccaagagagatcatgccttctatcccagaggctcttgaagaaatagttatgcacgctatggagagagatcctgcaagacgttatcagtcagcagcagagatgataaaggatatagacacattcaagctcaatccatctgttgttttcggatataagaacagccctgttcctatccctgtggctgataacaataacaaatattttgacgatgagcatagtgagaactatgacgacgatgaagaatatgaggacgatgacgaagaaaacgatgacgaggaagaagaggaagaaaagaagcgttcttacgttgttccgatactccttgctgtgacagttgcggtagttatcattgcagcgttcgttatcgtaggagttgtattcaagtcattcagcggttcaaacggtatgcacacaggcacagttacactgccgaactttgtgggcaagaatatcgttcaggttgagcaggattataaggataagcttaaatttgatatcaccgaagagtataatgaccagtatgacgagggaataatcacattccagggtcaggcagcaggaaagtctgttaaggaaggcttcacggttacacttactgtaagtaagggtaaaaaaatggcaactatccctgacatggtgaagaaagacggcactgtggctgaaagcgagcttaaggctgcaggatttatggtcgttaagagagatatatggtctgaggatatagcttcaggtcttgttgtgaaaacacagccggcagcaggcgagcagtatgccgtaggtgcgactgttgctttgtttgtaagtaagggccctgttgaaacaagagtcaaagtaccaagcgttgtaggtcttacagaagaaaaggcagttgcaatgctcaaggagaacaagctcaaggctgaggtcaaggagatcgagcatgagggtgataaaggtaaggtcatcgagcaggatacagatgaaggcacatatgttgagcgtgacacaactgttactatttacgtttcgaccggagaaacttcacctgttgaggtaacattctcactgccactcccaagtggtatccacggctcatattctatagacatctacaataacggcaacgttgcatatacacagaagatcggcagtggagaatctgttgcaggcggttctgtaaatgtaactgtaaagggcaagaagacagaaactctaactatcttcatcacaaatgacgaaaatcagcagaagtgccgttatgcagtatatgacatagattatgataagcagacagctactcttagcggaagcctgaatgaaagcggtctgatcgacattactccgacaacgaccacaactactacaactacgaccacaacaactactacaactaccactactgaagcacctgcaccggagcctcaggagccagacgagcagggtcagtagttcatgaatggaataatcgttaaagctatcggaggcatctactatgtagaagcctccgacggcatttatgaatgtaaggcaagaggagtattcagaagaaagaacatttctcctgtaggcggcgacagagttgaattttcattggaggacgacggaagcggagttatcgagaagatagaggaaagacgctcattgcttataagaccgcctcttgcaaatcttgatatgcttgtgtttgtttcgtctacctgcgaaccaagacctaatctgctgttgcttgataagtttattgcaatagctgttttcaaaaaaatagagcctgtggtagtttttacaaagatagacaaggaaagctgtgacgagcttgtggacatatacaagggcgcagggataaagacctttcaggtagacaataccaccggcgagggcagtgaagctgttaaggcagtgctggagggcaagctgtcggcatttacaggaaacacgggcgttggcaaatcgtcactgctcaataatatgttccctgctttggggcttgccaccaacgagataagcaaaaagcttggcagaggaaagcacaccacacgccatgtagagctttacaagctggagggcggtggttatattgccgatacccctggtttttcgtcgtttgataccaacagatatgatattattttcaaggacaagcttgcaggctgttttcctgagtttcagaaatacgagggcaagtgcagatttcctgattgcagccacacaaaggaaaagggctgtgcggtcatagaggcggtaaaaaatggcgagatcgcaaagtcaaggcatgaaagttatgtggaaatgtacgagcaggcaaagcagcttaaggagtgggaatataaaaatgactaagaaatgcactatcttttcaggcggcgaagctgtgtcggctcaatgtgtggcagaatacaaagattttattgacgattctcttgtgatatccgctgacaagggctataagcttgcacaggcagttggcgtaaagtcggacattattatgggcgattttgattctgctgaaaaacctgtttttgataatatcgagatcttcccctcagaaaaggacgataccgaccttatgcttgccataaaggagggctttgagtcgggttgtgatgattttctcatattcggtgcaacaggcggacgagtagaccacttacttggaaatatccaatctctgggatatattttatcttgtggcggtgagggaatgatagccgcagatagggagataattcggctttatcgtgcaggaagttacaggatatatgaccgtgagggcttttcgttctcgctggtggcatataccgataaggtagagggtctgaccataaagggtgcgaaatatgaagtagaggactgtctgctgaccaatgctttcccacttggcatatcaaatgtagtgaaaggctttgatgggcaggatagaaaatacgctgagatatcattcaaaagtggctatctgctgtcagtacagtcaaaaatggtaaccgatttttgatttttgaataatataaactataactattcgggaggtaatacttatgaaagttgtagttgtaaaaagtccaaaggtcatatcgggtttaatgaggcttattttcaagatcaaaaaggaagaagaataggataactggcggtactcgtgtgatataatccccttagagtagacacatgaaataataaaatggtgtaactctaaagggggttattttatgtcaaagaagagccagaagacgtggcttaaatgccatgaatttagaaattgcgatgatttgctgtggttttaatctgcataaattccacttgaaaaagcctgcaataaaaaaagcggcataaatttaaaatattttccacattttcaacacggcaaaaacgcagtttttgtgccgctgtgtttgctgtacccttttttcaagattagatagttcttttttgctgtgtgatatattaaagcccgtgagcttccatatcgaggaaatccacgggctttgttgcgcttttttttacagcgcccttttagtcacatttttctttcaacttgttagtctattcgagtcaaggctgatatgcaaccttccgttaagctccatggcgtgctcactcgaataaacagccacttcatcacttgacgatctgccacgactatcaagtttcgtcagatcgttcgacagctctcgctgtctgctcaacttttttctgttgctggtattattatattcgatttttgcaaaattgtcaaggttttctctataggtcttgacatttgccacagaatggtctatactgttatcagagccgatggatgtgttctctaggggcaattgtagcccgacagaatgaagcattttgtcggctctttttcattttgatacaagcaaaaaagttccataaaacaccgttcaacacctgaacgcattttatggaactcttttcagattataaatttcttcgccttgtttacaatacagcggtcgttttcgtaagacaggacctgtcctgccctgccgatctcgacccagcgtatgtctgcgatctcctcttcctgaggagtgtagtcggtgttctttgctttgccgataaagtagacaacgatcttctgcgtgtccttccttggtgaataggacactatctcccgaaacgtggtatcaagatttacgtctatccccgtttcctccatgatctcacgcttggcagtttcttcctctgtttcatcgccctcaacgtgaccctttgggaatgaccaatgaccgctgttgatatgctttatcagcagtatctcggtgttgccgtgatactttctgtaaacgatagcaccgcaggatttttcatgcagcatcatttttcctttccggagcttagccccaatatttactcattgatttaattatatcacaacagccctcatttgtctataccctttaataaatatactcccattttgtgcatattccacaaatcaggtaaaataaaaaaagccgtgcaaaagcacagctttttgaaacagtcaaagattattcctcaaccttgttctcgatatacttaacgatatcgccaacagtcttgatgttctcgacctcttcatcagggatctctacatcaaagctctcctcgatgctcattacaaggtcaactacgtccagtgagtcagcgccgagatcctctgtgatagaagcctccatagttactgcgtcctcttcaacgtcgagctgctctacgataatgtccttgatcttatcaaataccattactttacctccattctgtactttactgggtctgccgctcagcgcagcatttatgtcagccgccgccgctcataagtcggcaaatcattcggcatgatcatcaaaaaactcattcctgcgaactttcctcaaactcgcccacagttctaaacttattataccgcccctcaagcaattcgtcaagacctttttgcaattttcttttcaaagctccctcgatatagtcagagatattctccgcagtgagctgtgggtcgttatgtgcgccgccgtcggcttcggaaattatatggtcgcacacgccaagtcttgtaagatcctcggcggttatcttcattatatcgcacgcctcacgctctcttgtggaatccttccacaggatacttgcaaagcctctcggtgatattaccgaatagatagcgttttcaagcattgcaagctcatcgcacactgcaagagccagcgctcctcccgagccgccttctccgagtattatggagataacaggagtcttgagggtcatgaactccatgatgtttttggctatcgcttcgccctgaccacgcttctcagcttctacgccgcagaatgcgcctgctgtatcaacaaggcatataacaggtctatggaacttctcagcctgccttgcaagtctgagagcctttctatagccctccgggtggggcataccgaaattgcacttctgattttctgcaagatctctgccctttacctctgcgataactgtaacaggtatgcccttaaaataggctatgccgcccataacagcaccgtcatcaccaaaaagtctgtctccatgcatctcaaagaaatcgtcgaatataagagggatatagtccttggcagtcggtctgcccttgtgtctgattatatcaagtctttgacaagctgtcagctcactcatttgaggacacctcctttgctggcttatgaagtctgagtatatgagcgagaactcttctcattttctttcgctcaactatcatatcaacaaagccgttttcaagcatgaactcggcagactgaaaatcgtcaggaagcttctgcttgatagtaccctctatgacacgtctgcctgcaaatccgataagcacctttggctctgcgattatgatatcgcccagtgacgcaaaggaagctgttacaccgcccgtggtagggtcggtcataactgcgatataaagcagacctgcttggttatgtctagccacagcaccgctcgttttcgccatttgcataagggaaactataccctcctgcattcttgctccgcctgaggctgtgaatgcgataacagggagcctatttgcggtggcgtattcgatagctcgtgttatcttttcgcccacaacgctgcccatggaagccatcatatagttggaatccataacgattataactatcttctcgcctcttatggcagcctttcctgtgataacggcgtctttaagaccggtcttttctctcaaagcctgctgttttgcttcatagtcagggaaatctataggattttttgataccatatccttatcaaattcctcaaagctacccttatctatggttatatcaagacgttcttttgcagtaagtcttgaatgatagttacagtgaggacaaaccttgccgtttgcctgaaactcctccataaaagtgacgtttctgcatcttggacacttgaaaagcagaccctttgggatatcagtctttttcttgtcatcgtccgccttatcgccgttaaatcttactttaacgacagaaaacagatcttcaagcattattccttactcctctcatctgccaaaatgtcggtacggttaagaaaaccgttatcgtaattgccctctaaaaactccgggcgtcttataagcttgagctggaaatcaacattggttgcaacgccgtccacgataaactcagatagcgcccatgtcatttttgcaatagcttcttctctattcttaccgtgaacgatgagcttgcctatcatggaatcgtaataaggcggtatctcatagccctgataaactgcggtatctactcttattcctggtcctccggggataaagagcgactttatcctgcccggtgacggtctgaaatcaagaagcggattttccgcatttatacgacactctattgcatgacctgtcagctttatatcctcctgctttatagacaatctctgtcctgatgcgataaggagctgttgctttacaaggtcaacgcctgtgacggcctctgtgatagggtgttccacctgtatacgggtgttcatttccatgaaatagaactcgccgtttttatccacgaggaactcaatagtgcctgcgttcctatagccgcagaccttagcggctgtacaagcggctttgcccattttcgcacgaagctcttcattcataaagcttgcaggggaaggggcttcctcgaggaccttctgatttcttctctgcatggagcagtcacgctcgcccagatagataacgtcgccgtaattatctgcaagtatctgtatctcgatatgcttagggtcttctatgaatttctcgatatagatctcgtcattgccgaagcaggcaagagcctcctgctttgcggcggtcatctgcgcttcaagctcatcgtcggagtgaacgatccttataccacgtcctccgccgcctgctgaagcctttaccataacagggtagccaagatctcttgcaagggtatgcgccgcatggatatttgagatagcaccgtctgaacccattataacaggcacacctgcttctttcattgtttcctttgcctgcgctttatcaccaagcatttcaatagactcggctcttggtcctatgaaagttatgccgcacttttcgcacattcttgcaaaggacggattttcagacagaaagccaaagcccgggtggatagcatctgcacctgttatctcgcaggcggagattatcgccctgacattaagataactgtccttgcttggtgcaggacctatgcagactgccttgtctgctatctgagcgtggagagcgtttctgtcggcggttgaatataccgcaacagtatgtatgccaagctctcggcaggctcttataatgcggacagcgatctcgcctctgttcgctatcaatacttttttgaacatattatgcctcactaattatgactagaataagagataccttactttatcgcaaaagttatctcagcggaaacagccttcttgccgtttacagaagcaagtgcctttccaacgccgataggacccttgactttgattatctccacctcgatatccagcttatcaccaggcactacctgctgacggaacttacagttgtttatgccgccgaacagacctatcttgcccttgttctcaggaagtgaaagcagtgcaactgcacctgcctgcgcacacatctctaccataagtacgcctggggtaacaggatagttcgggaaatgtcccttgaaccaaaagtcctcagcctttatatactttgtagcctttacacgcttgcccacttcaagctcgtttacctcgtcgataagcagaaaagggtcacggtgagggattatttccatgatctgctctttattcaaaacaactgccattgtctttcctccaaatcagtttagtcaagtatcattatggtctgatcgaactcaacagcgtcgccgctgtttacgcatatctctcttaccacgccgtcaaattcgctctgtacttcgctcattaccttcatggactcgataatgaagatagtgtcgcccttctttatcttgtcgccaacgcttacgaacggctttgaatcaggtgacggagcggcatagaatgttcccacgataggggctttaactgccttgccgcctgttaccggcgctgatgttgccgacgcttctggtgctgtctgggctgcgggtaaagctgtgcctacagccattggcataggcattcccattggtgcaggaggagggcatttcttgccctttactgttatcaccttgtcgccgtcagctattgttatctcaccgaggtctttattcttcacgatatcggcaagcttctctattgtttcaaggtcaaactgaccataaattttttcgctcatatcagtttctccttatcagtcgcacttcttgatacagatagtagcgttatgtccgccaaagcccagagagtttgaaagtgctgcatagacaggcatttctctgttgccctcaacgcagtagtcaaggtcgcactcagggtcaggagtggtgtagtttattgtcttatgaacaaagtcgttctgtacagaaagtgcagtaacgatagcttccatgccgcctgccgcaccaagaaggtgacctgtcatagactttgtggagtttatgaccgtctttcttgcggcttcttcgccaagagcaagcttgatagctgttgtttcatacttatcgttaagacctgttgatgtgccgtgagcgttgatgtagttcacctgctcaggcttcagacctgcttcttcataggcatacttcattgcatgggcggcagcctcacctgttggtgatgggcttgtcatgtgataagcgtcgcctgttgcgccatagcctgctatttcagctatgatatttgcacctcttgctttagcgtgctcatactcctcaaggcaaagtatgcctgcaccctcgccaaggacaaagccctgtctgttcaggtcgaatggagttgaagccttgtcaagctctgttgcctttgagagagccttcatattgttgaagccgctgagtgcgaaatgagagatacaagcctctgagccaccgcaaaggcaaacgtcaagatagccgtcctttatttttctgaaagcttcgccgacagcgtgagtacccgaagcgcaagctgtggtggtacagaaattatcgcccttaaagcctgtatgcattgcaacagtaccagccgccatattgcctatcatcatagggataaagaaaactgataccttatcaggcttttcgttgaactttgttacttccttttcggtcatgttaagaccaccgataccaacaccgattataacgccagccttaaatggatcaacgtccttgaaatcagagccagccattttaagagcctgctttgcagagcaaacagcgaactgagtaaatctatccattctctttgcttcttttttatctatatactcagtgcagtcaaaatccttgacagcgccgactatctttacagggaaattctcagtatcgaactggtcaacatatgaaagaccgttcttgttagccttgatgttctcccagaactcttctacgttttttccaagagggtttactgtacccatacctgtgataacaactcttctcatttaaacactcctttatttctgaaacaatgatatatcttatctttccacggcacatatcgagcacatggcttgtgggataacgggcaaacgctgttcgtccctacattattgcttgatataaagccaaacaatatttttattcggtctgcatattttcgctgagcggacacaaattacatcataccgaaacgcacggcgtaaaatgcccgtcacggcgagtgaccgagtgactacatcataagtccgccgcttatttctattacctgtcctgtaacgtagcttgcgtcctttgaggcaaggaatgatacaacgcctgctatctcatctacctcgccgtaacgtttcatagctatctgatttatcatagcctgtttctgagcgtctgtaagcttgtccgtcataggggtcttgataaatccaggggctacagcattgcaggtgatacctcttgagccaagctcctttgcaactgtctttgtcatgccgacgatagccgcctttgttgcggaatagtttatctgtccagggttgccgtaaagtcctgcaactgacgcaagatttattatcttgcctgacttctgtcgcatcataacgctgcccacaaattttgacatattgaacacgctcttctggtttacagcaactaccatatcgtactgctcctcgctcatacgagccataagaccgtcacgagtgattcctgcgttgtttacgagaacgtcgatagtgccgaaacgagcctttactgccttgactgtttcctctacctgtgcatagcttgaaacgtcgcagatgaacttttcacactctacaccctctgcctttatcttatccattatatcgttatcttcaaacattgcctcagagatgtcgttgagagcaatattgtagccgtcctttgcaagtctgagtgctattgctgcacctattcctcttgcggaacctgttatcaatgctgttgccattttatcttcctccgtcttttacttgctgagaagcttttctgcttctgtgaacatttcctctatcatatcctttgcaggctcgaccttctttaccatgcctgcgatagctccgcagaggaaagaaccctcctcaaggttgccgtcctgaacggcttttctcagtgaaccgagggttatctcctcgaactcctcaggtgtgatcgtgccgtttgcttcgccgcttgcaagcttctttgagaactttgtcttaacgtttctgcatgggtgacctgtatatctgcctgttacgatactgtctgtatccttagcctttacaacaagctccttataaacagggtttatctgacactcctctgcggcaaggaaacgtgtgccgagctgtacgccctctgcgccaagcatgaatgaagcggctattcctctgccgtctgctattccgcctgcggcgataacaggtatctcaactgcgtcaactacctgtggtacaagacacatggttgtgttctcaccgatatgtccgcctgactctgtgccctctgcaataacagcgtcagcacctgctctttccattctctttgcaagagcaactgacggaacgacaggtatcacctttatgcctgcttctttccaagcagccatatacttgccggggttgcctgcacctgttgttacgacaggtacgccctcgtctataacgagctgagcgaggtcgtcggcattagggctcataagcatgatattaacaccgaaaggcttgccgtttacagccgcctttgtctgtcttatctgatctctcaggtagtcgataggtgcagagccgcctgcgattatgccaagtccgcctgcgtttgaaactgcggaagcgagagtatgctcagctatccaagccataccgccctgaaagatagggtattttatacccaaaaattcagttattcttgtctttgtagtagtcatagtagttctccttattgtcaaaagcaaattttatgccataatacataataacaatttattatgtaccgaatataaactgtatatttattatcaatactcgaaaacagccgcaccataagtaagtccaccgccgaagcctacaagacaaatcttgtcgcctctttttatcctgccttctgcaactgcgtcgcaaaatgcgatagggatagatgcggaagatgtgttgccgtagcggtcgatatataccgggaacttgtccattgaaacgccaaggtgctttgcggcagtttcgattattcttatatttgcctgatgcggcactatccaatcaaggttatcaggggaaatttctatctttgcacaagcctgctcaactgcatttggaagtgcctttgtggcaaacttatagacctctttgccgtcctgcttgaagaaataatcctttgtttcaggcatatccatatcaaattcctcgctattggttctgaaagcgttctcagacttcaaagcacgggaagcaagatactttgcaccgtttccgtctgcgccaaggaagcttgaatatgtagtatcctctgctgtttcaaggacgaaagcggctgcgccgtcaccgaaaagcacgcaggaagaacggtcggtataatcaacgaattttgaaagctcctcagaagctaccaaaaggacggtctttattccgtcgcctgtctggagatatctctttgcggtatcaaagccgtaaacaaagcctgcacaagcagcgttaaggtcaaatgcgatacagcctatcgcgcctatctctctctggataaggcaggaaagtgacggagtgaaataatcccctgttactgttgtggcaataataaggtcgatatcctctgcctttactcctgcgtcagccattgcagcctttgccgccattgctccaagatagtatgtaggctcgccatttgtgatgtgtctttgcttgatgcctgttctctgagttatccactcgtcgcttgtttcaacgatctttgtgaaatcctcgtttgttgcgaccatttcaggcacatatttgcctatgcccttgatctttacgcctgttactttacttcccactgatttttcctcctgaaaattctatattatatattgtatatttccgcaaattgtgctataatgttcttgttcctatggagcaagtcaaaatatattatatcaaaatataattagttaattttttaactatataacacatatcataacattataattataaactgtttttttagatacgtcaataacaaattatgaacaactcttgatgaatttaaacatttagagaatttttcacaagttttagggcgttagttaatattatgtgtctattcttgaaaatatcttgcaaaaattaaatcataaaacaataattcagtggagataactttcagaaatttacagatatgagatgaggcggctttgatattatcaggcggctatgtataaatttaaccacaaaggagtaaaattttatgtcaaaaaatatttttttgttttcaggtcagggctcacagtatgtaggaatggctaaggagctttgcgaaaagtatgatgctgcaaatgcggttttcgacacagcggaaaaggtgctgggatatgacctgagagcagtaacattcgacggccctgacactgagcttaacaagacagtgaactcacagcctgctataatggcttgctcgcttgccgcttttgaagccgcaaaggctgagggcatcacatttgacggcgtagcaggtcactcactgggcgaatatgctgctatggtagccgcaggtgttgtaactattgaggacggcttcaagctcatcaaggcgagagcggctgcaatgcagaaagccgcagaggctaacagtggctcaatgtatgctataatcggtctgcctgctgaagaggtcgagaagatatgcgaggaaacagagggctatgttgttcctgtaaactacaactcagccgttcagacagttatcgcaggcgacacagaggcttgcgaggcggctgcagcaaagtttgcggagatgaagaaaaaggctataaagctcaatgttgcttccgctttccactcaaagctcatgcagagtgcggctgatgaatttatcgaaaccgcaaagacagttgaattcaagactgcaaacgttgatttctactcaaacgttcttggaacaaagcttgaagatttttctgctatgcccgatatgcttgccaagcacatcgtttcaccagttaagttcacttctgagcttgcagaaatggaaaaggcaggctatgaaaactttatcgagcttggtcctaacaaggtgcttacgggtcttgtaaagaaaactctcaagggcaagaacgctgtgaacattgagaacaatgccacaatggaaaaggctcttgcttctctgagctaaaatatcgaggggagaaaaatgaaaaaggctatgaaaagggctttgctgttggcattggcggtggcaatgcttgtttgtctgagtgcctgtggaaaatgtgcgtgggagataaagataaacggcaaggatatacagataccatgcactctggacgatattggcgaggaatatgaatacacgctggattatcctttttcggggaactcaaacggcaaggggatattctcggtggcgcttatgcaggacggcagtataataggcactgttaaggtagaagcggacagtgttgacaatattgacaggaagtcgaagatacgtcagataagtgcggcgcaaagcagttccgataaaaagggaatgagcattgcaggggtaaaatgcggtgatgacaagacggaagtcaaaaaagttttcggagagcctgacagtcctgacgcagacgcatggaaatacaagaagaggggcttttgggcgactttcttttttgatgatgacggcaaggtgacaatgctgagcatatcagacattgatgatgaagatacctgataaaaggcggtgtataaaatgaaacgcaatgactacatatcatgggacgaatattttatgggcatttcactgctatctgcacagaggagcaaggattctcacacgcaggtaggggcgtgcatagtttctcaggacaacaagatattgtcagtaggctacaacggtatgcctaccgggtgttctgatgatgagatgccgtgggacaggaacggagagtttcttgacacgaaatatccatttgtgtgtcatgccgagcttaacgccattctcaaccatgcggcaggaagcttacagaatgccaagatatatgtttcactttttccatgcaacgaatgtgcaaaggctatcattcaaagcggcataaaggaagtcgtttactgggaagacaaatacgctgacactgacggagttaaggcttctaagaaaatgtttgagctgacgggggtaaagatacgcaggtatgtgcctactaatagggagataactattaagctgtaggaacgttcgcccctacggatatacattattaatattcggaaatttttataaagaaggaatgtaaaatgtcaagaaaatacgctatacttggagaaacgcttaaacacactatgtcgcctcctatacacgccaggctttttgagctgaaaggacgtgagtttgagtacgagatactggaggtaaagcctgaggagcttaaagacaaggcggagtatcttaattctcttaacggctacaacatcactattccccacaagataggcattatcgactacactgatgagcttgaccagtcggcaaagcgttatcactcagtgaactgcgttgacaacaaaaacggcaggcacgttggttacaacactgactgcgacggttttctcagaactgttcgtgcaatgaatatcgacttcacgggaaagatactgcttataggctgcggcggagtaggcagaatgatggcaattgaggcggctcttgccggggctgacctttacattgcggtactggagagcgatatgcctttggctaagcaggtagagaaagagataaaggctatgaagtctgacgctaggataactattgttctaaacactgagataccgactgacgttcactacgagctgcttatgaacgcttgtccggtgggaatgtatcctaagacaaacgcctgccctgttcctgatgaagttataagggcgagcggtgcggtatttgacgttatatacaaccctcgtgagactttgctcatgcagaaagccaaggctatgggcaagaacgctgtcggaggcatggcaatgctggtttggcaggcggtttccgctcacgagatatgggacggtgacgaatacacagacgaggaagttcagtctatcatagacgaaatggagatcgctgtggagaaggattttaagtaaaatacattataataaggatagtaaatatgagaccaatttttttgtgcggctttatgggctgcggaaaatctactgtgggaaagatcttggcgaaaaaaatgggctgtcagtgcgttgaccttgacaagtatatcgaagatacggcaggaatgagcatacctgaaatattcgacaaatacggtgaggagcatttcaggaagcttgaaaccgaggctcttgcagcatttgctgacattggcggcgttgttgcaacaggcggcggagcattgctttcggaggagaacggcaaggtggctaaaagatcgggcatggtggtctttatcgacacatatttcaacacctgctacggacgcataaaaaacgaccctaacagacctatcgcttacaactccaccagagaacagcttttagagcggtttgactatcgaagacctttatatcttgcccactcacactatgtcataagcggtggttatccgcctatcgtcattgcttctaagatacaaaagctttacaagagatttgatttcgggcagggctgatttagctcttccctgcagactcgaccttcatgccccctgttttcgggcttatcgcaaaccatgcgagccttaagcttatgcccgtttatcttgcatttttcttcatacttctgcttgtgatgatatcaaaaacggaaaagctttgtcataataaacagtacggcttgtgcaaacagtaccaaattatttgtatcttggataatcaaaaatagctatttataacgaataatccaaaaagtctgcaagcactgataaaaaatgttgaaaatcctcccgacatgttgtatacttatgatatgaaaacgttatattaaactgccatatgacagaagggagctgcaaatggacatacagaaaaccgtgcttgtcgttgacgacagcacaacgaaccgatctatactttgcgacatactacattctgactatactgtgatccaagcagaaaatggcatacaggctcttacaaagctaaaaaaacaggataaaaaagttgacgctataatactggatatcataatgcccgaaatggacggatatgagttcatggataaaataaagcaggataaaaccttatctcagatacctgttattatactaacagaaaaatcagacagaggcactgaaaagaaggtgcttgaaagcggtgcgtgggactttgttccaaagccttatgacgctgatattataaagctaaggctcaaaaacgttatcgcaagaagtcaggtatcgctgctcaaagagcttaataacgttatgaactacgaccctcttacggagatatattcaaagaataaatttttcagtgcatcaaaggcacttcttaaggataatcctgacaagcagttcgcttttctaagactagatatcgaccgtttcaagcttataaattcatttttcggcactgcgtatggagacagactgctaaagcgtgttgcaaaacgtataagagattttgcaaaaacaacggaatgctgtaccttcggtaggatagacgctgacgttttcggtatcttcaccccttatcagggcaaggaagaaacagtaaagcagatagagcaggctgttgaagacatgaaaaaactgtccgaaagctataacatcatgatcgtttacggcgtttatgtggtgactgacagaagcctgccaatatccttcatgtgcgaccgtgccgctcttgccgctaaaactgtaaaagggcattatatgaaaagctatgctttttatgatgacaaaatgcggctttctctcgaaaatgagcagaatataataaatgaaatgagcgacgctcttgaaaaccacgagtttgtgccttactatcagcctaagtatgatgtaaagacaaacaagcctgtgggtgcggaggcccttgcaaggtggatacaccctaccaagggatttatctcacctggtgtgtttatcccgatatttgagaagaacggctttatctcaaagcttgatttctacatatgggaatgcgtatgcaaacagctcaaggaatggaaagacaagggagttccgctcttccctgtttctgtaaacgtttcaagggtaaacctttacaaccctaatctttcaaaaataataatcgaacttacgaaaaagtatgacgttgaccctaagtatttcaacatcgagataacggaaagcgtttatactgacgacaatgtaatgatagatgatatcaccagtcagctcagaaataatggctttactatcctcatggacgattttggcagcggctattcttccctgaacgtactcaaagatgttcaggtggatatgctaaaaatggacatgatgttcatgttcaaggcaaagtatgacggccgtgcagaaactataatttcttctgttatcagaatggccaaatggctcaatatccctgttatagcggaaggcgttgacagagcggagcaggtagaatttctgaaaagcgtaggctgtgactacattcagggtttctattattcaaagcctttgcctgcggcagactatgaaaagcttatttcagatcaggaggaacagcctttgcctgagaacaggacgtcagtaaacgacctgctgtggggcaagagcggaggattgctgacatatatcgacagcatcgaccagcctgctacgatatatgaatgttttccgaacggcacagtggtaatggtatgttcaaacaaggcattttcacaaaaatacggctatggcagcagtatttacggcaaactcaatgttaagaactgcattgacagcgaatgcaaagagaaattcacaagcactgtgaacaaggcaatagagagcaaggacagagcagaatgtgttctcagtatgcacgagataaacggcaagaagcactggttcaagacgcatttacgatttgtcagcgaaacaggtgtaagctctgtgcttatagcgtatttcacggacgtgaccgacatggtgctgacggataaacgcataaacgaatataagaactatatccaagatgaaatagaccgaaagcacaagatccttatcgtcagcaacaacagcgacacacgctgtcagctcgaagagatactttctcaggaaaatactgtttacactgcagaaaccattcagggaggaaaaaaggttcttctcaacgaggatatcgaccttatttattttgacatacagcttatttccaaggacgacgaatttcctcttgacattgatgagagaagactccccgttattgctataactcaggctcatagcgtacttaaaggcatgacaaaattgaagaacagagtttcagactttgttatgaagccgtatatagatgagctggtacgtctgagaacgaacaatcttttaaagatcaatatttcaggcagtgcaaacgaaaaatattttagccgaacgaaatgatctgaaaaagtcctctgcgataagcggggacttttttttctcttattaagctatcagctttattgacaaaatatacactatctgatattatataggtatgaatgctgaaagcgagggagaaaaaatgtatcttgacaagtggcgtgtggcaataagaaatttgaaaaattcgcttttttcatatccaaacacggctcaaagctgtttccctgaccctatcacggacgacacagtgttttactgcgttcaaggtcttgtatatggcagtcaaaagttccctgacggaaaattcatacgcagttctcctgtgacctcggtatactccgaggacggaaagctttttgccaaaacaataaacaacgtttatgagcttaaaacgccaagcgattattttgactgcgatatcgctgaaaatgccgcacaaaaaacaggaagcagtgagcttgctgaaacagctaaaatgcagagagaaaagctcacggcacagcttgataaatttttcacgatctgccagaggctttgtgataatgaacaggctgacgttgcaaatgagttacctgaagatactcttgttatatgctattacggcactgacccacatggaaacaagatgttctacaaaaatgaagatatggtagtgcctgtttttgcatatgtgaccgttgggctggtcattgattctgtggggcttgcggaaagcgaggaaaagctggatttatgggatacgctggggagatattatattgacagcgagcttatggagttttatgactgtgacacgaaaaaccttattttctgcaatttgacgaactctcctatatatgtcacaatttacgaaagctccgctgctatgctctgtatgccaaacacggctaagatagcttcaagaaaagtaaaagaaaaataatgcttttatccgtctgagatctcaggcggatttttttattgcacaatatagaaaagaacgttgaaaattaatagaatgttaaacttttaacgtgccatagcaattgaatattcgtcaaaagtgtagtataattttttatatagttgctttttgatgtaaaataatatatttaactattttttgtatcgtgaggaaaagatcatggaaattttaaaacagcgtattcttaaagacggagtagtaaaggaaggaaacgttctcaaagtcgataaattccttaaccaccaaatggacgtcaagcttttcaacgatatcggtgaggagtttgcaaagagatttgcaggaacaggcgtaaacaagatactcactatcgagtcatccggtatcggcattgcctgcattgcggcacagcattttaacaactgccctgttatttttgcaaagaaaactctcagcaaaaatcttgacggcgaaatgttcgttactcaagtaaagtcctacacaaagggcgttacatatgacgtaatggtatctgaaaaatatctcggcaagggtgacaaggtgcttatcattgacgattttcttgctaacggctgtgctcttatggggcttatagatatcgtgaagcagtccggggctgagcttgcgggagcaggtatcgttatcgaaaagggcttccaggttggcggaaagactatccgtgacatgggcgtaaagctcgaatctcttgctatcgttgactctatggacaacggcactataactttcagggactaacgcacaaggcgttaccaataaatattttatggaggaagatcaaacatgaaggtaagacgtattcttgcgctcgttctttctgcggctcttgctgtaacagctcttacagcttgtacatctgctaaggacgaagcatcacagaagtcggctgacaagcagacgacaactctcagctatgacactgtaaagatcggtgttatacacatcggcaaccctgccgacggttcaggctacacatatgctcacgatcagggtatcgttggtatgcagaaggagcttggacttaaagacgatcagatcgtaagaaaaaacaacgtatcagacagcgaccctgctgctacagaaacagctatccgtgagtgcatcgaggaaggctgcaacatcatcttcggcacaagctggggctatatggacaaaatggaatccctcgctgaggaatatcctgacgtttatttctgccacggtacaggctacaagaacaacggcaagaaccttaacaactacttcggaagaatttatcaggcaagatatctcaccggtatcgttgcaggtatgaagacagagtcaaatcttatcggttacgtttccgctatgggcagcgagaactctgaatgcacaggcggtatcgacgctttcgcaatgggcgtttattctgtaaatcctgacgctaaggtttatgtaaaggtaacaaacagctggtattcaccaacagaggaaacaaacgctgcaaaggctcttctttctgagggctgcgacgttatcgctcagcactgcgacacacctaacccacagctcgaggctgaaagcgcaggcaagtggggcgtaggctacaacacagatatgtctaaggacgctcctaaggctacacttacttcaactctttggaactggtctgcatactacacatatcaggtaaagcagatcgtagatggcaactggaagtgtgagaactactacggcggcatggctgacggtcttgtagacatcgctcctctgaacatggatatctgcacagaggatatgcagaaggctgttgacgaggctaaggctaagatcgaagacggctcattcaacgtatttgacggcgttatcgaaacaaacgacggcaaaacagttggcgaagagggtaaaactcttgacgacgctactatcacaggcggaatcaactggtacttcaagaacgttgaggtcaagtaataaggcttaacagcttaacaaaacatttatacgggcggtgcaggttgccgcctgttttgttaatgatatgagcatacggcagcaggtaattctgctgtcggtttctgatgacattagcaaatctaaggaagttcataaaaaggagctgaaagtatgagtgaagaaatatctgctgagatcgctgtaaaatgcagcggtataacaaaagttttcggaagcgtggttgcaaacgacggcattgatcttgaagtaaaatacggtgagatacttgcactgctgggcgaaaacggatcaggaaagaccacgttgatgaatatgctttcgggtatctatcaccctgacaagggcaatatctacattgccggcaagcctgaggcgataaattcacctatggattctatcgaacttggcataggcatgatacatcagcacttcaagcttgtggaggtgttctccgccgcagacaacattgtggcaggcacaaagggcaagcttaagagcaagggtgctgtaagagatgagataaaaaagatatctgaacagcttggtcttgaagttgaccctgacaaaaaggtatacaatatgtccgtcagtgaaaagcagacagttgagatactgaaagtgctttacaggggtgcgaagatacttattcttgacgagcctacggcggttcttactccgcaggaaactgaaaagcttttcaatatcctgagaaaaatgaaaactcagggctgtgctatcattatcatcacccacaagctgggcgaggtaatggatatatctgacagagtgaccatactgcgaaagggcaagagcgttgaaactgtaaacacagcagagagcagtgaaaagcagctcactgagcttatggtgggcaaggcggtggagctttcaatagaaagacctgaacctgtgaacgtaaagccgatacttaacgtagtcgatctgacggtaaagaactctgagggaagcattgctctcgatgacgtaagctttgttataaacaggggcgagatacttggtgtggcaggcattgcaggaagcggtcagaaagagctttgcgagactatcgcagggcttcagaagatagaaaagggcgcagtgctttacaacaaggagaacatcataggcaagacacctaaggagataataaatctcggcataagcatgagctttatccctgaggacagacttggaatgggtcttatcgcttcggtgggtatgacggacaatatgcttcttaaaacatacaagcagggcaagctttgctttgtggacagaaagcctgctaaggcgctttcaaaggagcttatagaaaagcttgaaataaaaactccgtcaacagagcttcctgtaagaatgctttcgggcggaaacgttcagaaggtcctgcttggacgagagatacacagtgagcctgatctgctcataaccgcatatcctgttcgtggacttgacatcaactcatcatatcttatatactcgcttcttaacgagcaaaagaaaaagaacacggctgtgcttttcataggcgaggaccttgatgttcttctggagctttgcgacaggataatggtgctttgtcacggcaagataacaggtatttgtgacgccaaaaaggtcacaaaggaacaggtgggcatgatgatgacaggctcgacaatggaggaggtgctgggcattggctgatattataaaaaaagagcctcttataagaatagccaagcgtgctgaacgctcaaacaagcaaaagcttatcataaggcttctgtcggtgcttctggctatttgtgcaggcggaatattcattcttattcttggcaaagatccgttttcatactatgcgaaaatggtaaagggtgcttttatcggcaagaacgccgcaagcccttttatgccgttcaaagagaccataaagataatgataccgcttcttatatcttctcttggcattacgcttgcgtttaagatgaagttttggaatatcggtgcagagggtcagataataatgggcggagttttcgcttcatacttcgctctttatcattacgatatgcctcactatctgcttttcattgtgatgttcgttgcggcgatgataggcggaggactgtacggcattatccctgcatttttcaaggcaaaattcgacacaaacgaaactttgctcacccttatgctcaactatatcgcactttacgttatagattggctcacaaagggcgcatggcaggatcctgagtcaaagggatatcctaagatagcaagatttgaccttaacgcatggcttgactcgctaggcggtgtgcagataggctgggtgataggtctggtgcttgtggtattggtatttatctatcttaaatacacaaagcagggctacgagataactgtagtatcagacagccatgcaactgcaagatatgcaggcatgagccctagcaagataatgataagaacgatgtttttgagcggtgctatctgcggtatcgcaggaatggtgcaggcttgcggaacagaacacacactttcaacatctgttgcaggcggagtaggcttcacggctatcatagttgcatggcttgcaaacctcaatccattcggcatacttgtggtgtcattcttattcgcagtccttgaaaagggcagcactgtggtatcgtctgaatttgttctttcaccttactgctcggacgttttgcagggaataatcctgttcttcgtgcttggctgtgagttcttcatcagatacagatttgtaacaagaggaggcaggaaaaatgactagacttatttcattccttgcccatgcggtatatatgggtactcctctgcttttcggcacagtaggagagatacagaacgaaaaggcgggacaccttaaccttggcgttgagggaacaatggcaatgggcgcttgcgcaggctttatggtagcatacaagacaggaagcctttggctttccatacttgcggcatttcttatgggtgcgctggtttcgcttatctatgcttttcttaccataacaatgatggcgaaccaaaacgtaacaggtcttacactgactatattcggcactggactttcaaacttcataggcgagcagatgatatccgcttcacctacaggaaatctcaaactgcctgacggagtgatgagcagtctgaaaaacattgacataccgcttctcagcaagatacccgttcttggagaggtgcttttctcacagaacattttcacatatctgagcattgttatcgctgtgataatgtttatctatctgaaaaagactaaggtgggtcttaaccttagaactatcggtgagaatcctgctgttgcggacgctgtgggaataagcgttgtgaaatacaaatacataaacgttcttatcggcggaggaatatgcggaataggcggagcgttctgctcaatggtaataaacggcggtgtctggatggcaaacagcgtgaacggtcttggctggatagctgtagcgcttgttatcttcgctgtatggaatcctgcaagggctatttacggagcgtatattttcggtgcattcatggtgctgaaatactacttcccgaaaaacctcggcttcacggttcctgagtcattctttgatatgctcccatatcttgtaacggctcttgttcttatcatcacttcagtgaaaaaatcaaaagagcgttcacagccacaatcctgcggtataaattatttccgtgaggagagataaaacgtgacgtaacgggcgaactgttcgccccgagaatgttgaaaaagtatcatatttaaaagctctgcattttgcagggcttttatttttgccctagtgacaaaatgcaaaagatgttcatagcccaattacgatacaaaaaaaagcgggcgaccacaggtcgcccatacactttgttatgttatgataaactgtttttacttcgcctttgccgaagccacaaaagatttgagctcctcctcaggcatatagccgacagttgaagcaactaccttgccatgtttcacaacaaaaagggcaggtatgctcgagataccgaaagcggatgcaagctcgttttcctcgtcaacgttgaccttccccacctttacagaactgtcctcctcagaatacttatccaccagcggtgaaagcattttgcacggaccgcaccatgctgcccagaagtcaagcaggacaggcttttccgagtgcattacttcgttttcaaaattatcctttgttatgacctttacagacatttttcacagctccttttctagtccttgcttttgtaatagagcatacaatggcagaagccctcaaaattcgggtcggctatctgctcacggaactctttgcacatacacttgttttcctctgtgcgctgtatcctgcacggacaatagccacctgtgcgtttaagcccctcttttatgctctttaccatttctttatcatcattaagacgtaccattactacctatcctttgcagatatgcttagattattccttgacaaatgcctttactatctcgccgatatactgatagtgataatccttgtcagaataccatttctcatcgttttcagtatcaacaaagcactcaggcttcatctcctgaacataagcctttttgcacacaagcaccatatcagcttccgcaaaagctgttacctccacgccgttttcagacacgaacacaggggtcagacctgtttcctttgccttgtcgcagtcacgtccactatgtgagccacagaatgaaagtgcctttttatactcctctttgaaaaagcttatggtgaaatattctgccttgtcgataaattcctttgtatatctctgtggtcttataactgtggtgaaggtgttctttccccacataacgcctgcaaagccccatgaagctgtcattgtgttccagccactctcgtcgcctgctgttacaagaaaccactccttgcctatctttttgtatggattgaagtcaagggtatcaagcttatctgccgctacctctttgaaaccgttgaaactgctcattttcattaccgcctttcagtattatgtcagacttatcatacttattgtacaccaatatcgtatagaaaacgtctgaatatattatatatcatttcttatgaaattgcaaccccttgaaagccctgaaatattgtacaaaaatcgttaaaacagggcttttttgtgttgctttttttgaagaatagtgatataattgaattaagtatttgtaaagctgtttttgtgtttttggtttagctgttttattttatgccgttgcaatactcaatatgtatatcttttgaagtttatacaggataaattgtatattgtctaaaaatatacattaaaaagccttaaaatgtgtataaatataaaatttttatgcaaaagcacttgacaatgctgtataaaggtgtataataattttatcggcatgagagccgtgaaaatattatacaaacatacttactacaaacaatggaggaattttgttatggcaaaagagatcaaaaaggttgtccttgcttattccggcggacttgatacatctatcatcattccgtggctcaaggaaaactacaacaactgcgaagtaatcgctgtttcaggaaacgttggtcagggcacagagcttgacggtcttgaggaaaaggctatcaagacaggcgcttctaagctctatatcgaggatcttacagaagagttcatcgaggattatgtatatccaacagtacaggctggcgctgtttatgagaaccagtacctcctcggcacttcatttgctcgtccgatcattgcaaagagaatagctgagatcgctatcaaagagggtgctgacgctatatgccacggctgcacaggtaagggcaacgatcaggttagatttgagcttgctatcaaggctttcgctcctgatatggagataatcgctccttggagaatctgggatcttaagtcaagagagcaggagatcgagtatgctgaggcacacaacattcctctgaagataaacagagaaacaaactactcaaaggacaagaacctttggcacctttcacacgaaggtctggatcttgaagatcctgcaaacgagccacagtatgagaagccgggcttccttgaaatgggcgtttcacctatcatggctcctgacaagccaacctatgtaactatccactttgaaaagggtatcccaacagcagttgacggcgttgagatgaacggcaaggagcttgttacaaagcttaacgagcttggcggtgcaaacggtatcggtcttgctgaccttgttgagaacagacttgttggtatgaagtcaagaggtgtttatgaaactccgggcggagctatcctttacaaggctcatgaagttcttgaaactatcacacttgacaaggaaactgcaagagttaagcagtatctttcaatcaagtttgctgacattgtttacaatggtcagtggttcactcctctccgtgaggctatgagcgcatttgttacagaaacacagaagactgttacaggtgacgttaagctcaagctttacaagggcaacatgataaacgcaggtgtaacatctccatacacactttatgatgaagaagttgctacatttgatgaggacaatgtttacaatcaggctgattcagcaggattcatcaacctcttcggtctgcctatcaaggtaagagctaagctcgagcagaagagaaacgctaagaaggactaatagcgtcgctctggtcaacagagcataaaggtgtataaccttaaaaagtttgtataatatttttcacggaggttttgatatgtcagataacaacagcatttttgagcctgcaatagacaagaaggtcgagatctcttatgacagcctgccgaactcctcttttgaggacgtaaacctcggcggagcaaagttctcgaacgtaaatcttaaggaagccgttttcgatgacgttaatatggacgagacacatttcaacaacgtcagcatgaaagaaagcgactttgcagatatgtatatggtaaacacaaagttcttgggcgtaaatctcagcaactcgagatttggctgctctatcatgaacaatgttgagtttaaaaatcctgatcttaagaactcacagttcattcactgtgaccttacaaacgttgagataaacgattgcaagatagacggtctgaagatcaacggcgtggacatccagaagctgcttgaacagcacgaaaaggaaatttgatccgcacttattgaaatgtattggggcaggatgatcctttggggtcattttgcccatacattttttatatttgataacttgaaataaacataaaggacggttttaaaatggcaggaaaaatgtgggcaggaagatttacaaaggaagttgacgaaagagtcaatgatttcaattcatctatttcctttgacgcaagaatgtaccgctacgatatagagggttctatggcacacgccactatgcttggcgagtgcggtataatcgaaaagcacgaaagcgaaaaaatagtccagggacttaagggtattcttgcggatatcgacgagggcaaattacagttcgaccctactgcagaggacgttcatatgtttgttgaggctgagcttaccaaaagacttggcgacacaggcaaaagacttcacacggcaagatcaagaaacgatcaggtggctcttgacgtgagaatgatactcagagccgaaacaaaagagataatcgagcttgtgaaaaagcttgaacacactatccttgacattgcagagaaaaatctcacaactgttatgccgggatatactcatcttcaaagggcacagcctatcacatttgctcaccaccttatggcgtatgcaaatatgctcctgagagatatttcaagacttgaggacagctacaagagaacgaacatcatgcctttaggaagcggtgctcttgcatctacaacttaccctataaacagacagagagtttgcgacctgcttggctttgacgagataacacagaactcacttgacggcgtttcggacagagatttctgcatcgagctttgctccgctatctcactgcttatgatgcacctttcaagattttctgaggagataattctttggtgctcatgggagttcaaattcatcgagcttgacgacgcttatgcaacaggctcgtctatcatgccacagaagaaaaaccctgatgttactgagcttataagaggaaagactggcagagtttacggcgaccttaacacactgctcgttatgatgaagggtctgccacttgcatacaacaaggatatgcaggaggacaaggaagctatctttgacgctatcgacactgttaagctttgtcttaaaaccttcgatccgatgcttgctacaatgagagttatccctgagaacatgagaaacgccgcagccaagggatttataaatgctacagactgcgctgactatcttgttaagaagggtatgcctttcagggacgcttacaagataacgggtactctcgttcacacctgcattgaaaagggctgtacacttgaaactctcccattggaggagtacaagaagctcactgacaactttgacgaggacgtttatgacgctatcagccttgacacctgcgtaatgcagagaaaagcggcaggcggtcctgcgcctgaatctgtaaaagctcagatagaatatgtcagaaataagctttgataaacaccgctcccctgttaaggcggcactgctatatcttgtgctgtgggagcttgcgacagttataatatggctttttacggctaagctttttgtgatatatccgctgtttgcggtgggatttacggtggtgtaccctgtgtgtacatggtgggcttgctacagacacgctaagaactacggcttgaaatggtatgttgcgcctgtgatgatagcggtttcggtgatagaatatatcttcgtggaggaagcaaggtcggtagtgccgaactttatcgtactcactgtgttgaccgcaggctttgccgcaggtcttggaaactgctttgcggataaggacgcaataaacgccgcaaaggaagataaaaagcgtaaaaagctgaaaaaagaacctgaatacaagaacattttggacgataattaaaagtatgcagacggctaaagagctgtcagccaaacgagcgaacactgttcgcccctacaaaagtttgcatttgcatgagcatacagattattgacagacaaaatcataaagttttataaaaggatatgaagaaaatgaaaacaagagtttttattgacggaaaagaaggaacaacgggacttcagatatatgagcgttttcagaacagaaacgacgttgagataatgctcattgacgaggaaaagcgcaaggacgtgaacgagagagcaaagatgataaactcatcggatatcacttttctctgcctgcctgacgcagcggcaatagaagcggcttcactttgcacaaaccctgatgttaggataatcgacgcttctaccgcccacagaacaaaccctgcatgggactatggtttccctgagctttctgaaaagcatagagagaatatccgcaattcaaaaagagttgcaaacccaggctgttatgcaagcggctttataagccttgtttatcctctcgtaaaggcaggagtgcttcctgaggattatcctgttacctgccatgcagtttcaggctacagcggcggcggaaagaaaatgatagccgctatggagagcgaaaataaaacaaaggaaatgtattctcctcgtcagtatgcacttgggcagaagcacaagcatatccctgaaatgcaggcggtgtgcggacttaaatataagcctatgttcaatccgatagtggacgactattataatggtatggttgtttctgtgccgctggtaacaagatgtttgacaaagaagtatacacctgagaatatccatgaaataatggcggagcattatgttggtcagcatttcgttaaggtaatggagcttggtggaacggaaacgcttgccgacggatttatcgcagcgaatacattggccggaacaaataatatgcagatattcgtctgcggaaatgaggatcagatattgcttatgtcgagatttgataaccttggaaaaggcgcaagcggcgcagcaatacagaatatgaatattatgttggggataaacgaagcaacggggctggaataacaaaaaagcaaaaaacaaaccaaaagcaccgcacaaaaaatcgccggtgcagggcggcgttagccctgccgagggacgggggcgagcagccccagcgggggcaaaataaagccaaaagcaaaatcaaacccaacagggggcagagccccctccacaaaagtacggtctaaaaaaagcggcggacaaaaaaataaaacaaaccgaagtaaaatttctcaaccaagcctaaaaaccaacaaaactccgccgcttttgtcatttgaacagcgaagcgtcttcaaatgactcgccaacggcgacaataagctcccccacaaaggagagcaattcccgaccaatgagtgcgaatataaaagtgcggaaaaaataagcgggcgaaagctgttcgcccctacagaaataattaatagaaaaaaatctgtcctgatctaattagtgtgaaaattttgtaaggagttttgaatatgaaagagatatcaaagaaaaatttcgacggctataagtatgtagacggcggcgtgtgtgctgcaaagggctttaaggctaacggtctttattgcggcataaaggaaaaccctacaaaaaagcctgacctttgcctcgttgagtctgacgttatgtgttcagccgccggcgtttttactcagaataaggtcaagggtgctcctgttactatttctcagaaaaatcttgctaaaacaggcggcaaggctaagggctttatcctcaactccaaaaacgctaacacctgcaacgctgacggtgaggaaaaggcttacaaaatgtgcgagatgactgccgctaaaatgggcgttaagcctgaggaaattcttatcgctcagacaggcgtcataggtcagatactccctctcgagcctatcgaagctaagatagacgagctttatgagggactttcctatgatggcaacgaaaaagccgctattgctatcatgactactgatacagtgaaaaaggaagtggctgttgagtttgagcttgacggcaagatctgccacgttggcggcatgggcaagggcagtggtatgatacaccctaacatggcgactacgctcaatgttatcactacagactgcgctgtatcctccgaaatgctcaaaaaggctcttactgagatagtgaagataacatataactgcctgtctgttgacggcgaccagtcaacgaatgatacctgtgctgttatggctaacggacttgcaggaaaccctgagataacagccgagtgtgagagctacgaggtgttcaaaaaagctctttatatcgtcatgatgaacattactaaaatgctcgcaaaggacggcgagggtgcaactaagcttcttgaatgtactgttactggtgcaaaaaaccttgacaccgctataatcgttgcaaagagcgttatatgctcgccgcttttcaagtgtgcaatgttcggtgctgacgctaactggggcaggatactttgtgctgttggatacgctgaagctgattttgacataaacaaggtggacgtttcactgtcatcaaaggcaggagagatacacgtttgtcacaacggcgcaggcatagagttctctgaggaagttgctaagaccgttcttcttgaggacgagatcacaataagcgtttctatcggcgacggcaatggcactgccactgcatggggctgtgaccttacatatgattatgttaagataaacggcgattacagaagctaagacataaaatcagtataggaaagaagaatgagaaatggacataagcaataaaatcagaagtcagatacttattgacgctctgccacacattcagaaataccacgacaagatagtcgttgtaaaatacggcggcaacgctatgacaaacgctgagcttaaagaagctgttatgagcgatatcgtgcttctgagcgaggtaggcataaaggtagttcttgttcatggcggtggtcctgagataaatgcaatgctcaaaagagtcggcattgaaagcaagttcataaacggtctgagatacactgacgctgaaactatagatatcgttaaaatggtgctttgcggcaaggtaaacaaggagcttgtttgcgctctccagcttcatggcggaaaggctctcggtctttgcggctgtgacggtcagatgatacttgcgcagaagcttgacagcgaggtagatcttggttttgtgggcgacatcaaaaaggtgacgacaaagcctatagttgacgcacttaacaacggttatgttcctataatctccacagttggcgttggcgaggacggacagtcttacaatatcaatgctgacactgcggcggctaggatagcctcttgcttgagagcggaaaaacttattcttatgacggatatagttggtctgctggaggacaaggacgatgattctacacttatcccacaggtaaacgtcagcgatgtgccttatctcaaaaagaaaggcatcataagcggcggaatgataccaaagatagactgctgtgttgaagccgtaagacgtggcgttaaaaagaccactatcattgacggcagagtaccgcactcgatacttatcgagctgctctctaacgagggtatcggtacacagtttatataaaatatcaatacatattgaaaagagtgataaaaatgaacaccatagaacagttcaacgaacacgttatgcagacctatggcagaataggtcttgttatggaaagcggtcatggtcagacggctgttggcgaggacggaaaagagtatatcgacttcggctccggtatcggcacaaacagccttggctactgcgacgaggattgggtgaacgctatttgcgatcaggcacacaagatacagcacacctcaaactactattacacaaaggtacaggctgactttgcaaaaagactttgcgaggcaacaggctatgagaaaatgttcttcggcaactcaggtgcagaggctaacgagtgcgctatcaagcttgcaagaaaatacagctttgacaaatacggcaaggacgctgagagaaatatcatcatcacccttgtaaacagcttccacggcagaacgctttgcactctttctgcaacaggtcaggaggttttccacaactacttcttcccgttcgttggcggatttgagaatgttatcgctaatgatattgacgatcttatggacaagctcaacaagcttgacaacaaggtctgcgctgtaatgttcgagtttgttcagggcgagggcggtgttatacctcttcagcagagctttgtgaacgctatcatgcttgaatgtgcaaagagggatattctcaccattgccgacgaagtacagacaggcgttggcagaactggcaagctcctcacatctgagctttacaacgtaaaacctgacataaccacacttgcaaagggtcttgcaggcggtgttccaataggcgtgtgccttgctaacaagaagtgcagtgaggtacttggcaagggtacacacggctcgacgtttggtggaaatcctatttcctgcgcaggcggaaacgcagttcttgacaaggtgacaaagcctgaatttcttgaagaagttcgcaaaaagggcgaatatttcagagaaaagcttgcagaaatagacgaagttgagggcgttgacggacttggtcttatgataggcgtaaggctcaagacaaagaaagccgctgatgtgctcaacaagtgctttgaaaacggacttcttattctcacagcaaaggacaagctgagatttttgccgccgctgaatatctcatatgagcagatagacaagggacttgctatactgaaaaaagttcttgacgagaaataacaaagtgtgtaggtgcgaacagtgttcgcccgttggctacgcaatactaaataaaaatcaaattacggaggaaatattatgaaacatttacttaaaatgctcgacctttccaaagaggaaattctcgacattctcaatcttgcagaccagctcaaatacgaaaacaaaaacggtatcgagcatcacattcttaaaggcaaaactctcggaatgatattccagaagtcctctacccgtacaagagtttcttttgaaacaggtatgtatcagcttggcggtcaggcacttttcctttcaaaccgtgacctccagataggcagaggcgagcctgttcaggacacagcccgtgttctttcacgttaccttgacggcatcatgatccgtacttttgagcagaaagaggttgaggatcttgctaaatacggctctatccctgtaataaacggtctgacagacttctgtcacccttgtcaggtgcttgctgaccttatgactatcagagagttcaagggacgtttcgagggtctgaaaatgtgctacattggtgacggcaacaacatggcaaactcgcttatcgttggtggacttaaagtaggcatggaagtttctatcgcttgccctaaggattatcagcctgctgctgaggttcttgaatttgccaagggctacggcgacaagttctcaatgacagacgttcctcttgaggctgcaaaggacgctgatgtacttttcacagacgtttggacttcaatgggcgaggaagctgagacagagaagagaaagatcgcattcaagggctatcagataaatgacgatatcatggctgttgcaaaggctgacgcaatggtacagcactgtctgcctgctcaccgtgaggaggagataaccgaaaaggtattcgaggctcacgcaaatgagatattcgaggaagctgaaaacagacttcatgcacagaaagccgttatggtcaaggtaatgggtccgcaggaataattcgcatatgacaaaagccgtccacgctggtgggcggcttttttgtgttgaacacatcaaaaaggtctttgatgtgacgggataaaaagatccgcagtcctcaaagaactgcggtcatagttaaataacattttcatttacgatatggtagctttgcagaatttctgggtcaaactgaatgagtgagatcattctgcgtgcaggaccgataggctggttcgtacctgtttcccacgcctcaacagtttttgtcgaaactccgatcactgcggcaaataccgcctgcgtaaatcccagcttttttcggatcgcttttatatcttcagcagatatatcaggcaaaggctctattctaagagttgttttttagcagaaattttacctttttcgtagtcaactgcctcgttaagtccagtaattatgctgtcaaacacattcatattaaagctggtctccttcgtatttattattgaagttgtaatatactttctcatttggaagcactgccttaatcggataaactgacatcccaaaagaatctgtaaaaataacatcttctccaatatgtttttcaagaaactcatcagaaaaatcagatattaaaccaatgctgatagctccattccttgtaaaattcaatccttcaatttgtatactcttttcaatcaaagaacaatctgaagtgtgaaaaaaattcaacaacattttttgaatatctcgttcgatttgaatctgattatcaagataatatctgattgcttcttcttgttcaaatgaaattacagcatctttttgatttgagtatatacatagatacaggtcaaaagttttatcccataatgtaatgataaagctcttctttgtgtaccaatctgtttttttaatcaaagttcctaatacaggatgctcaattgtagttggtttattttttttctttgtctttccaaaaaacataatctcgcctttaaaatttgtatggcttagcccattactacctcaacatttactgttgcaccattttcagctacagggagaacattgccctctactgccttgccgtcaacagttacgctctttatgcccttgcaaacgtggtcagggttcttaacagtgatgttgtatgttgcacctctgtactgacgtgttgctgtcatgccgtcccactcgtgagggatagatggatctatcttcaagccgtcaaagtcagcctgtactccgagaatgtactgtgagatagctaccatgttccatgcggctgtacctgtgagccagctgttcttgccctcgccaaatctgcttgcgtccttaccagctatcatctgaccgtatacataaggctctgtcttatgaagatcagaaatctcctcgttgaatgcaggagctatcttgctgtaatactcaaatgccttgtcgcctctgcctgcatatgcttctgcgcagattatccaagcattgttgtgtgtgaagataccggcgttctccttatatccgcccggatatgtggagatctcaccatactggatataatactttgagtatgcagggttgttaagaacaagaccatactttgtattgaggtacttgtcgatagaatcaagtgtcttgatgtcagcgccctcgtccttgcctatttcagacataactgcgaagccctgtggctcgatgaatatcttgccctcttcgcactcctttgagcccatttttgcgcctgtggaatcgtaagctctcaggaaccaatcgccgtcaaatgcagattccataacgttcttcttcatcttgtctatctcagcctgtgctgcggcagcttcatcgtccttgccaaggtgcttgaggatagacacatagttagggcctgtgtatgtaaagagtgttgccaccattacagactcagctacctttgagtagccgccctcagccgcaaacttagggttagtataagtctggaagctctcgcccggagtgtcagagtagcatgaaaggttgatacaatcgttccagtcagctctcattgcaagtggcagaccgtgaggaccgaggttatttacaatgtgatagaatgataccttaaggtggtcgagcattggcttagcctttgactcgtcattatcataaggaaccatttcgtcaaggatagaccagtcgcctgtttccttgatgtatgcggaaactgaaaggatcatccacagtgggtcgtctgagaagtcgccgccgatatcggagttgcccttctttgtaagaggctgatactgatgatagcaaccgccgtcaggaagctgtgtagaagcgatgtcgatgatacgctgtcttgcacggtccggtatctgatgaacgaagccgaggatatcctggtttgaatctctgaagcccattcctctgccgataccgctctcgaaatatgatgcggaacgtgaaaggttgaatgttaccatgcactgatactggttccagatatttaccattctgtttaccttatcgtcaggtgtgtcaacattgataacgctgagaagtctgtcccaagttgccttgagctcttcaagacctgcggctaccttttcaggagtgttatactgctcgatcattgcgagagccttttccttattgatagtaactccgtcagcctcgaacttcttgtcaacaggcatttcaacatagccgaggataaatacaagagtctttgactcgcccggagcaagtgttatcttcttgtagtgtgaagcgataggtgaccaaccgtctgcaaatgagttgttagccttgcctgcttcaacagcctgtgggttatggaagccgttataaagaccgataaatgaatctctgtctgtatcatagccgtctatctcatcatttactgtatagaatgcaaagtgatctcttctgtctctgtattctgtcttgtgatagatggttgaacctactacctcaacacggcctgtgctgaagtttctctggaagtttgtgcagtcgtcctgagcgtcccaaagacaccactctgcaaatgagaagaatgagaatgttttttcttcattgctctcgtttgtgagaactacctgctgaacttcgccgttatagttctgaggaacaaagaatgtagcctcagccttaagtccgttcttcttacctgtgatgatagtatagcccataccgtgacggcactcataaaaatcaagctctgtctttaccggtgaccagcccggattccagatagtttcgccgtctttgatatagaaatatcttccgcccatgtcgataggcacgttgttgtaacggtaacgagttattcttctcagtcttgcgtccttatagaaggaatagcctcctgctgtgttggagataagtgagaagaactcctgtgtgccaagatagtttatccatggatatggcgttcttggattgctgatgacatattcctttttcacgtcatcaaaatgaccaaatttcatcaataatttccacctttcgtaatttatctattgttaattaatttcttaattataacccatacaaatgcgtatatcaacgggtgacctcagttcaccactactgcattttctattattcagtaaagaatctctgccagcacttgaatgtgtgaccctttgttatctcctcatatccgctcacttcgttaggcaggctgagattaggagagtttatcatagctgtcattggttcagggcagaaatatcctttattgcccttatcgttccacatattccagaacttaaattcttttgacacctcgttgcagactttatgaccgttatcggtatccacaacataagagccatagaagtccttaccgtcaagcttgttcatgcctgcggtatacatatcgtttgagatattatgcagggtaggcatttttgtaccctctttatattcaaggtctttctttttaagaggcaaaagcttttctgttggcagacatctcttgtcaagctcgcacttttcgattatcggcacgcacattctcattgattcctccctgccgccgtcgcacattggcgcattaaggcaggtatgagtacatatggaaacaggcagagccttgtcgctgttgtttgtcaggtatatctcctgcaaaagaccgttttcagaaagcgtaaacgtataggatattttaaaatccaccggaaaataagaatacatctcgtcattcttgtcaaaggtataagaagtaacaagcacaacttttttatcctgtgttgaataacactctatttcgtgttctctcttatgcacccagccatggataaaattatcaagctttttctcatttacaggcatttgatacactgcgtcagaggtctttataatgcccttatcaaagcgattaggcaagaaaagagtaggcagtccccatatctctctcgccttatttatagtcttgagagtgcagtcatcacgatatctgaacacctctatgccgttttcctcgtcacgaagcctcagcacagaagcacccagttttggtgcgataacgcaggaatactttcccgactgcattctgacacattccgtatctttaaacatgaatttaaggtctatattattcaaaaaagtaacgcccccatagtgcaaagcgatgatcttcctcccgctttaccatacatttttacttaaacgattaacatacaatcattataacatagcccgtcgcttttgtctagtacaaaacgcagatttttatatagaattttagctgtgttttttagtagttttttaccaaacgttcaatgaataatccaaaaaaatatgacaatactacaatcaacagcccgctgacagacggactgctctatattttaaacaatcaaaggaggagtttctcatgatagataggatcgcactgctgcttctcataataggcggcataaactgggggcttgtgggcattttccagttcgaccttgtggcatttcttttcggaggtgctgcagcgatactaagcaggatcatctacgttttggtagctatttcggctatctggtgcatttcactgtttttcaaagacaacagacttgtcaccgagcagtagtcccctgcaggtcatgacggcaggagagggagcttgtttcagagggcagcattttatcacgggtttgcttgctgcatattctaaaatcggctctctttcctgctgtcatgaccttatttttttgttttaaatattaaaatttgaacatcgcaggcactaaaaatggataagatattttacttttttaagtcgatttaagttcagacctcacgcagatgtcattgttagcataatgtcaacgaaatatttgtgcaaaatcccgaattttcagaaaattaacaagttctttgcaactttttcttgactatcgctacaaaagaggttataatttaattgatgttaaggatattgaacataatttgtttgatttaacatccgttttgttgtctcctttcttttgttctacacatagttttttttattttattttctgctgagcaccgttgctcagcattttttttgcccattttatgcacacgttgaaaaattcatattttagagttataatgttattttatggactaataaaacaatatgtcagttcttacctgtcaaaacgttttcgtcgtgagagaaaggagtaaatagaatatgagatatcttatagttgttgatatgcagaatgattttgtcacgggcagtcttggttcaaaaatggcagaaatgatcgttcctgctgtctgtgaaaaaatacgcaattacaaggctcagggcagcactgtattcatgacccttgacacgcatttcaaggattatcttgaaacgcctgagggaaaaaagctccctgtggagcattgcataaaaggcaccgagggctggcagcctgagactcaggtagctgaggctatcggtggaagcgcagaggtctatgaaaaaagcacattcggctcgactgagcttgcacagcaccttgctgaaataacaaaggcaggggacgagatagagctttgcggactttgcacagacatttgcgtggtatcaaacgctttgctaataaaagctttttgtcctgaatgcgaggtcatagttgacgcaaacgcctgcgcaggagtaacggaagaaaaccacaaggcggcacttgttacaatggcgtcatgtcagtgcaggatagataatttttgatttgagggggaacaccgcttcggcggaatgatttatgagtggtttcaaaaaaggtcttaaagacggcatacctattgctttggggtatctttcggtatcttttacattcggacttcaaggcgtaaaaggtggtctgagctggtgggaaactgtgcttatctctatttgcaacgtgacctcggcaggtcagttcgcagggctggacattatgctgtcggggggcggtttctggatagaaatggcttgtgctcagtttataatcaacctgagatatgcccttatgtcaatatctctttcacagaaagctgacaagtcactgtcgggaatacaccgctggctggtaggcttcggagtgacagacgagatatttgtcatggcaatggggaatataggtgaagtttcaaggcagtatatgtatgggcttatcgccttacctgtagcaggctggtcgctgggaactcttataggtgcggcggcaggaaaaatacttcctgagatagtcataagcgcacttagcattgcaatatacggaatgttccttgcaataataataccgcctgcaaagaaaaacaagggcattgcaatggcggcgatatttgcggctcttcttagctgttgtttcaagtggctgcctattcttaataaggtatccggaggattttccataataatctgcaccgttctttccgcaggaataatggcggctctcatgcctgtgaaaaatgaggaggactgtcaatgctgagtataagagatttcttcatttatcttttcattatggcaggagtgacctatcttattcgtgccctgccgttggtgatattcaaggggaagataacaaacagatttgtgcaaagctttctttactatgtgccatatgctgtgcttggagcaatgacattcccgtccatactattctcaacgggaaaccttgcggcttccatagcaggacttataacagcctgcgtgcttgcattcaaggaaaaaagccttatcatagttgcggcatttgcctgccttgcaagcttctgcgtgatacttatttgtcagcttatttaaatgtaggggctggcgtcctcgatagcccaccggctaaggacgttgcatgtgttctttactgttatttagacatactttgacctttctgctatatgcggagaggtctttattattactatttttatatagcatatgaaatatcgtaaatgcagtataaaattttcggctagtttcatattcttttcttgcaaaaaattctgggctgtgatataatcttattgtgtgaaaacgtttactgtttttgatctatgacaaattatatggaggtattgcaatgtcagacacaatgaacatttctcctgagctcttggagaaaatgaacaggtattgggaagctgccaattatctttcggcaggtcagctctatctgcttgacaatccgcttctccgtgagccactcacaatggatcacgtcaagaaaaagatagttggtcactggggtactgtacctggtcagaactttatctatgttcaccttaacagagtcatcaagaaatatgaccttgacatgatctatatttcaggccctggtcacggaggaaacttcatggtagccaacacctatcttgaaggctcttattctgaggtatatcctaacatttcaagagatgttgagggtatgcagaagctgttcaagcagttctctttcccaggaggaatctcatcacacgttgcgcctgaaaccccaggttctataaacgagggcggtgagcttggttattcacttgcacactcattcggcgctgtattcgacaaccctgaccttatcacaacttgcgttgtcggcgacggtgaggctgaaaccggtcctcttgcaacagcatggcactcgaacaagttcctgaatcctaagactgatggtgctgtacttcctatacttcaccttaacggctacaagatatcaaatccaactgtattctcaagaatttctcatgaagagataaagagcttctttgagggttgcggctggaagccatactttgtcgagggcgacgatcctatgacaatgcacaagctcatggctgaaactcttgacactgttatcgaggaaataaaggctatccagaagaacgcaagagaaaacggcgttactgaaagaccaaagtggcctatgataatattccgttcaccaaagggctggacaggtccgaaggttgtagacggcaagcagatagagggtacattcagagcgcatcaggtaccaatgacaatggaagctcctgagcatttgaaaatgcttgaggattggctcaagagctatcaccctgagaagcttttcacagaagagggcagacttatccctgagcttgaggagcttgctcctacaggcgacagaagaatgggtgcaaacccacacgcaaacggcggacttcttctgagagatctcagacttcctgatttcaggaaatacggcattgatgtgcctgctcctggtgcagttgaagcacaggatatgatagagcttggcggatttgtaagagatatattcaagcttaatgaagaaagcagaaacttccgtatcttcggacctgacgagacaatgtcaaacagacttggcaaggtctttgaggcaacaaacagagattggaacgctgacaagctcgacaacgacgagttccttgcctctgacggtcgtgttatggactctatgctttctgagcatatgtgcgagggttggctggagggctatctgctcactggacgtcacggtttcttcgcaagctatgaggctttcatcagaatagttgactcaatgttctcacagcacgctaagtggctcaaagttacttcacagctcccatggagacagaagatagcttcacttaactacatactttcttccaacgtatggcagcaggatcacaacggatttacacatcaggatccaggcttcctcgatcacgttgcaaacaagaaagcagacgttgtaagaatgtatctcccaccggacacaaactgtctgctgtcatgctttgaccactgcatacgttcaaagaactatgtaaacgtaatggtaacatcaaagcacccaagacagcagtggctcacaatggagcaggctgttaagcaatgcacacagggtatcggtatctgggaatgggcttcaaacgatcagggtcaggagcctgacgttgttctggcttgctgcggcgacacacctacacttgaagcacttgcggcagtaactatcctgagaaagaatcttccacaggtaaagataagatttatcaacgttgttgacctgttcaagcttcagccacagtcaaagcacccacacggactttccgacgctgactttgacgcactgttcacaaaggacaagcctatcgtatttgcattccacggctatcctacacttatccacgagcttctctatcatcgtcacaaccgcaacctttatgtatgcggctacaacgaggagggtacgatcacaactccattcgacatgagagttcagaacgagatagaccgtttccaccttgttatggaggttatcaaaagacttccacagctcggaaacacaggcgcttatctccaccagctcatgcaggacaagcttgttgaacacaagcagtatattgctgaatatggtcttgatatgcctgagatcagagattggaaatgggatatctgataaaaaagcctttctattaattaaatatacccacacaaaaagggacttccgtttattcgggagttccttttttgtgcataaaaatatcccccgccttgcgacgagggataaaaatactctagcacataaattactttctgttgtttgctatctttgcaagaagattcagtattttaagataaagataaataacgcctacgataagaccatagcttgcataccattcatactgagcaggaagcccctgttcaactgtcatctggatagtttcaaaatcacacataagaagcgctgcggcgataagaacgccaatagcagcgaaaagtatgccgatagggccgttgtttattgcaacgattgaagtgtagatagctgaatgaggtgcgagccatgcaagaagcatgaagagcacgccgcctatgatagaaacccaaaggcaggtgataagagcagttttcattctgcttcccacacgaacgccctttgaatagataactgcaagcactgcaactgtgagaagcgtcagtgtaacagcttcaactattatgcctttccactgcattgcgtagatcattgacataaaggtgagggcatatcccatgcctgcggaatagatagagcctgtgaccgccgttgttttcggagcgaatgaagccacaagtcctgctattgctgttgcgataagagcgccgacaaagatagtatactcagtggaaaaagcctgcgcaccgccgccgaagaagttgtgaatgtaaaaatatgctcccatgcctgcggcgaaaactgcaacaaaatacaaggtcttcattgcaatgcccttatagcttgccgcctccatgccgtaagtggactgtgcaaaagagcgcagctttttcactcgtggatttgaatagctttcagaaaaattgttataatcgttcatgaatttgcctcctttatttttttcgccaatatttattttcatggcttatatactattatacatattttcttaaaaaagtcaatatgatttttcaggcaacaacgcaaggttcttttttgggacttgtccgcatatgatgtaagcaaaggcaaaagcactgaaaaatcttgtgcagtcaaaatgtttcgcacaatgttatcaaggctatgccaaaaaatcggaaaggaagatacattgtgctggatatacttgaaaagaagcttacggaaaaccagaccacaagaaaggggctaacaactgcggaagctgaaaagcggctcagtacggacggagagaaccgccttgccaaaaagaaaaagacctctgcggcgaaaatttttgcaggacagtttcatgacgttatggtgatgatacttcttgtgtcggtggtgatatccgtagcacttgggcaatatgctgacgctgtgcctatcgtgcttatagttatcattaacgctgcgctgggatttattcaggaataccgctgtgaaaaaactctggaaaagcttgaaaatatgaccgctcccaccgccatggtatatcgtgacggcaggcttgtgaaaattcctgcgtcggaggtcgtggcaggagatgtttttactctcgaagcaggtgacagagtgccttgcgacggctacataaactcatcaagggcgttatcatgcgacgaatctgcactcactggcgaagctgtgcctgcggtaaagaaatgccgtacatctgagatagattttaccgctttgaataaggattacatggtatacatgggaacggtggtaacaaagggcgttggcgaggtcacggcggtggcaactggtgagcgaagccaaatgggcagggtttcaaccatgcttgatgagataaaagagcctgaaactccattgcaaaagaaactcggagagcttggcagaactcttgctgtcatctgccttgcagtgtgcgtggtagtctttattgcaggcgtactaaggggcgagcctgttctcaatatggcaatgacaggaataaccatagccattgccgcaatacctgaaggcttgcctgccacggtgaccatagcgcttgcccttgcggtcagaaaaatgctaaagcgtcaagcacttgtacacaggcttcattcagtggaaactcttggctgtgccactgttatctgcactgacaagacaggcactgtgacaatgaacaaaatgacagttactgatattttcacctgcaccgagaaaagccgtgcttacagcgtaacaaaagagggagcaagctttgatgacaaagccctcaaagcatgggaaagccctgaccttggcaggatacttttatgcggcgcagcctgcaacaacgcaaggctctgcccgcctgagaagataaaaaaacgtgacaggggaggcaggcaaagcgagctttgtgcagaaggcgaccctacagaaacagctatactcatagcctgcgcaaactcaggtataaacgtcagctcccttggttacagacgaactgacgagcttccatttgaaagtgaaacacgctccatgacggtaatatgcgctgacgaaaagggggttacaacggcattcagaaaaggcgcttttgacgttatcataaaagaatgcagccacgttttttctgacagcggcgagcttttgacatttggcggagcaatgagaaaacaggctttttacaagtgcgatgaatacgcttcaaaaggtctgcgtgtgatagcattttcacagcaggtggacggggaatgggcttttcttggactaatggcaatgaaagaccctctcagggctgaagccgcaaaggcggtggcggaatgtcagcgtgcaggcataaagacagttatgataacaggcgaccacaagctcaccgctcaggctattgcaaaagaagccggaataatgaaagcaggctctatcgctttgacaggcgacgagcttgacagaatggacgacaaacagcttgacgaggtaatagaaaactgccgtgtgttcgcaagggtgacacctgaacacaagctcaggatagtaaaggcattcaaaaaccgtgggcacgtttgtgcaatgacaggcgacggggtaaacgacgcacctgctataaaagaagccgacataggtgtatcaatgggaatatcaggcacagaggtcacaaagcaggcggctgacgtgatacttcttgacgataattttgccaccattgtgaactccgttgaggagggcaggaccatatatcagaacataagaaaattcgtgcgctaccttatttcctgcaacataggcgaggtcataacaatgctcggtggaattttaatggggcttccaatggtactgcttccagcgcagatacttcttgtaaaccttgttacagacagcctgcctgcaattgcgctggggcttgagcctgcggaaagctcggtaatgaaaaagccccctagaaaagaggacgacagctttttcagcggcggacttatgtggcatatcgtaataagagggcttcttatcggtatctgcacccttgcaagcttcactgttctgctcactaacacccattctctcggcactgcaaggacaggtgcgcttataacacttgtacttagtcagcttatccatgtgtttgaatgtaaatcggaagaaaagacacttttcactgtgccttatctttcaaacccattcctgcttttctctgtattcatatcagcggcagcactgtttgcaggcatatggctccctgttctgcaaaaggtatttttcacagccgttccgagcctcggagagtttcttgtggcggcgtcagcggcggctatcgtgcctgttggggcaggaataataccaaagctttttatgggcaaaaaatctcctgacgtaacagtgaacgccccgcagggatagcaaaagaccgacagggcaaagctttgtcggtctaattttttaatccatattttttatccagccttttaaatatcctgccaaagggttttgataaaaccagcaggaagaacacgtttgaaactgcgtatataagggtaaaaaaagctgacgagccaacaagggcaaggtatctgctgagaataaatgcgttatcagcccacagacagctccacaagtccatgataagagaaaacgccattcctgagattatgccgaaggtcacaaggagcggcttgctttttataagcttatcagccaacattcctgcaaaatatccggtcagaccccaaaccagcatttgaaaaggcgtccacgcaccctgtccgaaatagaagtttgagataagtgcggtcattgcacctgtcataaagcccgattctcttcccatataaagggcggtgataatgactatagcggtgcagggcttaaagcccggcagaaagctgaaaactatcctgccgaaaactgacaatgcggtcatggcggctattatcacaagctgtgtactgtcggaatgctttttctcaaagtggagaaaatagcctgccacggtaagaatggcaagtgcggcggtgacaaaagaatagaagcgttctctgaaaaacattatgccgccaaagcacacaaggggtatgacaagaagatagataagccctgacacaagttttttactgctcattttgacctcttttcaccattgcgagccgttctcttacggctgttgacgtcactgcaccactgaaaaagccccttgtgagccttgcggcggcggtggtgtaaaagcgattttgggagaaaaactccacggcattatcctcggcgactatcttcccgtcaaaaagaagtccgcacctgtcgcagtattgtgcggcaaattcaaggtcatgggtcacgagaagtatcgtcctgccctcgtcttttatgtccaaaagaatatcaccaagagcctttttggcgaaactgtccatgccctttgtacactcgtcgaggattattattttcgggtcagcaagaagaattttagcaaaggcacatttctgtatctcgccgccgctgagatcccaagggtggcggtcaagaagatgttctatgcccatgcgctgtgaaacattttccactgcgactttgtcaccgctttgcaaaagatcctcacggacgctttcttttacaaacattgtcacaggctcttggggcaaaaatgcaagcatttcacggaaaagcgagccgtttttataggctttctgctttttgccaaaaagtgaaactgcacccatataaggcttgcaaagtccgcatatcacacgcaggagcgttgattttccgccgccgtttgagcctaaaagcccatagcactccccttttctgataccaagatcacagcctttgaggatatcgggggagtttttttcatatctctgccacagatttttgcactgcagggcataaggctcagcacgttctgtatcagtgacagcctgctttggaatatccgtcacgccaagcttttcaagcttagccctgccttgtcttacattgaggggcaggtcatcgcaaagccttgcgaacgccttggcggtttcgggaagaaaaccctccagagcgttctccacaaaatattttgcagtcaaggcaggcgtaccgaaaaactcggttttgccctttgcaagatacaaaattttgtcgcaggagtcaaaaagctcctcggggtcatgctcggcaatgatgatagtcacgcccatttctttgttaaggcggtctaaaatgccaagaagctcccttgcggcaacggggtcgagctgtgcggtaggctcatcaagaagcaggatatcagggtctgtggccatgacggaacacagagcgacgagctgtttctgaccgcccgaaagtgtggagatatctctgtcatagagcggctcgataccgaaaaaagccgccatttcaccaacacggctttgtatctcaccacttttcacaccaaagctttcaagcccgaaagcaagctcagccgatactttgtcgcataccgtctggctgtcagggctttgcattacaaagcctatcttttcggcactttctctatcagaaagctcgcttctgtccttacccataagggtgatgttgccggaaagctcgccccttggggaaagctctcttttcagaagcctgagcaatgtagattttccgcttcccgaagcaccgcagagcattattttttcgccttttttcactgaaaaagtgcagtcagaaatggcatagtccgtgctttcgatatatttgaaagctacattttcgcaagacaatatttccattttatgctctcctttacttcaagaataaacgggaaaacgcatagtaatgcgaacattcccacaggaaaaacactgttttcaagctttatcacagggtaaaaagcggcggacagcccgccctttgcggaaaatatcagcaccaatgcaaagataactgcaaaaaccgccacaaaaatgccgtcccatgctctgaacttgaacgagtgtgcaaagcttcgtttctggataccataaccacgggctttcattgaagcggctgtgtccgctcccctttcaagcgtgcctgcacaaagggctgtgaacactgtgcagtcttttttcaggcggtcaaaacggctgtcggagatgttcgcaccagagcaattcaaagcgtccaaaagctgtctgtgaagccttttgagctttgggataaagcccattgtcattgttatcacaagggcagcttttggcgtttttcggccgaaaatgtataggagcttttcccttgtaagcacctttccaagagctttgcaccacattatcacagcggtgagggataatccagcggtcaagccataaaaaagggcttcctttgtgtaagccttgccgtttacgaaaaacagcggcgttacgcccttatgtgaaaaaagtggatttgtgacagtcaaaacggcggtaagaaagatgtagaaagcaaggtctgatgcggtctgtctacagctttgagttatggcacagaacaggaacgctcccactgccgagcatataccaacggctggtgaaaagcagaacattgtcaccgcaagcacagccgcaaaatacacaagggcggtcaaagggtgaaaagctgacaacctcatttcaccgcctcctttgtgtagtcgcaaacgtagtaaaactccacgctgtcaccgtcatggaggacatactgtgaacagcccttatcggggctttcgccatttacagtataggtccaccctgaggacggaccgcaggaaaactcgtagatattgtttatgccacggacatacactgtgttgtaaatattatcctctgagccttgataatcaagaggtatcttcccgcaccttgtagctttttccaacagatcaaaggcggtgtcgccctcacggaggacatatttttccgcaggcataacaatgccgtctgagggaacatagcactcgtcacggagatttttgtcaagcatatcgtaattatccaaaatatcagagcaatccactgtcagagtgacagtgtgagcggcatttgcagtatcgtcgctgtgcaagctgtaatactcgtcaacggactgaatatcaacgccctttatgaccgctgccgctgctaaaattatgactatgagcagagcgatatcctttttcacttttctgctccctcctgacctttgagctttttggctttctttgcctgatctgcgaaatttttaaccactgctatttcctctttggttatctcgagccttgaaaatctcgccttttcgtatattttctcgcactctgcgaagctttccgccatatcagcgccaaaggtcttttttatgctctcgaaaagctcccttggcgtatggtctgagaaatccctgccgcaaagcttttttctgcctgcaaagaacagcttctccacctttttgctgtcaggaagagcggcaaactttctttttcttaccaaagctattattaccacaataaggcatagtataagtattaccgcacctataacgatatataccgcatagcttttctccgcaggtttagtcttgttctcctcaaagatctcttcccttggtttgtcctcgtcctcgggagcaagggcttcaccgccttggttggtaggctttgcttttacagagctgtcgtcagtttttatcatgccaacataatcggggcagacctcgaaaggctgccagcctatgccgtctttgtaatactccgcccaatagtggagctgttttgaagtgacggtcagggctgagttatctgtaaggtctttggtcatatctgatgtgataaaatatcctctgcaaagcctggcaggaacgccctttgcacggaagatcttcacagcagcggcagcaaaatcctcctcgcctccacggcatgttacctcaagcatatctgcaaaagagctttcgcccccataggtctttgacctgtcaagcactgtgtctgacacaaaaaagcttagcatatcagaccgcagtttaccctgagaaccttgcagatcaaaatggtttgcggcaagctgtttgtcctcggctgatatgtcaaggcaggtggaataaacatagtcacgataacccttttctgcggcaagataatccgcaggctcagaagtgcgcagggtatcaaatgtgccaaaaggctttgtgagatagccttccgacaccgcaagcctgtaatagcttttggtgttctcaaagcttccgcctattatctttgggtcggaaaaagcgttctctgcggcggtcataccataggtataaaggggctttccgccatttttgatgtttactgtaacattgccgctgtcggatatatcaatggcattgtcaagcaaagcggtctgaaaagccggtgagaaatcaagcttatcaagccaatagaactcatctgaataggcatatttctcctcaccgctaagctccccccacacgccgttagtttctttctcaaaacggctctccataagatacaatggctgtgggtgctccattatgatctcatactcacttttcgtattaaagcgatcggcaaaggcaaagttggaaagcttatcaaaaagccctgtcaggcaggctataagcactgcgcaaaatgctgtaagtataagcacaaagagcttcaaatcgccttttatgctgccggaaaacgtcaatgcaaggatacctaacgcaacttctgcagtggcatagtacagagggatatcaataaagatacctgcgcacaaaaacagcgcaagcattgccactgtaaaaactctgctgtcaagacggctgaaaatgctctgcactgtggaaactatcactgcacccacgcaaagagcaaaccaagggtctgagcttttttccacaagcatttccaccactcctgcgcttttaccgtgggcggtcaagacgcagttcaaaagccctgcaaggcttgttaaaaacttcttgtggaatatcaccgccgacaatagtgcggtgaaaaatggtataggcaaagtcttttttgatacccctgcaagggctgtcaataagcacacacctaccaggacaaaggctcgccagcccataccaagcgacaatgacagcaggagcattgtcactgcagcaaaaaggctctgcatgatataaacaccctttgaaaagtgcttttccacatagcaaacacttgctgtcaaaattgtcacctcttttactattttatctcgataacacggcttatgccgcttctttcaaacagctctgaaaactccgtcagccgctcttttccctgctcaggcagtgaagaaagaaggctgtccagagcgacagtgaaactgtctgcgctgtcgatatgctcgaaaacttttctctgctgagaaaagctgtaaaacgccatgtaatgccctataccgccgtctgaaagatacattgaaaggctcagtgcctttgcggcaatgcggtcataatccgctgcggggacatttccgcctgtttcaacgtagatacaaaggctgtcagtaacaggctcgccatattcacggacgtagatatcaccaagtctgaaagacagcttccaatgcaccgatttatagctgtccccctgacgatattctcttattccgataggctcgctgtggtcaaagccctcgttttcattgctgaaaaagtcgctttcaagggcttccttgagctttgcttcctcgctctcatctatctctgctgcatcaggcattatgttcacactgccctttatttcgcactgcgcctttttccatgtcagccctgtaaagtcaaaggctctaagtgtcagaaactctgcttttatctttccgcaggtgtcgctttttacagtgatatccacctgagcaggctctctgctgatgataaaatgcacctttatgtcctcacactgtcctgtgagcatatttctaagccgcagtttactgctgtattcgccgcaagttcctgtgaagataaaattaaggctcatgtccttatttttcaagcctgtgtcgtcgcttaccagtgttgctgacagctttttctttgagaatatatttacacatactgacaacacaaaaagcactgcacacaacccaagcaccgatatgccaatgggctttttcagcacaaaaagcagtatgccaaaagctgtgcaaaggcagaagcatagcctcttcatctgcgtttttcctcattctcagggcattttacgctgccaagtatctcgtcaagcacactttctgccgcaagtcctgagagcctgccctttgcagaaagtgatattctgtggctgcaaacatggacaaaaaaatctcttacgtcctggggaacgacatattctctgcccttatagcacgcccacgcctttgctatcctgcaaagtgccaaagcacctcttggggatacgcccagagaaatattttcattatgccttgtggcgtcgcaaaggtctgagatgtagtcataaacgctgtcgtcaacaaaaacagcctttgccttttcctgcatttctataagcttttcagcggtgcagacggctttcacatctgccagtgggtctgaactgcttcggtctgacattatgcttcgcattgccgccttgtcaggatagcccattgaaagctttatcataaatctgtcaagctgtgaaacaggcagtgccgccgtgccaactgtgcctgtagggttttgtgttgctatcactgcaaaaggctcaggcagaggatatgttctgccgtcaactgtgcaggcccgctcctccatgacctccaaaagggcagattgcgtcttgcctgaggttctgtttatttcgtctgcaagaagtatattcgtcattgccgcaccgctgtgaaaagtaaagccctgcgcctgtctgtcaaaagccgtatagcctgtgatgtcggaagccacagtatcaggggtgaactgtatcctctttgtttcaagccccaaagcctttgaaaacgccacagcaagagtagtttttcccacgcccggaacgtcctccataagcacatgaccctgcgccaaaattgcggcaaacaccatatccaccacttcgtccttgccgattatgacctttttcacttcatctgttatctcacgcattttttacccttctttcttaccactgtgaaaactcccactgcgcacagcaccgctgccgcagatatcacatacactgtcacgtttttatcctccgcctcttttattatctcgtcagcagaagtgacctttttccgctcgctttcaggaagcttttttatcctctctgcggtcttttccaaaagctcctttttgtcttttccaacactatcaacaggataaagctcacggcttatgatactgttaaggtctgatatctcactgtaaagctcgttcgctttggagttcatttcttcaagctctgatattatcttatccctgtcggaaaggctctcgtcagcctttgcatgggctaaaagcacagccgtagcagtgcagtcccccgaagtaacaccgttttttctcagggcttcaagcttgttcctgtcgctttttgtaaagcctttcttgcccttatatatttccgttttctcgatactgtatacacaaccgtttccatggtctgtctgtgcaagctccactgtgaaagccctgtcgctcaaggtcaggctgtatttttctgccgcattttcaagctctgcaccgtatctcacatatgtgcgttcgtcacaatcaaggtcattgaaaagcttcaaggctttttctgcgctctcctcgtctgagatatccgaaagcctgccgtttatgccgtcaagcttttcacgctgtagaactgaaagctcctctctcatatcgtaaatacgtcgcatcgtaagttcaaaacgcttttgtgccgcaagtgcgcaaagcgcctgccctgtggcaagctcgtcagaatcgccgcccttttcatgtgaaaatccaccgtcgctgttctgataggaaagcagggcggtcaaaaggtcggcatttttcacaaaacggctgtcagcttcggggtctataccaagcgaacaaagtgctattactacctgcgaatcagcttctgcacttccgaacgtacctgagctgtcctgcttgccgcttagatactccaccgctttgtcaacgctttttctaacatcgtcacgggaaaaatcattgtaatatggggcgatcgcctgcaaagccattgcggtgatgtcgatatcgctttcaccttttgacagcgaaaagccaccatcggtattctgcgaagaaactatctcgtcaagtatacgctctctgtcaaactctgcaccctccggggtcttgtagcccattgtatcaagggtcaaaagtgcaaatatccagccgttaaggccctgtttgcctacggaattattttcatctctgccgtaaacaccgccttttacaagatctatgccctcaaggtcggcagggtcgcctcccattgcggaggctgttatagcgcacctctgccactcggtagcgttgtcggtatctgaaagagctttcacacgctgagaaagcgcagtgagataagcctcatagtcctcctcaaaaccaaagcgtgaaatgcctatggcaagccaatctgagcttcctatgcctgcgttttgcagaaaatcccccgaaaaaatgctctcgtcctgagaaatgcccattttgtcacgctgccactgacagaccttttctgcgctttcagttatcctgtcccttttatctgcgttatctgcattcaccgcaggaacatttgtcagaagcattactgcccctgcaaacaccgccactaatctgccaagaaaacctctcgttttcaacaatatcctactaccatgttttgtcatagctatcctgtgaacctgttatatctctgccgtaggcaactgtgaacgcaagcctaacagtgtcgccgtcggtgaagttcaccttgcccatgccgtatgcaggcatattgccgttcacagtgtacacccagcctgagccgtaggtgtagtcaaattctccaaggctgtcggcatactgtgtgccactgtctgcaatgccatcattttttacaagctccgcaagctcgctgtttactgctccacctgaaaacgcaccgcttttgtgtattcggcttagatatctctgatcgcccttgcctgtaaagtcacctgtgaagccgttttgctgaagaaaacgctctataacgtcaacgcctgtgtccccctcgtatattgccacctctgagcctgcggcaagctgtccaagccctatggtatcggcgtcaaagctcattgttataacgcctgtctgctcgcccttttgtgcactgacagaatttatggtataggcatgatccgcatatctgccctcggggtcatacacccttatttcaagaagatttgccccgcccgaaagctggagataataggctgaattcctgtcctgtgcgatacactcaacagaaagcccattgagccagacctcggtcttgtcggcatatatccttccgccctgatagtcctgtgcgttaaatctgagggtaaagcccgagcctttcactgtctgtccgttggtgacgtttatatacgttatctcaggtcttgtggtatcgtcagcaatgggtacataggtgacagtgaaatatctgtctatatttttgtcaccgtcttttgcataaagccttatacggttatcaccgctttggagggtgcaggtataattatctctgcccgaaagctttttgccgtttagaataacgcttagctttgcactgccgctttgacctttcattctcgcatagaagctaaaatcggcgtcatttacagtgcggtcataaaggtcggtatcaatggaaaactccgcaggagtgtattttatcttaaagcttttttcagcctttgagccgtccttttccgcagagagagttatagtattctcgccctcagaaagctgtgcggtaaaagtttcaccactggaaagcttttcaccgttgacttttactgtcaaaggtattttatcactgccgtaaaaagctgtggctgaaaatgttatgctttctgtgtcagtatccttatccgcaaggtcggtgtcaaaggttatctcctttttatcaaaataaactgtataatccttataagcccttttcacctgaccgcttttgtcggtataagtgcaggcaacacggatagtgttttttcctgcgtgaagggtaacgctgcccgaaaactgatttacaacgctgtcgttcacagtgacctgaactttttgcactgtgagagctttgtttttatgtgttattgtgaacttatacaggtttttttttacacgctcgccctcttttatagaggtggtgaaatattctgtgtcggtgttctttgtgacagtttcggtcttgctgtcaggctttttctttacctcgtcagacttattttcaccttgggcatttatggtaacattcgtgttcccgccatttactgtcggggaatttccgtcgcttttgtcagcctgcggagagctttctgttgtatctgtattgctgtcgctactatcagtgttatcactgtcatctgcctgtgagctgtccatatctgagctttcgtcctttggctgagagcttgtttcatagccctctccgccctgtccgtcctcctccgcaaggctttcagacagtgctgaaaacggattttcaggtgtcttataactgctcatattataaaaacgcatacacaaaaaagccgctgcgataaaaaacgccgctgctgacagcattattatttgcctgtttttttgtgtatgctttttcataatattctcacttttcatatcacagaaaatgcccgccccctgaaaatagagggcgagtatcctgcaaaataacttatatcttaattgtctttattttttttactttctctttcttgaaactgtaagagctccgctgataagaagtgcaagacctgctacgcaaacgcctgctgtcgcacctgtgttagggttagccgcacctgcgttatttgctgtctttgatgagctgtcagccgcctttgatgtgtcagcactgcttactgactctgaagctgatgaagtggcagaagatgtatcctcagagtttgcagaagatactgtgctttcggaagatacgtcagatgagcttacagagctttctgcttctgatgaagagcttggtgtcttgagttcttcaagcttttcctctgcggccgtaagagcgtcaacattgcctacatattccttaaggtcgccaagagcgtcataagcgactcttgctgccttgatgtcattctcgctgtcaagtgttatctcgccaaggtcactgataagcttctcaacagcctttacgctgtcataatcctctgctgcaagaactgttacgtcgatagttgcttcaacaggtgaaacggcaacgcctgttgtgtttgctgcaccctcttttgtcttatctctgtacataccatacttgtatgtaacagtaacgaaatcatcgtctgctgtaagagctgtatcgtcgatagtcacataatctgtaacgtctttcttcacaccgtttttgagaactgcgtaaaccttcaagtcggaagcgtcataagcttcgccctctttgcatactgtcttagcattctcggtcacaagcttttccacctctgagccgacagccattatgtagcctgaatcgttcttgaagtagatagtgccgttttcgtctgcaacaaggtcagctatagcgtactgtgcctgagcgcccgttggtgtgaaaagtgacggagctgttttctttccgtttactatctgagcgtcaagaacttctgttacgccctttttatcctttacatagcggatagcgcctgctgatgcgttctctgagaagtaaacatagttatagccgttctcattcacaacgccaagacctgatgtctgtggatagccctttgtttctgccttgtatgctatctcaaagctgtcaaggtcgataactgcaataacactgcccttatagtcgccccagcctgagccgtttacgccaacataagctcttccgttaagaactgtaggagttgatgtgcttgcgccaccaagtgcaatgctgtcaagctttgtgaaattgccctcatcgtctattgttgccttatagaaatagccgccgttagatgtgaaataataagcgtctgtatccttatcgtaagaaatagtgcttcttactcctccgcctactgtatactcagtatctataacgcttcctgagtttttgtcaagagtaactattcttgcagggtcggtagtgtttgccattgcattttccatgccgagaacgacaaaatcatcagttgcatatgcgcctgcccaatagaagccgcttttgtttgtgaatatccactttggtgacttctcttcatctgttgtgtcaggatcttcgtccttaacgtctatgcaaacatactgatcgttttttcctgaaccatcgttgcagaagcctgtgtagatacagccgtcattatagtagatagggcttacagactgaccaccaacgctgtccttgtatacccacagcgactcgagggtgtcagcgtcaaatgcctgaattccgccgttaaaggctgagaatatcatgccgtctgcataagtaacaggctggatggcgtagctgtttgtgcctgctcgctgtccaactactgaatccacaacgcccgtttccttgttcattctcatgagcttgtcgccagatgtataaacgatattatctccaacgatagccacaggcgacggaccatcgttccagctttttcctaccttagttgcccagttaagcactgcgttatccgcactgtcagggaggactgatgttgttacgttgttgtttgttccgtctgaaacaaatgcgcttacacacacgctcagactaagagcagtcgcaagagcgaagctagctgttctcaaaattttcttcttcattcttttctgtcctttcgttgatacacactgttccgccgtcaatgcactttttatgaacaccccgaccacagcaaaaaatgcctttccgccgaaacgaaaaagcattctatccgctttactgcctgcacagcgataaagcagaccgtcatcttcatcgcccaagacagaaatagtcaacgaaaacacagcagatacctgacttatgacagcacacaaaaagcctgtcaaacacagtaatggcggttgtgcaggatttggacctgcttccctgacggtaaggcttttgccctgacacgctctactcagctaacaacttttcaaactgtgctttcttaatattcacatcatgataattataccatatcgctatggattattcaataacctttttacaccactaataagtccgatacaacgccgtttttgtggcattttcataaactcatagactaaaacttcgttgggtatagttttaggctataccctcagtttctcctccagctccgtgtcaggcttgacagtgatagtgtagttgtttgtaaaaatgaccatgcccggctttgagccgtttggctttttcacgtttcttatgaaagtgtagtcaacgtccaccctggaggaatttcttccctttgagttgcaggcagcgattattgccgcttcctctattgtcctgtcaggtggcatttccccgtcgcaggtgacgataacgtggcttcctgtgatatctttgacgtggagccaaaggtcagttttctctgcttccttgcaggtgaggcggtcgttctgtttattgttcctgcctacccttatttcatatccgtcagaagaacggtatcttataggcggcagagcctttggaggcttgcccttgaactttgagcgctttacatagccctcctgaaaaagctcctcacgaagctcggctatatccccctccgtctgcgccctcgtgagagaatcgaaaacagaatccagatacttgacctcctgctcgccctctgcaataagcacagtgagctttttctctgcggtgtcgagctttctgtactccttataatacttctgagcgttctgtgttggcgtaagccttttgtcaagtggtatcttcactgtagggcagttctcgtcataaaagtcctgcacctcggcatatgccatgcccttttggagcgcatagaaatttgaagtgataaggtcaccgtaaatgcggtatttttccctgtccttgcactctttaagctcctcacgctgattttgcacacgcctttgagttctctcggaggtgtttataagaagcttgaaaaggtcattggctttctgctttattcttgaaagggagtccctctccgcatagaaatagtccagaagaacacttggcgactcaaagctttttgtcaccatgagcgcaccatactgcgtgatatcgcagaagcagaaatctttgagattgccctcttttgttttcagcactgtgtagacgttagtgccgtcatttatgctgtcacggactttcgagaaataaaaccacagcctgtccgcagcgtcgccgcttagctgttcggctgttatctccgcacctcttgccgcaaagaacacagcttcccttgcgaacactggcgaaatgccctccagcgttttcattattgcctttgaaagctccgccgtggggttttcgactatctttgcaagaaattcttcttttgtgcagtcaagaagattcagcctttcctctcttgggggcaaagtataccgcgcaccgggaagaaccattctcactgatgacatttcctgtcccacacgctttatgctgtctattatcctgccgtcctcacgatagaggataagatttgaacgcctgcccattatctccgccgcaagtgtgagattcaccctgtcgcccatttcgttggtggcttcaaagtcaaagaaaagtatacgctcaaagccgtcctgcctaatggcagtgagtctgccccctgcaagatgctttctcatgagcatacagaacataggcggtgttttcggattttctatatccgccgttgttatatgcacccttgccgagcctgcacctgtgctgaacataagcttctgcgcaccctctttagtgcggatagtcattataagctcctcgcgtgaaggctggtgtatcttatccaccctgccgtcaataagagggtcaaattcttttctgagcaagctcagatagattccgtccaatgccattttacttacctgctttttatattacttcaactatatccctgttgcttacggctatctctactctcagatcactgaacttgtttttcagctcaccagcgataaactcgcagaagatattttccgtatagaaatgacctgcgtctataacagaaacgcccatattctcgccgtctataaaaacgtcatgctttacgtcacctgtcaaaagcacctgacagcctttttctgcggcgtcagcaaggaacgaaccgcctgaacctgagcacactcccacacgacttatctcacgctcgccgccgctgaaacggactactctacagccgagaacgtcctttgctctctgtgcaagctcacggacattcatgccgtcacactcgcagacatatccacagccaacgccatgctcctcatgcaaagcgctctcgggttttagacccaacattttgcaaagcacgtcattcattccgccctctgcggagtcgaaatttgtgtgcatggaaagagcgttctttcctcctgccgcaagtatcacagcagggtcgttcggcacgagggtctttagtcctctgaaaataacagggtggtgggtgagaacaaggtcaaagtcacgctgacaggcttctcttgccacctctgcggtgcaatccagtgccaccagcacactccttacctctgcggacatttctcccacgttaagaccgctgttgtcatagccctcctgcaggcggtatggggctaaatcctctataaaactataaatatcataaactgtcgtcatttttgtcagctcctttttgtgtgtcaaagtctgtcaagctcgctctgtgcaagcttaacaagcctttctcccagctcctttttgtcctcggacttcatcattccgctgcctgcaacaaaaattctttttgcctgccttgcgatatactctttcccctcgccctcaggcttaacaaagccgaactgcaaatatctgtcatcacattcataagacggagttttgcctgtatacaccgcctgcatgacagaatatgcaaactgaccctctgtgcaggcaagctcttttttcacctcaaagccgttggcataaagccactttctaagcacgtcccattttgtcataggctgtaaaacgaggttcactccgtttttcacccacggacatttttcaagcagtcttgcaataagctcaccgcccatgcctgccataacaacgtctgttatgccctccgggggaacattgtcaagcccgtctgaaagcacagttttaatgcggtctgaaagtccctcacgattgatatgctcctcagccgactttagcggcattggtgcaacatcacaagccagagcctttttgcacatattttcctttatcataaagcagggcagataaccatgatctgtccccacgtcgcatacaatatctcctgtacaaagctttgcacaggtcacaagtcttttatccaaagctgtcctccaaagaaaaaaatcgccgctcgccccctgaaaaggcggctgggcggcgaaaatagttccaaacgcttattccgcaaaatgcttgttgagcttttcgagcatttcctcaacaggaacgccatgaacagcacaagcctcttcaagagtttcgcctcttgacgctgggcagaacagacagtgcatacccatttccataaagtatggtgctgtattttcatcagcgtccattatatcgcctataatagtatcctttgtaactgtgaatgccattttatattcctcctatcatgatagaccacgcaccgcaaacgctttgcgttatacctatattataaccaatcctgcgaaaaaaagcaagccctttttaaggcaataccgcacaaagattgtgcgtcagatgcgtagtcagattttttgtcagattgcataaaaattccgcaggcatactgtcgtatgtcaagggatttttgtgtgatatgacggaaaatctgcaagcagatggcgtgcaaagccgtcaggcgggctttgtgcggtgttgccttatatattataatgtatctcccttatcaacatttataacagcgttgtatcttccgtcaaattctgtgagccgttttgatatttttgcttttacctcgctgtctgaaagtctgaaatcaaaaggcactaccacatcaaagataagattttcacggttttctccctttgtcattctgaaatcgtgtatgctaaggcattggtcgatagacttcacaacgtctgttactatctttttagtttcgatagtttgctcgtcatgatctgccaccggatccatatgtatagacactgcgcagtgatatttttctttcatgctatcctcaagatcgtctataagctcatgagccgccataaagtccatttcgcatggcacttcggcatgaaaggagataacggtattccctacgccataatcatgtatgagcagatcatggataccgattatctcaggaaaactcattgcagtgtcaacgatatcctgaacgaactctttgtcaggctttgagcctaaaagcggcgaaacgctgtccttgcaggtcataaagcctgagcggaagataaagagagcaacgaggacgcccatatagccgtctatgtttatgccagtgaacgtagagaataccattgcaagcataacagctcctgttgcggcgcaatcggaaagactgtcagcggcagaggcgaaaagcgaggtagagtttatcttttttccaagctttctatagaaataccacatccaaagcttgacagccactgagcaggctaagataacgaaagtcatagtagagaagctaagcttatcgtgggcaaagatctttgaaaaagaagattttccaagctcaatgctcatcatcattataataaacgaaatgacaagacctgagatatactccattctgccatgaccgaaagggtgatcttcgtctgcggctttggctgccattttaaagccaaccagtgacattatagacgagcctgcgtcagaaaggttgttaaaagcgtccgccataacggacacagcccctgacacaaatcctgcaataagcttaccgaggaaaagcatgatattaaggactataccagtacatgagcctaggtagccatatttttttcggacgtttttatctttcacgttatctctgtcttttatgaataatcttataagaagtgctgccatatgaatatccccttttgtttaccaaagtaaacttataagtttatctactattataacacataatattacaaaatcaagtgcaaatgcttatttatatggatattcgccgcagcaggcaatatgcagccacttatttctcatttccaaccacataataaaattttcttttcactattgaaaaaatttgtgcagtgtgctataatagtcattagcgttaatcgtttacatacgcaaaaaggaaagaggttatataaaaaatgagaaaattcatatcgagagctgcggctctgctgctggcaggagttatgacagcggctgtggcaggctgcggaaaaaactccgacagcaaggcaaaagacacagcaaaaaaatggactgagcttgaccagacacagataacagaagccatggggcttggctggaacttaggcaatcagcttgaagcttccagcggcggacttcccagcgaaacttgctggggcaaccctgaggtaaccaaagagcttatcgacactgtcaaggcgcagggcttcaagacagtaagaatacctgtttcttatcttgacatgataggcgacggccctgactacaagatagacactgactggctggacagagttcaggaggtcgttgactatgttgttgacaacgatatgttcgctatagtgaatatgcacggtgacggatattacactgttgaccacagttggttgctttgtgctgaagacgatgataagcagaccgagataaaggacaagtacagcaaggtttggactcagatagcagaccgtttcaaggactatgaccagcaccttatcttcgagtccatgaatgaggaattcaacaacgattacggcaagcctgacgaaaaagcatatgataacatcaacgcatacaatcagatatttgttgactcagtgagagcaacaggctcgaacaatgaaaaacgctggctacttctccctggttggaacaccaatatcgaatacacagcaggtgatgattacaatttcaagataccgaccgacaacggctgcaaggctgacggcaagcgtatcatgatatccgttcactattatgacccattcaatttcactattgacgagaacaagaccgcaaaaactcagtggggcaaatatgcggtaaagaattatgacaactggggtcaggaggattatgttgacagccaaatggcacttcttaacgagaagtttgtaagtcaaggttatcctgttgttatcggcgaatttggcgcacaggacaagacagaaaagtttgcagactacaatgagttcagacgctactgggctgaatatcttatcaaggcggcaaagaaaaacggcattgtttgtgtatactgggacaacggctacaacggcaacaagggctttggcatcataaacagatttgactacactatcacgcagcctgaccttatcgcaggcatgatgagagccataaactccacagacgattatgagatcccgtcaccggcaggctacacagaggtcagaaagagtgcaaaggcttcataagtttttcacacacatatatgctgatacatttgcaggggcgaacagcgttcacccgtttgatttgcatgatgaaataataaggcgctgtaaaaaaaagcgcaacaaagcccgtggattccctcgatatggaagctcacgggctttaatatatcacacagcaaaaaagaactatctaatcttgaaaaaagggtacagcaaacacagcggcacaaaaactgcgtttttgccgtgttgaaaatgtggaaaatattttaaatttatgccgctttttttattgcaggctttttcaagtggaatttatgcagattaaaaccacagcaaatcatcgcaatttctaaattcatggcatttaagccacgtcttctggctcttcaattaaaaattgttcttagagccagcgtgtctgcccatttatttttactggagcaaaagaaaaaagcccgataaaatcgagcttttcgtggtgcggatgacgggacttgaacccacatgaccttgcgatcactagcacctgaagctagcgcgtctgccaattccgccacatccgcatataaaaatttgaaacttttactcggctcaaatccaaaaccgaggtgggtgcttatcacactaatccacatttatgatgaaccagaaagcagccaagcaaataaattcactgtcgttacgctgcctgaagctagcgcgtctgccaattccgccacatccgcatatttaacgttgctcaatgcaacgtacttattatatcatattacacgtactttgtcaatactttttcgcagttttttcgataaaaacgccaaaaaataaagcctgactaaaaagtcaggctgatttttatatcggaatcatcacccgtttttaaactgctcacttagagcctgatcactcatgccgaaagtcacaagcttgctgaaatacttgttcttcataagcgccttgataagtattacaccaactatcgttacgcatacaaattcgcctaaggctacccagcccatgttcacaagaagcggcgtcttgaagacatacgtcagttcaaagccaactatcaccgcatttgatatcaccgggaaaagcgacgcaactacaagatttaccttgtttctcagcagatagataagaaccgctgccacaactgtagcaagcgttccaaatactacgtccaccattccgagcgtactgaatagattgactatcaaacaacctatagaaagcgaaatgatgtaatccttgttgaaataacaaagtagcatcaaaacctcagatatgcggaactgtacctgtccgtatgcaagcgagctgcaaagcatcgtagccacaacgtatatcgctgcaataagtcccatgtttgttaaacgacgtgcactgaaaatttccataaaaaaatctccttgtttttatttgtgagtggttgatctaggttacactctatttaattggaaaataaaataacataaaaaggctgccgccgaaacgacagcccgtttatttacgttaatttagctattgattaagccttgccaacagaaccgaagagttccatcttctccttgaccttagccttgatagcctcgaagccaggattgagaagctttcttgggtcaaagcccttgccctgaagatccttgccctcttcaatgtactttcttgtagcttcctggaatgaaagctggcactctgtgtttacgttgatctttgcaacgccaagtgagattgccttcttgatcatatcgtcaggaatacctgtaccgccgtgaagtaccagtggcatatcgccaaccttttccttgatatcagcaagtgtctcgaatgaaagacctggccagtttgctggatacttaccgtgaatgttaccgataccagctgcgagcattgtaacgccgagatcagcgattgtcttgcactcgtctgggtctgcgcactcgcccatacctacaacgccgtcctcttcgccaccgatagaaccaacttcgcactcgatagaaagaccaagctgatctgcaacgtgaacgagttcagttgacttagcaaggttctcatcaaatggataatgtgaaccgtcgaacatgatagatgagaaaccagcctttacgcacttgtagcagccctcatatgttccgtggtcaaggtgaagtgctactggtactgtgataccgagctcttcgtccattgcctttaccatagcggcaactgtcttaaagcctgtcatgtacttgcctgcgccctcagatacaccaagaattacaggtgactgcagttcctgagcagtgagaaggatagcctttgtccactcaaggttgttaatattgaactgacctacagcatacttgccggcaagtgcctttgtcatcatttccttagctgaaactaacattttttaacgacctccgttattttaaattttcctttattattatacaacattactctgccaattgcaatagcgtgacattaatttaacaattatgtaacatttaaacctcgtacatctcgatgaccttctgagccacctcgatctttgtgcatctcttatccatagcctgcttttcaagatatttatgagcctgctgttctgtaaagccaagatactgcataagtgagcactttgctctgtttatcgttcttatctcttcaagctttttgtgcagtttaagattttcagaccgtattccgagcatacgttttcttgcggcactgacaaatttcattgaacggtaaaaatactgtctgcctagtggctttggtatcaccattacgccgaaatcttccagtttatcagcaagaatatccgcattttccgactttgcgatagccacacagcttgcgtcagttgaggtgcagactatctccgcaagctcgttgccatattcgtctgacaatggacagtttatcacgacacagtcataactgcctgaccctaccgctcgccttgtttcaagacccgttgcggctatagaagtcttgcaggtgggaaaggtttcttttaacagactcacaagcatagctgttgccttgtcattgcttgaagccacaagtatcctgtccatttccccacctcctttttttagctttctctgacattacagatgataaaaatatctggctgtttcaaactgctccttatcggcagctctctcatattctatgataagctccttttctattgcgataaaacgctccaacatatgctcaggaagcctatccgcaagaaactcgctcttttcagcacgttccactgcctctttcaaagactgcggaagtgtttcaagctttgcaagctcgctttcatctgccgagcctatattgaaattaaaaggttttggaagttcttccttatttataacaccgtctatgcaggcataaataagcagccccatagcaaagtaaggattacaggtgttgtctgctgaacggagtattataccattctcatctgtatcagcaagcggtgcacgaagaagctgtgcataattttcatgtgaccatgaaatgtacttaggtgcaagcagactgccaaaacgtttgtatgaatttgtagtggtgtttagaaacagcgtcatatcgccaacgtttttcagtattcctgctatcatgcgctcagcctctttggaaagtccgccaagctgaggtctgaaaacattttccgtgcctttcatgcacatgagcattatatgcagaccagatccgcagttgtcaacgataggctttggcatgaacgttgcgtaaagcccatttctgtcagccacagattttacaacgttcttgaacgtcacaagattatcggcggctttcagtgcgtttgaatactgaaaatctatctcgttctgacccggaccagtttcatgtcttgagctttctgggaaaatatccatttgctcaagtgtcaggcagatatcacgtctgaggttttctcccctgtcaacaggcgcagcgtcacaatagcctgcataatcgtgaggacgctttgtaggcatatcagtatcgtccttttcaaagcagtaaaactcgcatgaagtacctatctggaagttatatcccttacccttcgcatatgcgatagcagttttgaggaaaaacctgccatctccctcgaaagccgttccgtcaggatatttcaggtggcagaaaaatcttactaccctgccgtgctgcggtcgccatggaagaagcgccagcgtatcagggtcagggaaaagtctaaggtctgaagcagtcacattcaaaaagccaccgagctttgaagcgtcaaagataagtccctctctgaatattttcggcagctcgcctgctataacagagatagtctttaacgaaccgaatatatcgcagaacatgagctttacgaactttacgtcgttttcttcaacgaactgcaaaacctctttctctgtgtatttcataataaatcctccgtaatgatactgttcagaaaagttttccgttccttacttataattatatctgaacagccaattctgtaaaaccgagcagttataaagattttgttactttatttttactttgcgttatttgtcgatatcctccagccaaagcttagccacagcgtcagacggcattctccaatcccctctcggtgacagggtaacagaaccgatctttgcgccgtcaggcaggcaggagcgtttgaactgctgtgagaaaaatctgcgatagaatgttttgagccacttgtctatgacctcgtcaggataatccccctcaaaggcatatttcgcaagccttttcacctttgacggctcaaagccccagcgtatgccatagtaaaggaagaagtcatgaagctcatatggaccgacaaggtcttctgttttctgtgtcatctcagtgccactctcatcagtaggaagaagctcaggagaaacaggagtgtccaaaatatcgtacagtacatttctcagagtatcagatgtgcaggtgtcgccgtaatactgaacgatatgccttaccagcgttttagggatagaagcgttcacaccgtacatggacatatggtcgccgttgtaggtcgcccagccgagagcaagctcgctcaagtcgcctgtgccgaccaccattccgctcacctgatttgcgatattcataagcacctttgtgcgctctctcgcttgaccattctcgaacacaacgctgtgatcgttataatcgtgaccgatatcttcaaaatgctgtaaaactgcttttgagatatccacctctctgaacgttacctccaaagcgtcgcaaagtatctccgcattggagcgtgtgcgctttgttgtgccaaagcatggcatcgtcaccgcaacgatatcagtatgaggacgtttcagcaagtccattgccattacacacacaagcagtgcaagcgtagaatcaagtccccctgaaatgccaatgaccacagtcttggaatgtgtgtgtgcgatacgcttcataagtccatgggactgcatttgcaaaataaggtgacagcgctcgtttctctccgcctgatttgacgggataaaaggcgtttttgcaaactttcttgtcaaagctgtttcgcccatttcaaggctgaatctttcacgggagatattgtccttatccaaaaaaccgctgtctttggaagaatagtcccactcagcacttgcaggataggtagaaatttttcttcgctcaaacgcaagctttttaaaatctatttccgatatggtaatgccgttttcaaaaagcctgctctctgcaagtatagagccgttttccgcaatgatattgtgaccagaaaagaccatatcctgcgttgactcgccgtcacctgcagaacaatagatataccctgccacaagccttgcggactggttcgatacaagctgtctgcggtatgagtccttgccgataacttcatcgcttgcagacagattgcatataagggtagccccagctttagcaagatagtttgaaacagggtcagccacccacaagtcctcacaaagttcaaagcccaccacaagctcaggtatctcttcacatacgaaaacggtctgttccataggcggtataaattcaagctgtccgtactctctcagatcaatggcagcacattcgcctctgtatggtgcaaaatgtcttgcctcataaaattcgttatagttcggcagatgcgttttaggtacaaaggcacgcacctcgccgtcctgtataacagccgcacagttataaagcttgccgtttgctctcacaggcacgcccacagccacaagcatatcgctgtcagcagtagtctttgctatctttacaacaccctccattgccttgtcaagcaaagcgttctgaaagaacaagtcctgacaggtataacctgttatgcaaagctcagggaacacagcgacctttacgccctcttccctgcacttttcaagctgactgattattttatccacattgaagtcaacgtctgccacctgtatctcaggggtgcaggcggcgacctttataaaaccgtctttcataaaaatatgctccttacaagaaattatcattgttatcattataccattttttataggtataagtcaatgatttttacagtatagcaaaactattttagaacgatactagacaatcgggcactaatgtgttaaaattgagatatcacatcaaagggggaacgccatatgaacaaactgtgggataagtttcttttaggccttagctgctgtgcattcatgctcgcagagggaacagatccgtcaaacatcaccacattgctattggctgtcatatgctccgctatcttgcaaataaaaccaagctctgccgttgcatacctttcagttattgcgtacagctcactttgcattttcagtaaagaagctttgatactcgcccctttggtgctttatgatgctttctgtacaaaattttaccctgctatggtcttaacattcataggcgtacttgcaaatatattcactctgggaaaagacatcttcccacttgtcgctctttttttggtaagcttcacaatttcaacccacagcgttctgaacgaaaagctgacaaagatgctcataaatactcgtgacaattcaaaagaacttaccacccagcttgtagaaaaaaacaaagccatgcagagaaatcaagactacgagatatatcttgccacgctgaaagagcgtaaccgcattgcaagggagatacacgataacgtgggacatatgctcacaaggtctattttacagcttggtgcgctttcggtcataaacaaagatgaaactgtcggtgaagccatcaacgacctgagcggcacgctgaacaccgccatgacgagcatacgaagcagcgttcatgatcttcatgacgattctatcgcactaaagcctgctgttgaagactgcataagacctctgaaagacagatttgcagtaagctgtgattatgacttttccgaaagaatgtcacgagatgtgaagctttgctttattggcgttataaaagaagcgctttccaatactgcaaagcacagcaacggtgacagcataaaaataatcattcgtgaacaccctgctctttatcagcttagtatcgcagacaacggaagctgtcccgaaaagatagacgaaagcggcatggggcttgccaatatgcgagagcgtgcggcttctttaaatggaaacataaacatcacatcgggcagcaagggattccgcatttttctgtctgtgccgaaacaaaacctgactgaacggaggtcttgacatgaacattgttataatagatgatgacaagcttgtggcggtgtcgctgaaaaccattcttgaaagcacaggcagtgtgaaagttcttgccatgggaagctgtggcgaggaagccatagagctttactctcttctcaagcctgatgttctgcttatggatatccgcatgaacggcatgagcggcattgaagccggcgaaaagatccttgctgggtaccctgacgcaaggatactttatcttaccacattttctgatgatgaatacattataaaggctgtgcttatgggagcaaagggatatattttaaagcaggattttgaaagcatatgccctgcccttgaaaccgtcatgaatgggcagacagttttcggctcagatgttgcaagcaagcttcctgagcttcttaccaatcacagcagttttgattttgaccactacggcatagtcgaaaaagagcaggagataattgaacaggtggcaaaagggcttagcaacaaggaaatagcctcactgctttatctcagtgagggcacagtgcgaaattacatcagcactatcctggaaaagctctccctccgtgaccgcacacagcttgctattttctactacaccaacatacaatagcactacaatttcataaaaaagtaaagaggagacggcatgaccgctcctctttttgttattattacattttagctctttccttagctctctgtgagttgctcaaaatacgctttcttattcttatgctctttggtgttacttcaagaagctcatcatcagcgagaaactcaagtgaatcctcaaggctgagatttcttggcggaacaagtctgagcgcgtcatcagaaccgcttgcacgggtatttgtaaggtgcttcttcttgcagacatttacaacaaggtcttcctgctttggtgaagcgccaactatcattccctcatatacaggtgtgcctgctgtgatgaacagctcgcctctctcctgtgcgttgtaaagaccgtatgttacagcctcgcctgtttcaaacgcaacaagtgagcctgttgctctctttggtatctcgcccttatatggctcgtagtcatggaatacagaactcatgataccctcgccctttgtgtctgtaaggaactcgctcttatatccgaaaagtcctcttgcagggataagaaattcaagtctcattctgcttccaacaggtgccatttcctgaagctcgccctttcttgcacctatcttctccataacagaacctacgcaattctcaggaacgtcaataacaagactttcgataggttcgcaaagcttgccctctatctccttaaacagaacgtgcggtgttgaaacgctaagctcatagccctcacgacgcatattctcgataaggatagaaaggtgcatttcgccacgtcctgcgaccttgaaagcgtctgtgctgtctgtttcagaaactctcagtgaaacgtccttaagaagctccttgaaaagtctgtctctcaggtgacggctcgttacgaacttgccctctctgcctgcgaatggcgaattatttacagagaatgtcatttcaactgtaggctcggatatctttacaaaaggtacagcctcaaagttgccgaagtcgcagatagtgtcaccgatagtgatgttctcgataccgcttatacaaacgatatcgccagcctttgcactctggcatggaactctgttaagtccctctatctgatacattgtaactatcttgccacgatattccttcttagtctgatgatagtcgccgatcgtaacgtcctgattaactttcatttcgccacgctcgatacggccgatagctattcttcctacatactcgttgtagtcgatagcggaaacaagatactgcattgggccctctgtgtctacctcaggtgcagggatatagctgagaatctcatcaaagagaggtatcatatccttgccctcttcatctggcgaatgagtagctgtgcctgctctgcctgagcaataaaggatagggctgtcaagctgctcgtcagtagcgtcaagatccatgagaagctcgagaacttcgtcgcctacctcattaagacgagcgtcaggtctgtctatcttgttgataacgatgattattttatggccaagctcaagtgctttctgaagcacaaatcttgtctgtggcattggaccctcggctgcgtccacaagcagtataacaccgtttaccattttaagaacacgctctacctcaccgccgaaatcagcatggcctggggtgtcgataacgtttatcttaacgtccttatacttgatagaagtattctttgcaaggatagtgattcctctctcacgctcgatatcgtttgagtccatgactctttcttctacagcctgattttctctgaaagtaccgctctgcttgagcatctggtctacaagggtagtcttaccgtggtcaacgtgggcaataatagcaacatttcttaaatcttctctaatcatacatactcctccgatttatcaagacacagcaaagcgaatgctttctgtaacgatttgcttaatatatttcgcaaaaattataaacaataaaaattataaatatattttctcccatcaaaggaaagaaaatcgtaatttttcacaaaaagcctataaaacacaaaagcaccttgcgaaattttccgcaaggtaactttcctaattgagaattatagcacatttttgccgatttgtcaagaaaaaagtatcattcacaggttacgccttgtatggtgtgccttagattaaatgatttatgtttttggctgttttacacaatattgcaccgctaatattttacacaaaaataattgaaatcatggtataaaagttgtataatatcaataatcaaagatataactttgataacagagatcatatattttgaaaggcggaataatcaaatggctaacagaatgatacttaatgaaacttcatatttcggtgcaggctcgatcagcgagatagttacagaggcaaagaagagagcttttaaaaaggctcttgttgtaacagaccctgaccttatcaaatttaacgttgcaaagaacgttacagatcttttggaggaagcaggacttgcttatgatatattctctcaggtaaaggctaaccctactgtaaaggtagtaaaggctggtatcgaggctttcaaggcagcaggtgctgactatcttatcgctatcggcggcggctcatcaatggacactgcaaaggctatcggtatcatcataaacaaccctgagtatgctgacgttacttctcttgagggcgctatcgacacaaagaatccttgcgttcctataatcgcagttcctacaacagcaggcacagccgcagaggtaactatcaactatgttatcacagacgaggagaaaaagagaaagttcgtttgcgttgaccctcatgatattccagttgttgcagttatcgacgctaagatgatgtcatcaatgccaaagggacttacagcttcaacaggtatggacgctcttacacacgctatcgagggctacacaacacttggcgcttgggagcttacagacatgatgcaccttaaagcaatagagataatctcacgttcactgagaaaggctgttgagaatgacccacagggacgtgaggatatggctctcggtcagtatatcgcaggcatgggcttctcaaacgttggtcttggcgttgttcacggcatggctcacccgctcggtgcattctatgacacacctcacggaattgcaaacgctgtacttcttccatatgtaatggagtacaacgctgaatacacaggcgaaaagttcaagtacatcgcagaagcaatgggcgttgacacaacaggcatgagccaggctgaatacagagcagccgcagtaaacgcagttaagcagctttcaaaggacgttggaattcctgagaagctccacgagataggcgttaaggaagaggatcttcaggctttgagcgaatctgcatttgcagacgtatgcacaggaggaaatccaaggccttgcacagttgagtctatcctcggcatctacaagacagcattctaattcaaaaatcttttatctgccctcggttttcgggggcagatttttattgcccgaaaagaatatttatggtataatacatttaaagtgagtttaaagttcataggttatcatatatcgtaagatattatactgacttatagggaggaattttaatgagattacttcttgctgaggacgaggttgagcttgcaaatgcgatttcggcagtgcttaaacacaaaaattattctgttgacgctgtttacaacggcatcgacgcatacaactatgcaattgcacaggattatgacggcataatacttgacattatgatgcccggtatggacggcatacaggtgcttacaaaactccgtgaaaagggtatcgactcccctgttcttctgcttactgcaaagtctgatattgacgataggataaccggacttgattcgggtgctgacgattatcttacaaagccctttgcaatgggcgagcttcttgcgagaataagggcaatgacacgccgccgcactgagtttgcaccctctacccttacttttggaaacgtttctctcaacagacagagctttgagctttcaggtcctaacggctctcagaagcttggcaacaaagagtttcaaatgatagaagcccttatgctaaatcacggcacgcttatttcaacggagcgtttcatggaaaagatatggggctatgactctgacgctgagataaacgtggtgtgggtgtatatttcatatctgcgtaaaaagcttggtcttatcggtgcagatgtcgagataaaagccacaaggggcgtgggctacacactagaggaaaagcataatgattaagcgtttacagcggaaattcgttgttatcgccgctgtgtgccttcttatcgtagagtttaccataataggcggcataaatggagtgaacatctatcagaccaacaagaatgcagacaatctgctgaacataataatcgaaaatgacggcagatttcctgagttcgaccccaagggcatgaagcatgacaagccgcaggataattcagacagctcatctccccctgagagcaaaaagcctgataagcacagaggctttaacgaggaaactaagtatcagacaaggtattttgttgtatacgccgacagcaatggcgaaataaccaaggtagatacaggacacgttgcggcggtgtcaagttcgcaggctatagaatacggcaaaagcattcttgacagcggcaagacttcaggcacgtcaggaaactaccgctacaaaacaggcgacactgacaaaggcaagataatagttttcatggactgccgcagtgacgccgcaactaaaaaccgtttccttcttgtgtcatgtgccataggggcggcaggatatatacttgtatgtctgcttatcataatcttctcaaagcgtgccataagacctgttgtggaaagctttgaaaagcaaaagcagttcatcaccgacgcagggcacgagataaaaacgccgctggccataatctccgcaaacacggaagttcttgaaatggtgtcagagccaaaccagtggacggtgagcataaaaaatcagataacaaggctaaacggtctgctaaaagagcttttaagccttgcaaaaatggaggaggaaaagcctgctcttaccatggctgatttcaatatctctgacgctgtttatgacgccgcttcgccttttactacccttgcggaaacaaagggcaaaaagctcaccattgatgttgccaacggactttcctatcacggcgacgagggtgcgataagacagcttgtttctatcctcacggaaaatgcagtaaaatatgctgacgaggatggcgagataatagtaaagcttttcacttctcataatggcaaggaaacagacctagaagtttcaaacacctgcaaagaaccaccgcaaggcgacctaacaaaactttttgacagattttatcgtgacgacagctcacgttctcggtcaaaaggcgagaaaaagggtggctacggcattgggctttctattgcacaggcaatagtcaggtcgcacaaaagtaagatatcatgcaaagccgaaaacggcatgatgatatttacagcacagcttaaataactgcaaagcagagttggtcaccagccgctctgcttttttataatatgacatttgtcacatgaagatatgactttgctcactagctttttggcggatagtattgtataatgataatacaaactaagggaggtttttcttatggctgaaactgtagtaaaaatagacaatctggtaaaaagatacaaggagcttattgctcttgaccactttgatcttgaaataaaaaaaggcgaggtcttcggacttctcggtcctaacggttcgggtaagaccaccacgataaactgcctgctctcactgttggcatacgataagggcgacatcgagatattcggtgaaaaaatgtcccctgtgaactatggggtaaaaaagcgtattggcgttataatgcagaatgttgcggtgtttgacgagctgactgtgtatgagaacattgactatttttgcgggctttacatcaccgacaaagccacacgaaagaaatatgttgacgatgccatagcttttgtgggacttgaggactttgtgaagttccaccctaaaaagctttcaggcggtctgctcagacgacttaacattgcctgtggtattgcacacaagcctgagcttatcatacttgacgagccgacagttgccgttgacccacaatcaagaaacaagatactggagggcattttacagctcaaccgtgaaggtgcgactataatttacacctcccactacatggaagaagtcgagcagatatgcacccgtatcgccataatggataagggcagtaagatagccgagggtactacagaggaactcaaacgcatgataaagaacaccgaaactatcaccgccgagatactccagcttcctgaaaacgtccgtgaacaaatagaagctttggaacacgtttataatgtttcctatgccgacaacaagctcgttgcacgctgtacagggggacggcacaatcttattgagatactgaaaatattgcaggaaaatcaggtgggcttcggcagcgtttattctgagcagcctaccctcaatgacgttttccttgaaataaccggcaaagctctcagggataaggagtgatagaatgttctcaaacatattcaaatacgaatttaaaagctgtctgcgtcaaaaagccatactcttctggctcatagcctttcctataatactgggttgcttttttaagatggcgttttcaggaatatacgaaaaagatgttgtattcaatgctatacctgttgcggtgacaaatatagaagaaaacgatatccttaagcaggtgcttgaacagatatcagatagtgatgacgctcttttcaaggtgacgtatacggatattgacaaggcagaagaaatgcttaaaagcgaagatataaaaggcattataaaggcttccgacctctcccttgagtttggctcaacaggtatccagcagaccattgtaaaggctttcatacagcaatacaaaacgcaggaaaagataataactgacactgcaaagaacgctccgcaaaagcttgataaggtcatagcttccatttctgagaagataagcccaaatgaggatatacctctccacggcaatcctgacataacgatacagtttttctataatctccttgccatgacggcacttttcggctcgatgtcaggtctgttcgtggcacaggaaaatcagggcgacctgtctgcacttggcgcaagacgttgctgttctccagtgaacaagcttacaagcataacggcaacgctccttgcttttcatgtggtggaaatgatatgcatggtgatatcggtgacgttcctgagatttgtgcttaaagtggatttcggcagtaagctcccccttgtttaccttgccgcagtgctaggcggaataatgggaatatccatgggatttttcgttggctctttccgcataaaagagggtttaaaaatgtctgtagtcatggcggtatcaatgacctgctgcttcttcagcggtcttatgtcaaacaccatgaaaggcactgttgcagagcattgcccgatattcaatgaaataaaccctgccgcagttatctcagacagcttttactgtcttaatctctacgaagattacaggcggttcacagtgaagataatttcaatggcgatatacacagtgctgttcacccttggtggatatgttcttacaaggaggcgtaaatatgcaagtctttaagacctttatgaaaatactcaaaacaaggcttacgtctgctatattatatctcgtcatatttatggtcatagcagtaataatggcggatactgcaaaagataacaatgactatgaggactataaaatgtccatatccgtcattgaccgtgacaacagtgccgaaagcaagcgtttgcaggactttatattcagcggcaacaaaaaggtggagcttgcagatgatgaagacgaggtcatcgatgccgtttattatcagcgtgccaactatgttctgtatataaacaagggctttggcgacaagataaacgcaggggattttgacggactttttgagaatttcaaaatgccctccagctacggcggacagctttttgaaagcaggcttgacaactatctttcaagcgtaaaggcgtacatgacggcaggtgaaagcacagaaaacgctatggagcttgccaaaacggcagtttctcagcaagtaaaggcggagcttaaaaactttaacaacaagggcggaacaggtatgccggcaatattcggctactattttcagtatcttgcatacgttatgctttccatgctcattgttaccctttgccccgttatactgacgctaaacagaaaaggcgttcgagaacgcacaatgtgttcaagcctgacgtcagcaaactacagcagacagacggctcttggggcaagtatcttggtgtttagcatatggcttttgtttatgatagtcgcaattatttggggcaaaacgctcagcgtgaaattctggcttgcctgccttaacagctttgtatatatcattgccgccgcaggcatagcaatgataatagcgcagtttgaccttagcgacaacggcataactgctatatcgaacataatcggtcttggcatgagctttctttgcggagttttcgtgccgcaggaattgctcacaggaggcgttcttgcagtgggaagattgttccctgcatattggtacaccaaagccaacaatatgcttttcggcatgagcggtggagtattcagcacaaaggaatatcttatctgcattggtatcgaagcactgtttgcgatagcgttttttgctgtggctgctctgcttgttaagcaaaagcgtgagggtgatgtaaattcccttgcataagttgacaataatatggctgtgtgttatactcttattgttacggagctgacacgcagcctttttgcgtcagctaaagaagatcatagatgaaaaaagaggaaaaagtatggatagattacagcttgacaaaaatgcaaagctcacaggcagagtatatttcaaagacgaggtaatgtggctcggtctttcaggaagcggtgcgtcattcacatttgacggcacaaagcttgttttgaagctcaaaggcgacaatatcgcagtgggcgataatcctatcgactatgcaaggatagccgtttatgttgacggcaagagagtagttgacgagatgatcgactgtgcagaaaaagagatcacggtaatagaccgcacggaaaacgctcagtcagttgtggagataataaagctttcagaatctccaatgtcggcagttggcgttgaggctttcaccgagggcagtgctgaggctttgcctgaaaaaccgctcaaaatagaatttatcggcgactctataacctgcggctatggtgttgatgatgaggacgaaaaccaccagttcaccaccgccacagaggacgttacaaaagcctatgcctacaagaccgccaaggcacttgacgctgaatacagtatgttttcagccagtggctacggtataatctcaggctacacagaaggtgacgagcctatcagtgaacagacaattccacagttctattgtagctacggcttttcaaggggcaattttgcaggaactgctccgcaggatatcccatgggatttcagcaaatatgttccgcagataatcgttataaacctcggcacaaacgacgacagctactgccgtgactacaaggacaggcaggctgttttctcaaagctttatgctgattttcttgcggtcgttcgtgagaaaaatccgcaggcttacattctctgcactgtcggaataatgggcgagaggatattccctgctgttgaagagggaataaagatatatcttaaaagccacgctgacagcaagataagctcaatgatgttccatgagcaggacggcgcaaacgatggctttgcggcaaactggcaccctacagaaaagacccacaacaaggcagctgcggtgcttacggaaaaactcagagagataataaaaagcatataacaaaagcggcagtcggtaacggctgccgcttttttgtcattttacgccaattctcattctgtagcagaacgaacaggaaagcatggctagtttcagacctgttctttgaaagctttccttataagaaaacatatttcagcacgaaaagcactgcaagcacatacataagcggtgtgatatccttgcgctttccacaaacaagatttataacaacgtatgagattattccaagagagatgccctctgaaatgctgtagaaaagaggcattgaaagaatacaaagatacgcagggatagcctttgtataattgccgtcatcaaacttgatgtcagtgatagagctgaacatcaaaaagcctactactataagtgcaggagctgttgcaaaagatggtatagccgtgaagataggtgcaaagaacattgacagtgcaaacagcactgcggctgtgatagaggtaagacctgttctgcctcctgcggcaacgcctgctgaggactcaacgaatgttgtggtggtggaagtaccaagaactgcgcctgccgttgtggcaacggcgtcagcaagaagcgcaggctttatctgcggaagtctgcccttttcatcaagcatatctgcctttgaacatacgccgataagagtgcctaaagtgtcgaaaaggtcaacgaacaggaaggagaataccacgactataaaattgaagataccaatgctgtgcatatccaccttaaagcactgaccaaatgtttcgccaagttttgaaaaatccgtaagcgacattgtagggaaaagcgaattatagccgctttcagcgtcaggaacatacagccctacaagttgacatatcatgcctattacccatgttgccactatacccataagaatagagccacggacttttttgatatataggataatagttatgaaaagtcccacgatagtgagaagcgcacatatgcccgaagttgtgaaattcttgcggaagcctgttatggtaacaagagtggctgaactgtcaacgcaaagtccagcattctgaagtccgataaaggcaatgtaaagaccgataccaacggacaccgcttttttcaacaccacaggtattgcattgaaaatggcttctctgacgtttgtaagagaaagcacgatgaaaactatgccctcgatgaacaccgccagcagtgcaacctgccatggatagccatagcctgccacaacagtgtaagccatgtaagcgttaagtcccatgcctgcggaaagcacaaaaggcagatttgccataagtcccatgcacactgttccaataacagaggcgatacaggtggcaagaagtacggctgtaggatccatgcccgtactgccgagaatgctcgggtttatagcaaggatatatgccatggtcatgaaagtcgtcacgcccgccattatctcagttttaacatcggtgtgattttctttcagcttgaatattttttccgtcatattttattatgcctgcgttgcagacatttcctcctttcaatatggggatactatcttattataccgattttacagcatttttcaagcctgatttattaattgaataaaacttatcatttaagaagcactgttactaacgtcagactttattttccactgactattgagccaataaatgcggttttcgatccaattgaaaagatcctccgcagagtcaggaccccactcttcgccttttctaaggtcggcgtcatactctttgagatattcacgctctgtttttatacagccctgtaaaagcttctcccggctcatctccgtccacttttccttgacagcgtccataaaccaatcctgcttacaaagaatgataaaccatgggtttgaacgatcgccgtttttagccacaaaattcttgtctgtgaaagcaccagcataatatttctcagtgctgtcattatatgcccagttaaaatcccaaggagaagtaaatttcagcttaggacatttactgtcctttgaaagatcgacgcacatatagaagcttccctcaccacagtcatagtcatgtacgatctcataaagaatatacatatctctcactgagtctatatccataacattagaaacggcttcctcagcggtggtaacatcagagtcaacaaggtcataattttcatcaaatttataatatttgccgttctcgcaggcttcataaactatcttgaacagattgttgagatacttgtcaataaagtctatctgattttgcgaatagaggtcattcttgatagaatattccgcaggaacgaactgccttgtttcgccgtttatgtcggtgacagtggcattttcatagtccatgcttatataatggttatcctcatcgcttgttgcatagttgtcaagctcaagataatagcctatatcagtgtctgtgtagccttccgcaggctcggagatatccactctgtttggatttatctgacactgttcgcaaagctcataaacgccttgaaactcctcgttcacatagagatgaacaagctgaccgtctgagcagaaattgctgtcacccatgatagttctgccaaaacggaatgcgatatcgtttcttatcagatcccaatctgatttcaacagcacccagcttttgcactctgcgccgttattaagcccaagcatatttgtctttttatcaaattttatcctataaggcactttgtttgcaaggatctgactaacatcaccgtaatatgcgcttgaatttcctcttacctttatgcctgctgaggcttcgtttatctccaatttttcatcacaattgaaaacgtccaccacgcaggaagtatacttctcccttgaagctatcatatcgtcaggggcagtcgtaacacttataacaggtatcttactttctgatcgtatctttttcttaaaactttctttttcagccttgtcagcactcaagctttcataagtagcaggttcagagtttatcacctgttttgtggtggcaggaagagttacaacaggctcagccgttgttgtcacagcctgagattcggcaggactactctctgcttttgagctttcccctgtttctttagcacagcttgtgagcattgctcccgtcatgactactgcacatacagcagcaataattcttatgttcatatcatttctcatattattatctttccatttattgtgcattacacacatattttttatcatataacttattcaattatagcacattgacatagataatacaatatgctataatcataaaagtaagtgggataatttatgcactaatacgattatataggaggttttttgaaatgtttatacctgacgataaaagatatgacaaaatgatatacaaccgctgtgggaaaagcgggcttaagctttctgcgttgtctttgggcttttggcagaatttcagcctgaaaaacaattttgaaaacatggaaagaatggtacacactgcgttcaacagcggtatcacacattttgaccttgcaaacaactatggcaatccctacaacggctcggcagaggaaaacttcggcaggatactcgaccgtggcatgagagagttccgtgacgagatgtgcatttccaccaaggcaggctatgaaatgtgggcaggtccatacggtgacagaaacggctcgagaaaatatctcacggcaagccttgaccaatctctcaaaagaatgggacttgaatatgttgacattttctatcaccatgtaagagatcccgaaacgcctcttgaagaaactgcccttgcacttgacaatgcagtaaggcagggaaaagcactatatgtcggcatatcaaattacaacagagccgacacagccgaaatgctgaaaattttccgtgaactcagaactccttttattatcaatcagccctcatattccatactcaaccgctggatagaggacgataagcttgacagccttgcactttctgaaggctttggcattgcagtgttctcgccgctgtatcagggattccttacaagcaaatatctaaaaggcataccggcagattcaagggtaggcagaggcgaaacatggataggcaatgagcttaatgacaaaatgatagaaaagctcaacaagcttaatgatatcgccacttcaaggggacagaccctttcgcaaatggcactttcatgggtgcttcacaacaaggctgttactactgtgcttatcggtgcaagccgtcctgagcagataacggaaaacataggctgtcttgaccgccttgacttcacagaagatgaacttgcagagatagacaggcttgcgaagatgtaataaagaagctgtcagagtcaccgccctgacagcttttttatgcgttataatagctaacgtaatcgtcaagcacatctgtcgtaagctcaaaaggataatttttaagcttggcagggttggcaagtattccgtctctgtccttcttccaaagctcctctgacatatcaagcttgccaaaaagcgtcctgatataatctcggaaagcgtcgatatcgtaaaagccaagaagctgttttacaacatactcagcttcgatgctgtcaccgtattttttcaaaaagcctgacagaaaaacgcctactgccttgccgtggggtacgccattttcatatgtcaaagtgtagctcagaccgtgaggtatgcttgtgcctgtgtaggctatcgccatgcctgcaagcactgatgcctgcatgaaagttgagaactcatcatcggtcatatgagcaaatctctcatcagtttcaagacagcccttacagcttgcccaaagcctcataccctcctcagcgtatgcacggctgaacgcatttgcgttggtgttgagccgtgactctatcatgtgagcaagtgcgtcaacgcaggtgcttttcatgccgccatatgatgatgttttaagatagccgtagtcaaccaatgcaagtgacgggaatattttgtgggcaatagatttcttggtctgcttgatgtgggaagtcaggatagaataaggtgtagcctccgagcctgttccgcaggtggtaggcacacagactatagggtaaaaaggtagtttcgcaggagtgtacaaaagctcctccaccttggcaatgttctctgaaagctcacacttctcagcttttacaacgctctcgctttcggaaaattcggcattttcgcaaactatcccattcttagcaagcattgatattgccttgcttgcgtccattggcgaaccgccgcccactgccacgaacatatccacgccgtattttaccgccgccgttgccgctgtgtaaacagtttccacagacgggttttcctcaatatcattatatatcacatatccaatgccctgactttcaagcactgccctgacatcatcaagagaaccattcaccgcagaagaatgtctgcctgtgactatcatggcttttttgccaagttccgctatttcgcccccgtgattttttaccgcttcattttctatgtaaatatctgtaggtatatttctcattttttacgctccttttggctttttatccattatagcacctttgacggcgattttcaagcctagacattatagaacgtatgtgctataatattagtaacaaatcatggaggaaaaagttatgcactttacaacggcaaaggtatactctcgcaaaaaaacggcatgaatttatatcgtagctgcacatgacggtcagacgagtatttttgatactgccgattgaaaacctctcccctttatgttataataaagaaaaaacatcaaggtgaagcaatgaataaaaatcaaaatatagctatggggatatcccttgctgtggtagcaataatggtcggctcggcggagatcttcggggaaaaggaaataatttttcctgagataacggcagtggcaatgggtgcgctaattgctcctgtgcaatcttggaatacctctcgcacacggctttttgcggcgatagtttctgccgctgtcgcaggcgtgtgcatagtgcggtttatccctgagatacttatacttcgtatagctttgggacttcttgtagcagtgagcgttataacactgtcaaaaactagcttcgttcctgccatttcagcctgcatacttccgatacttatgggtacaaaaagccctgtttacgtcatttccgttgcggtcatgacagcatttatacttatttttcaaaaagttcttgaatactttggacttcatgaaaagtatgaatatagacctattgaaccaagctcagagcttctaaaactaagagcaaaacaagtcatcacggtgcttgttatctgcatattgcccgcgcattttcacgagatattctttatcgctccgccgcttatagttgcattttttgagcttagcggcaaaggctcaaagcttatgaaaagaaaatacaccgcaattgctctcatggcggcggctgcgttcgcaggcgttatggcaagattttttatctctgaaaagcttgggcttaccctgacatttggtgcagttttatcctcggctgtgatattcgttctttgccgaaaagcaaagctttattttcctccatgctgtgcaatatctaccttgccttttataatccctaaaacggcaataataaaatttccatttgaggtcacagcaggatatattgtccttaccattgccgcagttatcataaccaaaataggcaataatacaaataaggcataatcaaaaacgtacaaagctttatgatccgacctccagaagttagaccaaaaatctaacaacttggaggtcacatcattacgctctgtacgtttttttgtatattaagaaatcattctctgtttttaagcacctcggcaggggttatcttgccaagctttcttacaagaattgaggtgatgataaagtatgttgccattactcctgcgaaaattataacgtaagcataccatgggaatgcaaggtttattccgcttgttacgtttggaatgaacactgggaaaaccttgtccataaacatctttgaaagcggtatctcgataagtgcacccaaagttatgataattgcgtttccgtttaggtaaagctttttcacgtccttggtcttatagccgaacaccttcacaagggatattccaaaggaagccctttctattgtaacattcagcataaggaacatcacagagcagaaaattattacagcaaccgcaataagcattactatcattgacatcataaggtccgtgaaaactgccgctgaacgctcgatatccgattttgttgttgtgctgtaaagtctgccctcgtcaatgtcaagtttcttgtctgagagcaaacagttgtagtaagtgtcgctctcaccgaaaagctcacgcatactgtcaatatccatgaacaccataagtccgccacgctcgtcgcagatatcctccactgtgaatgcataatccattgaggttgcatcgtctgtcaggataaacttatcgccctttgccacgccgtaacgctccacaactgactggctcactgttataaagctcttgcccttgtgtgttttcacatcataatacttgttgtcgctgtccatacccataatagtgacatcaaggttatagccaagctgttcctttgaaagagtttttacaaagcaagcctcaccaccatctggaacgctttcctctggatatttcagagtgtacatatactcgtattttgtgtcattgatagtgtcttttctcacgttctcacagagatagtagcaatcaacgccaagcataagaatgaacagtgaaaacagcatactgagaagcactgttatgcctgtgcgcatttcacgaagcatttggcgtatctgaaatctgcggataaaattcctgctctttatcttcactctgctgtagtgacctgttttctgctcgtttctgataagtgaaagagccgtctgagaaagccgcttgtttatcacaagggtattaactataaacgaaacaacaggaggcgttacaacgctgtaaatgataagatacaaaggataaacaggggtaaaatcagggagcgaagaatatgcgtagctgtcgagaagctgataatcgattcccacaggtgagaagcctatgaccgcaccgattattccgccaacaaatgcaactatagtcggcaatgttacgtagtgtcggataagatcttttttctttgcgccaagagcataaagcgcacctataacactgctttcacgctggatctgatgaatgacgaaaacagagataacataagtaagaagtgccataagtataacacccacaccaagtcctgcatatttgttcatgacaacgtcacctgccgcaccagctatacgaacgttgtcgccctttttcacgaacattgtcagattgtcaagatcaattgtgaacacctcgtcaagaagctcgtcagcatgctttttgaagctgtcaataccatttgcaaggctctctgcaccgctgtatgcagatcttgcaccctctgacaggtcttttgagccgtcatatgcggccttaactcctgccgtgataccgttcgcaccctctgggagtgcctttgcaccctcgtaaagtccacccattgcgtcatagagagcgtctgctccctcagaaaggtctttcacaccgtctttaagggtctgagagccgtcatagagcttgtcgataccatttgaaatatcgtcacgctgcttcaagacatccttgatagtttcaagataatacttgtctgtgacttttttataatcaaagtcaaaatcctcgatcatttctttaagctcgtcatctgttgccttgccgttaagtctgtaagcatagcaaaggtcttcggctttctgttcgcagtcatttttgaaatagtcgtactgatcgtcgcttacgaaaagaagtccgaagcccttgcttgacacagccgtgtcagagaaattttcaaaaggtgtgtcatagtcaggtgtggttcctattccaacaatctcgaattcaactccacctgctgtaagcttatcgcccactgacagagaatgttcctcgctgtaacgcttttcgactaccgcttcgccctttttctcagcaagtctgccgctgtcaagctcgataaggtcaatgtcatttcttttacggaaaacacggagctttgagccgtccttcgcggtaacgtcaatgctgaaatgctgttcaagagtaattcctttgtctgttatttccttttcctgctcgtctgtaagaggaataaaaacgccgaactgtccgtcctcgaccttgttttgcttaccatgttcggcagttccgtcgatgatagtgtctgcgcttgcaaccacggaaactattatgtacattcccattacgataagcaatacaagcgcaagataacgtgcaaaatttgttttaagctcacgtccgagcctttttctgagtaccctgttcattacaagtcctccagctctgcggcaggtatgcgtgtttcgttaagataatcctttttgataagtccgtccttaacgattattaccttatgcaccatattttttatagcgttgttgtgagtaacgataagcattgttgtgccatatttttcgtttatcttctccaacagaatgagaatatcccttgaagttttggagtcaagagcgcctgtaggctcgtcgcacaaaagcagctttggattttttataagtgcccttgctatagcacatctctgctgctgaccgcctgaaagctgtgacggaaacttgtttctgtgttcggaaagttccaacgttgtgagaagttcttccatatccagtggcgaatctgaaagatattcacaaacctgaatattttccacaactgtcagatttggaacgaggttataaaactgaaagataaagcccagattttcctttctgtagtcggcaagcttatcaggtttaagaccgaaaatctccttaccgtcgaccttaacagagccactatccatagtgtcaaggccgcctatgcagttaaggagcgtggatttaccagagccgctcgtaccctgaataacgcacatctgacctttttctagacttgtggtgataccctttagcacctgaatatagctggcgtcactgccgtagcttttcttcacatctttgatctccaaatacatatcatttcctccatttatgagttagatttagctaactttactttatataaaaatgtgcatatctgcacatttcatcgacatttgagatacaaaattcacacataacgttgttatgtaggtttctaaaagttaccgcccgcaggcggcaattttctaatcctcgactatcattgtaaaccatatttttattagaaactccattactctgcgcatatggagctttgccttttccacatctctctcgtgagttagcaaatgagtgtaggcgtcaacacttatatgggttatccaatgaagcatatactcatcaacgtggcagttaggcattcttgcggcagctttttccgctgatatcctaaagcccttttctgtcatatctacgatcatatccacagtattttcatactcagacccttgcgcacccgtgagcagcagcataaaaacgtcatagtggagatacatataatcaacaagcttgtcaaggtcggtgtgagtatcaatgtgatactcagcagacagcaccgcagggtcatcgctatccatatcctgagcgtcctgcatataatgctccgtaagaagcctgcaaagctctttcagcggctcatcgacaatagccttgaacaagtcatttttatttttaaagaagaaatacagcgcaccggtcgtcacgcctgcgtcagcgcagatttttctcagagaagccttcatataaccattttcagagaactcggccattgcactttccaacagtttttcccttgtttcaagttcgtcacccattactgcaccccgctttccgtttcacataacactgttatcttagcatataacgctcgatatgtcaatacatttactatattttcagcatattatatgatattgaaacataacagtgttatgtgattggtgactattacaaaataaaattggaagcggcatacctgtctggtcagctcttacgatttctgacgggttaaagtatataagcgatagctataaaattgctatggtttacaactgtgacagcgctcctatgctggtccttgaaaacaagtactcatatagctgggatatttgcattagtgcaagcgaggtgtcgtcaggagttgctttctactcatacgatgacattgcacaagctttcagcaactacggagtatatgcggctcaggtctgatattacaacatagtaactattcaagtcaaataataatcgggccgagcaaaatgttccaccggaacatcttactcggtctttttcgtagtatcgataattcaacatatttacaactatcctgtatttttcacgcaatcaccaatctggtcattttctctatccacttatcaatgaagcttataaacccctcaaagcttcatagctctccatttgtttgaaataacgctgatattccagtatgtgataaagcagataaacaacatactgattgccgatacgacaactgcttcaataataagaaacggtgtcgaataggttgatatgaatcttgacgtaattgtcaaaatgatattttgacaaaacctaacaaatgtccccgataagataatgtctaatatgaaccgccataggaatgattttgtgaatttggtcatgtctttctcatgttatcaaattataatttcaatagcgttgcttacttgtgtatatgaatgtgtggtagaatcataatcagtacacaataatactgtatatactccttccggcacatcctttcgcaatttgaattcgtttatttcacttgcatcgacaattttttgaatttcaccgtccttgactataagccaacatatattttctaattctgaattatcgctctttgtaacagtatataaatcagaattttctttcacagatatattttctgaatatgacggcgaattttttttctcaaccaactgaattgattctatgtatcccaaattctttccatctttatcagtataaaactcaatttgaaactcatcattgttattagctgattttatcaagtcattataatagtcaaactctgatttactaagacttaatcttagttgagtatttatgctttcattatatacttttaatttgtctgaatccgcataaactccataaaaattatacaattgagtagcctgaacaccttgaaatcgtgatggataagaagactttttcgatttttttgtataaaccgaaatattatcatcttgcttggttaaattaatagttttcttaaaagcacttccgttgcttattttttgcgcaacagaaatttcttcaattagattttttatgccgtatgtactatactgagactgaacagatataaaattcatccacaatattgaaacaaaacacgaaaatacgactccaacaattttatgacctaaaccgtaacctttttcattaaagaatgttacagccgattttatcataaacatgatcataaaaaaggctagtacaattgctgagattgctttaattttcaaaaataaacaaactaaatttatattttcttgaccaatcaatgagtttggagcaaaaaaattcaataatatatttccgaatatcagcactaacaaaaaccaaccgcaattattataaattgttttaatagctttcatatttttccctacaaaatctcctcattaatatgtttgatattgttatatgcgtatttatcatatacataatcaacatcatcataagtttccatacttcttgacaaaatcgccaagataacgctctgcaaaagtcttacgaaaattccaagtagaattatatctagtataaatctccatagaaatgattttgtgaattgggtcattgtttttcctccttattattcaaccgtgtattcaatcgtgttactaatgggagtatattctcctgttgtttcattgtatccgaaagcaagtattatttcataatttccatactttctattactttttaagaaagttagtttattaatccactccttctttgagaagtcccaattttgataaaattccccatctctttttacatacagactgatgctacgatcaagaggaacaaccccaatatcttctttatcatcataataaggtatatgcggacgattaataaatactgttcctttttcatctacttcaagagttatttctatatccatgtcaagcaattcatttaataactccgtaatttcattttgctcttttttttcggcttcttctgtagcgtcatattctcctacaatatttaaactacttatcgtcatcgtattaggataataagtaacgtcataaaacgccgagaaatcaatctttgatttgtcaccgggagaaatcataagttttgtataacgatcgttatcgtcaacggcatcaatatacacagcatttcttccttggttttcaaagtataagtacgacatagtatcgaagtgtacatctttaagcgtttcagtatctgaaaacatatcctttgcagagttcaccatcattacataatcactttttattgctttaatgtcgtccgaataagaactaataccgtaaaccgaaaaataattttcaaaacctcctataaaaacaagaagaaacaacacgatctgaattacatacataaagcatctaagtacaagtctattacttttggttggtataaaccttgtaacaacaagcgatataccaaagtacactccgccgatcatggcaagcgtaccaagcatataaaacaatgtacacaaaaacagtttaataggtgtattctctccaacaaaactgttaggaaataccaaacaataaattgttagactaagcacaagaccacaaaccgttattaatcctgacaatgcaaatgtctttggagacagcggcttaatggtgccttcgtcaacaaatcttttgtagttataccaaaataatgccttgttagccataattatgtcacctcagatatgaatcttgacgtaattgtcaaaatgatattttgacaaaacctaacaaatgtccccaataagataatgtctaatatgaaccgccataggaatgattttatgaattgaggcattgtttttccccctaaaataatcaatcttctttttccagtggtacactctcatactcttcagaattactattcttactcctcttagaatataaaatggtattgctgataggggcttgatcttcgatttcttcgtcattatccaaaacaagagtgacagcgtaatctccggcaggagcaaaagttagaatatttgtccagtttgaccgaatagctaaactgcgcttataaaactcgccgtcacaggtaatgtaccaatatattttcttttccatctcagctaattctacgctgttcggatctaaatcatcatacactgcaataccagaacgctctacaagtattgtattgttttcattgacgcttaatcttatttcaatattttgttttataaaatatgaatatgatggagaactaagtgacaaattgtaatcggaggtatccgttatatccagaacttcttttacataacctgatcttttataatatgagattcgaaaatgccgttcatctggaatttctttttgaaatccgttgtcgcccttgatcgtttcgacctgacttgattttagtgatcgttttacattaacaccatcactgttttctacccaaatatttcgattatcgtataactcaatgctgtcggtttcaatacttatcggatcatcatattctatatcgtcatttatttcggatatcagagacaactgttcaaatactgtcatattgctgatctcaaatattttatttatacctgcacctactcctataagcaaacaaataaaaactaatatccgtatccgattttttaacaaaaaatctttatcatggtttattacggctgatgtaataattttcaagcctaatttttttgacttattaaatttcctatatcttgcacttagaaaaaggccctcacccatagccattataatgactgcggcattatacacaatcaaaagatagcatataaaattaaatattatcaatcttttgaaatcagatataccgttagtgaatatcccttcatacaaatattcataataaacaccataagccgcaaatgttgctcgccacgcaaaatccgaaaaacgcaaaaatgcggaataactcggaattagcatagaaaacccacgaaagtggcgcaaatgcggcggtttgaatatgcaaaaagttgacgtgctttgcggataagaaaattgaatgtcaaaaaaataaggtcttaaaatgcaattttaaaagcattttaagacctttaaattttacctttttagaacgttttagaactgttttcaaattttaaaattgtcacaaaacagcgtatttacgcattttaaagctataacgtttataaaatagtttgaatgttcaattgaaaaatctcattgaaaaatttccatattttatacgggaatataggaactaaaaattcgattaatgggaactagttcccattaacttatcaatgtcccactgtgcggctcgaacaatcactacagtcggaagatcaagcacaagttgcttagtttcatatttttatatcatacagttccaataacctttccccggcaatagatactatcataatcatgcagcggaatatcatcataatccgggttaagggaaatcaagcgatctccgccgaacttctttataaatccttccccgttaagtataaaaatgcctatctcgccgatctcaacagatggctgcgaggctatcagaactacgtctccgtcgtggaatacaggctccatgctgttgccagacactcttagagcaaaattagcctcaagagtgagctgcgttttcttaacctccaacatacctttttcgcagccatccagatcaacgccagttccggcactgacaggcaacgaatagtactctatgaaaacactgttttcaagctcttttaatggtatttttgactgctcaaaaaggaccttggcacgttcgaggacttgaccctttttcattaaatctaattccttataatatgtaagtaactcttgctcatcatcggtcaactgttccgctggtgagcttttttctttgccgtaaacaaggtaatctattgaaacatcaaaaaattcagcaatttcaattagatattttctatatgatttgcttttcccagacttccattctgaaaaagcaacattatttaatttcaggtaattagtcaattctttttgctctcgattgcctaaaagcatagttattctatccaaaatatccaaaattcaatcatctcctttgttacttatcacgaaattagcgtttttctaatttcgagttagaatttcacttgacaattagaaaaaaatctagttataatttactatagggtaacctctagggcatagttaccccatgataaattaagtttaacacaaaaagcgttaaacgtcaatcgaaaaaggaggaattttaatgaataagtataagattaaggaaaccgatgtgaatatgtatgagtacagaggctatacgatatcaggtaacgataggataggctatgtttgcatatcaccttacggggctttctcgccaaaggcttataatacaatcgaggatgctaaggcagcaatagatgatgatcttgattgcatagctgaaaaatacggcgagcagcaaacaagggcggaacaaactccgccaataagaggatatataatgaataaagctttaatcgtagaaaaagagctctatttcctgctccatgccgccaatgatgatgttgatgatataacttactgcgaagacaacggagaagagtgggtgcttgtaaccatgaagaacggtcatgtgtatgatataggcatcacaggagacagtccgcttgctgccgctaaagacgttatcaccgttatgatgtataagtaaggagggtttattatgaaaaaacttacggacgagggaaaggtgcttaccatgtttgccattatcatgctatggtgtgccataacaagtcttagcggacattccgagttctggatcataccgttgcttacactatccggattgttctgtatgcaccttatcatctctcttatcagagatatatactttgctaaaaggagggaacgcctttatgagcgcagatattgggaaaagcataaagcagattagagagcagcgtgatcttaatcagagagagcttgctaagtatgcggggatcagcaatgtgaccatgtgcaagatagagcagggcgttttgacgccctctcttaagactacgatcaggatagccaatgtgctgcgatgcagtcttgacgatctgtgcggcagatcacgaaacagccgaaacagccgacagtaactcggctgtctgccggggacggtctcccggtactgatgatggcagaccaaaatatgcaggtgccgtgcttgcccgccataggggatatagtgaatcacctgcagcttgcaagctcagaggtaacgacttagatcttgaaccaagcctgtcatacagtctgtagaccgaggacataaaatatcggtagcgtatgacttaaaaaccacgtgttctggctacgtgtcgtcgggttgaattagccgaggtacaggttttgttataagggttccgactttccttaaggtgcgaactcgtaaatgcaagctgagagcgcatgagcttaatgtttgcactagctggaacgtcttttgtatttttataacacagtctaaagacaacataaagataccgcccgtctgagcgtatcagacccacttaggataactttttatcctatctaccttgccgtttcggtaataatcggggcggctaaatgttcacgcatagtgctaggttcgcaagcgtaagcctatcaggtgcaagtcctgatgtgaaagccaactcaatcaacctagtcgacaaggttgtgcaacgcagtataagtgcgcagggtactctttcggaaggagtagacttatacattccgatttttctagccgaaaccgagccgcaacaggcggttcggtctgccggggacggtctcccggtactgatgatggcagaccgagaaaggaagtgtaaccaatgaaatacaaggaatttaaaacacaagtactgtctcatgcggtgggacaagcccggcttctggctcaggcaagctgccttgaggacataaaaatagagcctgaacagctccgcaggaatgttgcgaccattcttgcagtattgaccgaaacagaagattttctgtccgacctcgtaaacaaccgttctggctctgatacttagtatatcagaaaacattagttttgtcaagtaacttcgggaggtgatgatgtggaatatttgacggttgccaaaactgctgatcttaaaggctgcagtgaacgatatataaagaaactgtgcaaggacggaaaattgtcatgcaatatcgaaatcaacgacaggaaccgtcctaaatatatgatcccaatatcatcactccccgaaggcctgcaggcaaaatactatgctcagaaaagagcggaagcgggcttagaacttgttgcacagcctgttaaaaatgcattaaaacagcccaaaaagcctgtgaaaacgtcaaagcctgtgaaaacgtcaatcgaagagttttccgaagatgagcgtgatgaaatcgcactctgggtagatatcctcagagactggcagcgttaccgggatcaataccccggaaagaaaaccgaagtggataagctttacgtcggcaagtgtcagctcgagcataatgatatcaaagtgtcggtggatatactataccgcaagtatgcagcctacagaaataataatctgcaggggctttgtgaaaatcgaggcggagccaataagggtaagagcagtatcccaccggagctgtgggagcagttttgctatttctatctttccgaaaacaaacctaccgtttcgcgttgttacgacctaacgcttgaatgtgcaaaagagtggtatccgtcaatggtatcaaacttcccgtcagacaatactttcaggcggcatataaagtcggaaataccacaagccgtgcttacatatatgcgcgacggcgataaggctatgaaagataaatgcctgccatatatcagccgtatgtacgacggtctccacgctaacgacgtctggatcgcagataaccacacgttcgatatacagtcctacgatgaagataacggcacgatccacaggctgtaccttacagcctttttggatgccaaaagcggagtgctggtcggctggaatatatgcgacagtccgaactcccagtcaacaatcatcgcattaaggcatggaattatgcgatttggcattccgaaagccgtatattttgataacggtcgagagtttttgacccatgacgttggcggaaaaggtcatcgaagcaggaaaaccgataaccctgagatcgaaccaccgacaatactccaaaggcttggaatcacgatgcataacgcaatcgtccgtaacgctaaagcaaagcctattgagcgtacatttagcacggtcacaatgcagtttgcaagaatgtttgaaggttactgcggcggcactattatgcagcgacctgagagccttaagcgtagaattaaagaaggcaagattccctgcgactttgagattagagaatatattgatatgtatattgacggtgattttaatatgcaggaatatggcggagctgagacaaagtacaaaggaatgagtcgtatcgacgtatggaatatggatataaagtctgtaggaatacgcaaagctccggaagccgaacttaatcttatgcttatgagatcaacaagggtacaaaagatcaagcgcaacggcgtatttgttgaaatatccggcgaaaaggtctggtttatggactatgaaaacacttaccgtcacctgggcgaggaggtctatgtaagatacgatcccgccgatcttagaagcgtaagggtttacgataaatcggaccgttacctttggacttgggaatgtgcggacaagctgcttatagattacatcaccgaaagcaaggaagagatttccgatgcaatggctttacagcgcagagtacaacggtttattaaagccgaggcccagaatatcacagatggcttaaactcagagcataagatcgaccttatggaggctgccgctctcaaggcagcacatggtaagcagagctttaagatcgttatgccgtccaatgtgattatgataagagctgataatgaaccggaaagtatatcaaaggcttccggagacgatattgtggtcaatatagataaaatgaacgaaaacgccgagaggcggaagaataaatggaggagtgattaataaatgaaaaagctaacagctaaacaggagtgggcattggaacagataaaacagctgcagtactcggaaaatctatctgcggctgcagtctgcaaaaagattggtatatccgatagctcatactctgcaattaagtcaggtacctacaacggcgatgtagataagcagatgaaaaaagtaattgaatactttgtaaccaagcaggctgcagctgaaatctatgtcggcacagactataaggaaacgtcaatatcgtctaacgtgtacaagatcatacgcaactgtcagcttcagggcggtcttgccatagcctgcggtgacgcaggtataggcaaaacacaggcttgcaggcagtattaccgtgagcacggcacaaactgtatatacataacggtaaatccgtgcatcaagtcatcaaaatccgtgctggagcttatcggttctaagctgaacgtatcctccggctctgtgagcagactctggctggaaatctcgtcaaagctttcggacggcatggtgataatcgtggacgaagcccagcatctcaccagaaatgccattgatactctccgaagcctttgcgactgctttgacgaaaagggacagacccttggaatatgctttgtcggcaacgaaaccacggtaagcagacttggcggaaagcagaaagcggagtttgcacagatacgcaacaggacgaagaatacccggttttacagcgttaagcagataaagaagagcgacatcgaaatgctctttccggatatcagagaggacactactgctgttgaatttttactgtgtatcgctcaaagtccacaggctatcagaggagcggtcaatctatactccaacgccctcgataacggcaatgtgaccgccaagggattgtctgcaatcgctaaatatatggatatggcggtataaaaagtgaaacggaggacaaaaagaatgaagcacggaaaaaatcccaccaaagctcagaaacgaataatagcgtattacaagcttgatcctgcggactggatggtttcgaaggcgacggacaagcagctttgccttgtacatagatatactgataagatacgctggatagacatggtacgcatcgaggagccgaggaaagtaaaggcgactaaatatgcataataattttgaatgttttatgaaaggcagcgcagaatgtgccttttttatgaaaatgtgttgtgatgactgtccgtactgcgataaatgcggctattgtgataatatttgcaacagtaacggagaatgcaatgaatgctcaattgtagacaagaaataataagtatcagaggggctgtgcccctcctgtaatgcagccgccgatcggcgcaggtcacaagccctgataaatgcagagtgcagaaaaacaaggaggtaaaaacgctatggaaacaaaacataaaaagcttacaagcaaagctggattgacgatcccgaaggacatcagacttgcagcgggctttgcgggaggcatggctgttgacatcgagaagacagcggacggtatcatgattcgcaagcacagacctacctgttgctattgtggcagtgttgataatgtgcgctctatcaagggacgtgatacctgcagaaactgcgccgaagaaatcatagaggaggtaaagacggcttatggatctgtctgaaaaggtaaaacgttatgctgagatcaaggcggaaatttcggagcttaaatcagaggcagacggcatcgaggctgatatccttaaggcttcggaagccgacctgcaggatacaaagtttaaatctgctgtctacagcgacaatgctggcaatgcaatcacagtcaccaacgccgacaacgttaagcttgtgtacccaacaatgcttaaggagatctttggtaaagcgtacggcgacgttgtaaaagaggacgtaacctacaccttgtcagaatctgcaaaacgcttgctttccgccgtttacaacaaggagtacataaaggacggcagcgttgctaagatactggatgggcttgggcttgacgataagagccgcaaagttctggagaaaaagcttaagggtgcgaaatatgagaccgacgtaaaaaatcttatgcagcttggcggtctggatgaaaaggcggcgcaggagaacgcttatctggtatccgaagccgtcgcttggcagaatcttaaacatctgcttatgattaataacgaacagcttaccgatgagattgtggagcgtgctgtggatatgattgacagcgcggttgtagttgaaagaacgccgaaaacgaaattcacggctaaaaaataaggacaggaggatttggatatggcaacaaaggagcagattaaaagaatttacggtctgggagcaggtcttggtattgtcggcaaagataaagatgatatgctgcacgaattgatctttagcattaccggtaaagattcggtaaaacagcttgacgatagcgaattcaaggctgttcaggcggaacttatcaatcgcatgaagcttgccgatccaaaccatctgctgcataataccaaatctagaaacaaaaagaaagaagctgaagagatcggctgcaacggtatggctacgcctgaacagcagcggctgtgctggagatactgctacaggctcaaggaacttgacactaatccagagtcagctgacgttggagacaggctaattggcgtgataggcaaagtactgggcgttacggcatcaaaaaagcagccgtttcggtggatagatcaggaacagtgttctaagcttatcgaacagctcaagcgttatgttaattcggcagagcggcgggcgaaaaggcaaggtgagaaatatgccggaacttgatatatacgaagaagaccttactccagagcagcgggatatttacgactgcatcggctcacaggcatacgaaaagcttgtgcagcgttacggtggtttgtcaatttacattgcaaaagctgattctgttatccgatcggcacgtgacgaaaagatacgcagggattttaacggatataacttcaagtttcttgtcaataaatataatctgtctgagcgcacgatccgcagcataacggctgagataaggcaggaaaagcaaaacgctcctatcgagggtcagattacctttgatgaaatataattgcagaaactcgctgaaacgcttcatctgtaacacccccaatatatatggtacagttattataacggataacggtactaaatatattgggggtgtttttatgacaagtcagcagatatttacgatagtatttcagctcgttcttacaggcggtataggtattataacctactttttaaagcggactatggacgacatcgataaatgcaaaagcggtctggataaggtcagagaaaattacgtctctaaagacgagtttgacaagtgcaagaccgatattaccgacgtcaagcagaactatcttaccaaagaggatttttacagagaacagcttaagactgaacagaagctggacaagatcatggatatcttgatggaaatgaagggagaaaaatagcatggatatggaaaagcagatgcagcttatcagagcaggcaattttaaagaaaataacggctctgttatgcgcactataaatatgctcagatatcagtatcataagcttaagagcgttgagtatgctcttcccgatataacaaagggcgaaattaccgacagcgtgaactatctttatgaagccggatacatacatctgaggacggtgttgtccaaagagccgtctacgctggcagacagcgattttgacgaactcgaggcaaagcttacggcaaaggggatcagcctgcttgccggaggtatcaacgacccctgcataaagctgtagggggtgcggataatggcaagaaagcgcagaaagcactctaaaatagacaagctgtcgccggaacttaaagcaacggtcgaagatatgatgaaagccgattttacatatgcggagatcgcagactatataaaggatcagaccgatcagcccatatcaatatcctcggtttgcagatacgccgcaaatctgaatgaatctgttgagaccctcagaatggctcaggagaatttcagggtcataatggaggagataaacaagtatccggctctcgataccagcgagggaataatcaggctgctgtcgcataacgtgttggaatctatacagaacactcccgaagaaaaatggaagaacatagacccggaagccttgctcaaacaggctaccagccttgtaaaggctgcggcgtataaaaagaatatggatctgaaaaacgaggatatccttaacgcgggctttgaacaggtcaagtcaatggtgttcgaggcaatggcaagggaacgtcccgatctttacaaggatgtggctaagttccttgaggagaaaaggagcgatatatgatctacgttatttatgttcagagcggcagagagcatgacgttgttgccactctcagagataaaaatattaacgcctatgcgcctgctcacgacctgttggaacgtaaaggcggcgtgtggcgcatggtacgccggatgatatttcccacatatgtttttgttaacagtgaaggcatcacagacgagctttactacaccgtgaaaaatactgtcggcgtattgagatttttgggcagaccgcccactccgctgccgatgagcgaggaagtcagacttcggtggatacttgatgtcgaaaatcttaccgtcagccgtggttacataaacagcggaaaggtgactatcacagagggactgctcaaaggcagagaacactgcattgttaaatacagcaggcggcgtaaacgctgtacgctgtactgtgagataaacggcaggcgtcattactttgacgttgctgcagaactggaaaagatctgatcataagcgtaaggttgattcgtcccctgcgcttaagctcagattacatagcgccggacatcaacggaattttgaaacaaaaatatccgaatggcgaagcattgctatttgatttcattttagcggcgtttaacggcgttatagcacgttttgaaataattcttaggataatttcacacttgaaagagaaagcccttaaaacgggcgtgtagtttgagtttgagcgaacggaggtgttaatgtgaatgtaaagagaaaacaggctatcgacacgctgtcggcagctgtaagcaacattaatgatgtaaaaatacagacggatatacaaagcctcggcgagctgtcggaggcttttattaatacctccgacaaggcagaacggaaaaagcttgccacagattataaaaagcggcacaaggaacttcaggattttttggacgacaatcctgaacttgtaaactccgaagtggagagagctttgcttgcggcggccctgggcggcgaatatgcagaggaagaagttagagttgacgccagagggcgcaaaacgatcaggcgcagggtaaaaaaagtcgctcccaatccgtccgccgctctgagctatttgcagaataaagacaaagaaaactggtcaccgaatcccaaggctgatcctgagctggaggacacgtcggaaattgaggaggatatctatggcaaggacaactaagcctgagaaacgcaaaaagaccataccctacaattttggcgataagcataaggcatatatccgaaagtcacaggactgcatgataaacgttgccgagggagcggtaagagccggaaagacagtggacaacgttcttgctttttgtcacgagcttaagactactaaagacaagatacatcttgcatcggcgtcaacactcggcaatgcgaaaatcattcttggcgactgtaacggctttggtattgagcatttctttcgaggtcaatgccgctggggtaagtacaagggcaatgaggctcttatcataaagggcaaggatacaggatttaaaacaaggatcgtcatcttttccggcgctatgcttgccagcagttataagtccatacgaggcaactcttatggtatgtggataggtactgagatcaatctgcatcacaaatcatttgtgcaggaggcttttaacagatctatcgccgcagataagcgtaagatatggtgggatcttaacccggacaatccaaaaagctggatatacaccgagtacattgacaagtaccagcaggacgccgccgattgcaaattcctcggtggatacaactacgcacattttactattgacgataacataaatatctcagatcagcgtaaggctgaggtaaaatctcagtacgatccgacatctatctggtacaagcgagatatactggggttaaggatagcggcagagggtcttatcttccagagctttgccaacgaccccgaaaagtatataatacccgaatcacagcttgacaaaagcaagatcacatcaatacagataggtatcgacttcggcggcaacaagtcaaagaccacattcgtggctacggcttttattgagggctttaaaaagcttgtcgttattgcagatcacaaaatagacggcggcaagggcgaggtcggtcccgatactatttacactgcttttataaagtttgtaaagacgttatatatgcgttttaatccgcttttaattaaatttgcatgggcggacaacgaaaaccaagcggtaataaacggtctgagagtagcctgtgccagagcaagactgatggtcaagatcgtggactgctacaaagctccacgaaacgacagaatatctatgcttacgtctttgatggttcagggcagattttgggtgcttgacatttgcaaaaatgttatcggaagcttgtcggagcagatatgggatcctaaaattccggacagagatgagcgtcttgacgacggtacttgcgatatagataccgccgacgctctggagtacagctttagcaaatttatcaagccgctaacgctggcaggaggtgaaaacatttgaacagtgagataataaactggctgaataataacttcggctataacatttcgaccgactattataataatatatccgtatggaaagactggtggaagggttttcatgaaccatttcataggataacttttgaaaacggagaaaaacgcaagagtcgtgatatgtataccatgaaaatggccaaaaaggtgtgcgaggactgggcaagcatattaataaacgacaaaacgtttgtaaaagtagatgatgaatactcggaaaagttcatcgttggcgataccgacaacggcggagtgttcggcagcaacaacttctgggatcaggctaacgaccttatggaaaaaatgatgtattccggcacttgtgccgttgtgatacgtcttaaaaatgctgtggtaagctcagacggcagacttctgccgtcaccggacgcatggatagatctaaattaccttgaggcggataggataatagtcctatcatcggacaacggcattatcaccgaagcagcgttttgctccgatatctgtacaaaaggcagcaacaagctgtatcttgagatacaccgtctggaaaaaggcgaatatgtcatagaaaatcacatctttggaataaaagataaatcgctgttgagcgaagaacctctgccggacggtgttgcaagaataatgcatacaggatcagacaagccttggtttaccatatgcaaacctgctatcgttaatcccattaacggcaataatgggatgggctgtgcggtttttgccggagcgattgacaacttgaagggagttgatcttgcatataataatcttaactctgatttttggttgggacagaaaaaagtgtttttaaacaaaaatatgcttgaagatatgtctggagataaaaaggttgctcccgatgaggtaaatcaacaactgttttattatatcggcgagactatggacgatggcacgggtaagagtatggtgcaggagcataatcccgatctgagagttgcagacaatacggcgggtatacaggcacagcttgattatctcagctttaaggtgggatttggtactaagcattatcagtttaatgcaggctctatagtaactgctacccagtacacaggcgacaagcaggacttgatccaaaacgcacacaagcattttataaaagttgagagctttttgcatggtcttgttaaaacgctcctctggataggccacagctttatcgacgcacaggtcaaggaggacgcacatatatccatagtctttgaccaaagtccactggtagacgaaaatgccgagcgacaacgtgacaaagatgatgtaacagcaggtttaatgcagaagtgggaataccgtgttaaatggtacggcgaatcggaagaggaggcaaaggcacgtcttgcagacggtgaacctaccgacgatgagcttatgggctttgaggacggtgaggagtaatgcttacccctcagacgttacaaaaactgccagatgacttgattgatcttgtaagcgaggtacagactgatataatcaagtctattgccaaaaagcttgttaaagcggactatcttactccctcggcggaatggcagttgtacaaagcaagccagctgaagatgtctacaaaagagatcactgctatgcttgcagaatttacaggcaaatcaaagcggcagatatcaaagctgtacaccgatgcctgtaaggaggcaatcaacaacgacgccaagatatacagaacttacggcaaggactgctccgccgctctgaggtcggtggcattatccaacacgcttaaggcaggcgttaaaaatgcaaatggtatgacaaaaaatctgtgtaagtccatggtagagtcctcgcaggcaactgttactcatcttatggacaaggcatggttaaaggtacaaagcggtgcttttacatatcaggatgctatttacgacgcagttgtcgagcttgctaaacaaggtattgcgactgtaacttatccatcgggtaagaccgactgggcagacgttgcagtgcggcgtgcggtaatgacgggcataagtcagactgcaggtcagatgcagcttgatcttgccgcagaaatggactgcgatctggttgaggtcaccgcacacatgggcgcgcgtccctcacacgctttatggcaaggcaaggtttacagcatttcgggcaaatctaaaaaataccctaaactcagcaccgccacaggctacggaacgggtgacggcttgaaaggctggaactgccgacatgatttttatccgtttttcgagggaatttccgaacgtgctaatctccctgttgacgtgaccgaaaacaacagacagtatgaattatcgcagaaacagcgtgctatggagcggtctatacgagctacaaaaagacgtttagctgcatatgacggtgctatctctgagacggaagacgaggtgcttaaacggagactgcaaaatcagtttgaacgccactcggctatactgaaaactaaggaaaaacggctgtctgagttttgcgatacgaacgatctttatcccgaaaaggacagagttcgggttgttggatttaacaagagtgtttcgcagaaagcggtatatgggaataatcgttactttgttaagcaaatgaaaagctacggcatagaaaatccgccgaaaagccttgacatttttgaaaatatgaagtataataactctcctgagtacaaattgatgaatgcatatattacttctgtaaaaaagggaaaaatttctccgcttgtaggttacgatcattataagaagttgcacaatgagattaacaacagtcttgttggtttaactacaactaacggtattgaaataactgggcaatcggatcatttcattgaacgtgttattggtgtaatcaaagatcctgatacgggtaagaaacgtcttggcgttgaacttcaagatattcaggatgctttgaccaatggtaaagcaatgaaacccaaaataagcagggataaaaacggtaacattttatatgatgaagatggtaaacctaaaatatctcagctatttgttacagataaatgtgcagtatccataaatcctgaaacgggcgtgcttattcaatgtaatccaaagtgaggtgtattattatgatattcaatttcaaaaaagatgaatatgaaatgcttgtcaaatatggcgattttgaagatttggaatacccatacaagctcttccccgaaacaagtcagatagaaataaataataaagatgtttctatgtttcaatgcataattagcaacatatcagttgtttatggcatggacgaaaatcagaataatatgacagatttcggatataaagcattggatatttatgataaggtttattttcaaattcataatgaataagctcccagctactgggggcttttaattttgcaaaaaggagctgataatttatgctttcaacccttatattgctttacgccctcgatacagggcaaatccccgttggctgttatgtagccgcatgggtcttcacaataataaaaggtatttgtttggttattaaatgccttgtagatttatcagatgattaaaactgcattttaacgatagtaaaacgctctttcaagggcgttttatttatcctcgtttttgcggagcaaaaatccgagccgcttgcgaggagataaattttatactcaaaattaaggaggaaaaatccctatggaactgaaagatttaacagctctcggtattaccgaggagcaggcaaacaaggtgcttgaacagcacacagcggagctgaccgcagaacagcagaagtacacagaccttaacgcagaactggaaacggcaaaaggcacgatctcagagcttactgataaggtcaaagcatttgacggcgaggacattgaaggacttaagaaagcggcgtccgactgggaaagcaagtacaatgcagatattgccgcacttaagcttgacaaggctctggaactgtcccttgccggagcaaaagcaagagatgtggacattgtcaagtctcagcttgactcgtcgctcctcaagcttgacgatgacggcaagatcacaggtcttaccgaacagcttgacaagcttaaggccgacaaagcatttctctttgcggatggtgatgagcctaccgcaaggatagacaccggtcttgaccacggttcggcaacagaaacaacatcagacgcacaggcaagagccgtaatgggtctgcctgcgactaagtaattttacggaggtaaaatattatggcaaacgcaattacaaaatttaaaacctacatcgcactgcttgacgaggtttacaagcaggcatctttgaccgccgatctcgacagcgatcctactcttgttaaagcgggcgcaaacgcaaatgagatcataatccctaagatctctatggacggtctggcggactactccagaaacagtggctatgtaaagggcgacgttactcttacaaacgagactgttacctttaattacgacagaggtcgtaaattcagcgttgacaatatggacaatgaggagactgcaggacttgctttcggcagactgtcctcagagtttatccgcgtcaaggttgctcccgaacaggacgcattcaggttcgcgacctatgcaggtacaacaggcatatctaaggtttctgcaggagcaacactttcatcgggtaatgatgtccttaccgctctgatcactgcacagaacaaaatggacgaagacgaagtatcgccggaaaaccgtattctgtacatcactcctactctgtataaccttgctatcaatgtggacaccacaaagtcaaaggctgtacttgacggctttgctaagatcgtaaaagtgcctcagagcagattttacactgcgatcgatcttaaggacggcacgacaaaatcagagggcgtcgatgaaacggcaggcggttttgctaaggcgacaaccgcaaaggatataaactttatgataatccagaagtcggcggttatccagtatcctaagcacacggtaaacaaggtcgttacgccggaggaaaatcagacggatgacagctggctgttcttcttccgtgcttatggtctggctgatgtgtacgaaaacaaggcggcaggtatttatctgcaccacaaggcataggaggtgtcgttatggcaaagacagtaggattgacttttaacgagaagccaataacaatagaaccgcctgccgactatcgcgaaaatgaaaatgtcattgattataagagcatgacagtccctgaactaaaagcttatgccgccgaacttggcattgacctcgggtcggcaagcaagaaggacgcaatcattcaggaaatcgtcgatgcagttgcggtagaggatacgacaagcgaaacggaggtgtaggctatggcttatgctgattacacgttttacactgctgattttcatggcaataagatttccgaaacggattatccttattttgcggagcgtgcatcggaatatctcgacagtctgagctttgccgagaccgacgagatcagccttgccaaagcctgctgtgcttgtgcagagatcatgtactccgcacagccggataaacagatagcctccgaaaaggtcggagattattcgataagttattcgaccactcagactgctgtcgccgatgagctgatcaagaccgcctccagataccttaatctcaggtctgtggggtggatataaatgagatataatacaaaatgcaccgtctggcacaaacagcccgacggtgcatttattacacagcattatccgtgctggtggcaggacaccgaagccgaaaacattgcaaagacgggcaagaccgatgttgaccgggcgttgatacatctgccgttgttggctgtagtcgataagtccgactatattgcaaagggcgatattgattttgacgtgacagcctctgtggcagagttgcttaaggctgtaagcccgctcaaaatcagtactgtagagcgcaaggattacggcagtcccataatgtggcacacggaggtgacggctaaatgagtaataacagtattaaagtaactctcacggtcgctcccgaaaatgaactgtttgcgaggcgtggtctgcaaaaaggcggccgagtacagaagtatatcgacagcgaagtattacgttgctgtgatagttatgtgccaatgcttaccggtaagcttaaacagtcaggtattacatcaacggtagttggatcaggcatggtgcattacaacacaccatacgcccgcaaaaattattacgataacaaaggtatgggcaagcaggggcttaaccttgggggcaagcgaggcagactatggttcgagcgtatgaaacccgatcatctgtccggaataatcaaaggagtgaaacgaattgccggagcaaaataaaagccttttggaggctatgaaagaatatgtgttacagtatcccaatcttggagatattgatctgcacatagaccagactgagtctgaacctgttaattacagtatacagacatcaggtcttgtaaaactcagtgaggacgtgtgcggaaatcagacatggcagtacaatgctttgctccagagcagagagtacacagccgatgatctgtcaaggctcaatgcatcagcttttacggaggattttatcttctggattgaaaaacagaacagtagccggaattatccagaacttgcaggaaattttgaacctatcagtatatccgctgataatggcatactgcttgctctggatgaggacggagacagaggattgtatcagatacagatacattttacatttgaggaggaaatataaatggcagctacaggaataaaaaagcttaaaagaagtcatcttatgcatttgttggattccacttttggcggagaaactccgtcatggttcctgatcggcaaaaacattgaggatatgtctatggatttgggaccggataccgcgactgttaagaatatccttgatgaaacagatgtaaatgacaacggttacgaacctagtttgtctgttgaaacctactacgcaaatacagaagatgcgatttacgaaaagatcaaatctattgcgttggatcgtcttgttggcgacgactgcaagagcaaatatcttgaggtgcttatcgataagaccgaaggtccttacgatgcatggatggaagattgcatcgttaagccgcagtcatatggcggaccgcagggcggtgtcaacataccgtttaatatccaaccctgcggcaatcgtattaagggtactgtaacaatcgcaaataaagtggtgacatttacgccgctggctgaaggataatttgaggggcgactaagcccctcttttctaaggagtgttttttatgtcagaaacaattaagcttagttttgacgacggatacaaaaatatcgaattaaatgggaatccggataaaataatccgtattaatccaacagatactcagtttattaaccgaatttcaggctttgatgagaaatatgagaatatacgcagtagatacggagatatcgatatgaactctatcaatgatctgcagaatcttgatgagaataatccggactttgaaaagctgaaacttgccgctgatagtgtggacaaacttgatatggcggtgaaggatcttataaatgagatctttggttatgatatttcattaatagtattcggaactgattcatgtctttcgcctgccggaggtcaaccagtatttatgaattttatgcagtgcatcttcgcgtacataaatgaatgttctgtggaggaaagaaagaaatcacaggagaaacttaattcctatgcggcacagcgcaataccattgttggtgaaacaaaatgataggtgcattgcctaaagctttgacagtcaacggtaaaatatattcaatatatagtgattatcgcgtagctttgctgattttttctatgtgcaatgacgatacgcttaatgacaaagccaaaacatatggatgtatacaactgttgtacaagcatcacgatcagatacctaactcggatctttacgaagcggcagaacaagccaaatggtttcttgacggcggagatatgccaaaatctaaacgtcaacctaaaccgttgataaactgggatcaggatgaagggattatttttccagctctcaataaggtagcaggaaaggaaattcgtgaaattgattatatgcattggtggacggttttaggcctttttaatgagattggtgagggtttatacagtaatgttataaatatacgctataagcttgcacacaataaaaaacttagtaaaggagaacaggacttttaccggaacaacaaagaacttattgatattaaggtgaagcttacagcagaggaacaggatgaacttgattttataaataatctgttataaaaaagtcagcccgtttggactgacttttttattacgcccaccactgattaccgcagttaaggcaagttatacgaactttttttgctcctttgtttccggcaacaagacctattggaccggcaacagcagttcctatgactgcttttccgactccaaagccttttttgtttgccgtaagcgaagtacttccacatttaggacagcaagcaataccgtttttcttgttttcctttatacgctgacgttttgataacgttttttcttcatgttgtgtttcgcctgtttgtgatgaagttgatgtggttacttccatcggtataaaagtattattgctaagtgcggagaagtaaccacataactcagcaatttttttattattgttaaagaaaaacattacgttatatgattttccgtttgctgttataaacaagcgaccgttctcggaaggagttccggctgtatatctaatatctgatatgtcggatacttttatagtttcgcttttgagcccacttttgtatgagatctccgtttccgaaactattatagttgacacaaaagccgattttattgtggcattcataggtatagttgaaatcgagttgacttcttcaatttcggttttattgtgatgcagaatttcagttccacatttcatgcagaaatctgattcatcggatatttctgcgccgcatttaaagcaaaacataacatttcctcccattatgtatttttttcattatacagcgtatggaggattttgtcaagaaaggaggctgatataattggcaattgacggcagacttaatttcgatacaaaaatagatacaaaaggattttccaaaggtataaacagtttaggtaaccagcttaataatctccgaaatatagttttaaaaatgggtgcagcacttggtactgtgttcagtggaaaagaagctcttgaagctgctgcagatataaatgctgcaaattctcaaatgcaacagacttttggaactttaaaatctgctgcagatagtgctatgaaaagtgtagctgataacagtagcattcttcagacaagacttcaaaatgtaggcacatctatttatgcttttgctaaaactacgggtatggattcagttagtgctctaaaaatgatggaagaagcgttgcaggtaacagcagacagtgcggcatattacgatcgaagccttgaagatactgcagaaagcctaaaatcgttcttgaaaggcaactttgaaaacgatgctgctttgggtttgagttgtacagaaactacgcgaaacacagcggctaataaactctatggaaaatcatttatggaattatccgaagctcagaagcaacttacactattgcaaatggtcaaggatgcaaatgctctttctggagcggaaggacaagccgcgcgagaagcagacggctgggaaaatgtcatcggtaatctgaaagagtcttggaaacagttgcttgctgtaataggacagcctgttctttctggtgctgtaacagttgtaaaaaacataacagcggaattgcaaagtttgacagctgttgctaattcagcagttaaagcactttctgaggtgtttggaattaaactgatgaatacaacagatggagttgctgaaagttcttcgcaggcggcggaaaattattccgatatggcaacatcggctgaagctactgtcgaggctcaagaaaatgcacttgcaagctttgatcagataaataagctggcggacaacagttcctcatctgatacaaatgcatcgccagtggtcggtactctaagcgacaatacgatctccactactgtagatgttgatacatctgatgccgataaaaagcttaaagattttttttattgggtaaaatcatcttttaatactatttttacgccatttaaacaagcttgggataaaaatggagtcaaggtaacagatagtatgagatttgctttcgagggtgtatggagtgttatcaaaagcataggcggatcattcaccgatgtttggagtaacggaacgggcgaacaaatttctgaacatttactcggtatatggacaaacattaataatacaatcggatatgtgtcacgcaatttttcctccgcttggtctgatagcagtggtacaaaaattattcaggacattcttgatatttttaatgatatactcgacacaattgaaaacataacggcagacactgttgaatgggcgcagaacattgacttctcaccgctcattacatcatttgaaaatgtaacatccgcattaaagcctttaactgccgacatatttgacggtatcgaatggttctgggataatattttgctccctatggcatcatggactataagtactttgataccaacatttcttaatttgctggcggcagctataaaagttcttgattcagcaatttcagcgttaaaacctatgggtaaatggctgtgggataaatttttgaagcctattgcaacatggaccggaggtattatagtaggcgcgttgaaaggtattacatcagccttaaatggggttagtgactggataaagaatcatcagactgctgtcgaaaattttgctgttgtagttgggactttgggatcggcatttgcaatatccggaataattcaaggcgtagtaagtgcatttgccgcattggcggcaggaacaagtgtattgacaccgttaattactgcacttggtgtagcagttaattttttgacgagtccaatcacacttgtatgtctaggaatcggttcgcttatcgctatcggcgtattgctgtacaaaaattgggaaacagtaaaacagttttttattgatttgtgggacagctttaaaatgaccatacagcaatttgtagactgggtaacagaggtctggacatcaattaaagactttttcgccggaatatggcaaggcataaaagatgtatttgccgtcgtggcagaatggtttacgggaattttccaagcagcttgggacggtattttgtctgtctggaatgccgttataggttggttctcaaatctgtggacaggaatcaaagacattttttctgcagtaggaagttggtttggagatatatttacaactgcgtggacaaatataaaatcggcgttttcggctacagcacaatttttcagggatttgtggactgcaataaaatcaccgtttattaaggtagctgattggtttaaagatatattttcaaaggcttggcaagcagttaaggacgtattttcgactggtggcaaaatttttgacggtatcaaagagggtataacaggagtattcacaacggttgtaaacggcataattggcggaataaataaagttatttctactccactggattttcttaatggcatacttaatgatattcgtgatattgaaatagcaggctttacaccatttgatgagttttgggactatgaccctataccagttcctcagattccaatgctcgccaccggcgcggtaattccgccgaactccgagtttcttgcggttctcggcgaccagaaacgcggcacaaacatcgaagctccgctggatacgatcaagcaggctttgtttgaggcgcttgctgtttacggcggagctgtaggcaatcagaaaataagcgtaacgataccaatcgaagtaaagggcagagtgctgtcacagatcgttattgacgatataaatgattttatcaagcgcaacggcaaatcgccgataaaagtataggagggatactatgaaatcaaatggattgaaatttgaagaagaaacggtagccactcctgctgaaattactttttgtaacaataaaatctggtcgggcaatgcagggcgcaccgctaattgtcttatggtcggagacatcagggctataaagaaaacggtcactattaaatggtatcatctcacaggcgagcagactgcacagataaataagtatatctcaaatgttgatagcccattttttaacgtcacacttttggacgagacttttaatgaaatcaaaataagggtctatgcaggagatccaagctatgaaatattcggctgggacgaaaagcggcagttttgcaaaggcgttgctgttgaccttatcatgcagtaggaggcggatatatgtatacaacaagtacaaccgtctcctcacgcatcgaaagctactgccgcacatggcgtatgtggcttgaaaacgacgagagcgtaataatgggggacaacataatgtccgctaccagtgacgtgcagtcaacgagcctcagtgacgacatagagcttggtgcagtgtgctcacagtcttgggcattacagataaacgatgctgaaacacgtttcctcggcaaagagtatgacctgtccctgtaccttgcagacctcacaggcgtgaccacctactccaccctagaagcctacacctacgcagaactttcaaagctgacagtggagcagataagcaagcttggagaggtgcttgacggagagagaatacctctggggcggttcacctgcgtgaaatcgaaaaagtcgggcggaaatactgaggtcacttttgcggataggctttacttctccgacaagacctatgtgccaaaggtcaagctacctgcgtggtcaaaggctgtcgaggacgacatatgcaagcagcttggactgcaaaacggcaacgactacaccatccctgcaaagctccgtgtaaagggcggtgcaaggctttacggcaagggtcacataaggctgaaaactgcaaacttcgacttcaaaataagctctatacccaaagacaccacaatgcggcagatgctcagttacatagcttcggcacaaggcgagttcggttttgttgaccgatacggcagatacgtccgcaaatggtacggctcgagcgtgaagatactggacaacaacactatcgacctgccaacactgggagaacgtccgaatgttttggcaggcattgtctgtaaggtcagcgacagcgaaactctgcggctgggcaacaccacaggctcggcagggcgtgtgttggagtttgaaaatccatatatgacaatgtcgctgctgcggtcattgtgacataggataggcggcttttcgtggtatacaacggagctttttcaccgccttggcgacccccgatttgacgttggtgacgtgataacatacgtcagcgaaagcggcgaaagctacgatataccaataactaacataggattcaattttgacggcggactttcagcagacatttctgcggtgggtctgtcggtggaagaacagctttaggaggcgagataatggacgaaaatgagataacaactgtggctgatacgcaggcggagaatactgccgatacagcggacacaggtcagacaacgcccaccaccgaggagcttatccagcagctcacggcgagggtggcagctcttgaagaaatagtgggcgaggaggagtatgagctgcggtactcgggcgaacagacggacgagcttttagacggcggtacagcggtgtttcgtgcaaagacagcggcgcagatagtaagtcttgtgaacaggctctacccactgtatatgcggtgggggtctttcacggtgaatatgaaggtcaacgccgacaacggctcacaatggacttacaatacacgcacaggcatgataccctcgggggtcactaaccctgcggtgtttatggtgtgcgactggggcaaaaagcacttcaagtcgcagagttttcaatacaaagtcgcaagcaacagcagggacatcgactgggaggcataccttgagcacacctcagaccagggcggcacatacgctttcaaggtgtactatctcatagtcggcaaaaatgcggaagggggaagtatagttggctagtttcacggaaaatctcggacttaaaaagcccgacaggtcggacaggttcagcatcgaggacttcaacggcaatatggatattatcgacactatacccgatatggcgagcggacagagccttgtgggagtgtcagtgggagaagcgtacggaaatataggtataacaggcatagcggaggcggtcgaagatgaaaatatatgagggcacagacggactgagagggctgataacaaagcttatcgaggtgtgggactttaaaaagatagtctatgagggcgatggtgcaacactcagcacgaatgatgttgtattcaatctgtgggtcactgatgaggtgtttctgcgtggtcaattcagcgacacgggaacaaacggctggattgacctgcgaacggaagatttgacttgtccatgtgttggaacttatagcaacatctctccaaaaaggcgttgggtcatatacaaacaggacggcttggcagccataggcattgacggcaatcagaatgaccgcccaggcattaacatcgttatcggcgaggtaacagactatgaaacgcaggaaaaaagctacggcttggcaacaagctgtgcagacaacaacatacggttatgttctgtatttactgacggaatgacgataaagtctgtgcctgccagacctgtgtgtcggcgtaagtggctgacctctttcacacctgtgacatcgtcgactttgaacaaaggctttacaaacctttatcacattctttcacacacatcggggcagaatgacagcgactactatcctgattatgcagttcccacgcaaacagtgctgctcaacggcaagaaatatctgttaagcagatttgcttttgagataaaggagtgagcaagatatgaaacagaaatttgcaaagcttatagacgtcaagtctatcgtgacgatattgttgacagcggtgttttgcgtgctggcactgcgccgcacgatttcagcagagcagttcatcacggtgtttactgtggtgatatcgttctatttcggcacgcagtatcagaaaaactataaaaataacaaggaggataattatcatggcagcgacaattaaaggcattgatgtttctatgtatcagacaaacgtagatttcgcaaaggtcaaagcggcgggctacagttttgttattatcagatgcaataactgggatcacacgaagaactgtgtagtaaaagacccgctttttgaaacgcattacaaaaatgcaaaggcagctgggcttgacgtcggtgcatattactatacatggcagacaacggtatccggtgcgaaacaggacgcagttctttgtctcgattacatcaagggcaaaacttttgaatacccaatttactttgatctggagtggcagaaagcttttgcacgcggtaaaacggtatgctccgacatggtaaaaactttttgcactgcgctggaggaagcaggctacttcgcaggtctgtatatcagccgcagtccgctccagacttacataacaaatgatgtcgcaagacgctatgcactgtggattgcagaatacaacagcaagtgcaactacggcggcacatacggtatgtggcagtacagttcaacgggcaaggtcagcggtgtttccgtgccggtagacatggattactgctatgtggattacccatctgtgataaaggctaaggggcttaacgggtttaaggctactaacacaagcacgtctaaggtacttgacagttcgggctttaagaaaggtgataaatccgatggagttcttgcactgaaacagctccttatgctggcagggtacaaacttgacaacaacggcacgttcggagacggtaccctaaaggcggtcaatgctctgttgaaaaagtggggctatactcagaacggtattgcggggactaaatttattaaaaagctgtctgcaacgataaagtaaaggagtagcttatggatacaaaagaaacatcatacagccaaatggtgacagtcactaggcttaattacaggagcgattgcaacttcaccgccggaacgatcgttggcgttctcgaagataatactccggtaaaagtcgctgatgatttttatgaatttcatcacggtcactactggagaaaaatcaagcttggtcgcaagcattattatgttgttgctgattggcttaaaaagatttaaaagtaacagctccgggcaatccgctcggagctgtatactatattaaaaggaggtcatatttatgaaaagtccaataccatggattggtggaaagagccagcttaaaagtaagatcatcaagtctttcccgcctactgaaagctacaacagatttatcgatgtattcggcggaggcgggtctatactttttgcaaaaggcaaacacgctgatctagagatctataatgacgccaacagtgatttggtcaactttttcagatgcttaaaatatcattctgatgagcttaaaaaggagataaaatactatttaaacagccgggaaatgttccttgactgccgtgagcgcatatctgtaaccggatttacagacattcagcgggctgctatgttctatgtgcttgtcaagacaggcttcggagcaagtctgagaacgttcggctgcaacaaaaagcggcttaacacagataatttcgcagatatcgaggcaagactggatggagtagtgatcgaaaacaaagattttgaggatcttatcaaggtatacgaccgtgagaaagctttattctactgcgaccctccataccacaagacagagcgacattacactgttaaatttaccgaggatgaccatgagcggctctgcagagttcttcaccagatcaagggcagatttgtactgtcgtacaacgatgacaagtatgtgagagacctgtataaagactacaatattcaggcggtcacccgcaataacagtctttcatcaggtgatttcaaagaggtaataatcacaaatttctagtattttttttagagaataaataacggatttcgttatttatgttgtaaaaaacataccggaggtaatcatgagagtaaaattaagggctttgcttaattccaggggcattactcaggctgaacttgcgcaggcgacaggcatcagaccgtccacaatctcacagctttgcaataacatcgctgtcggtttcaaattttcacatcttgagctgatttgcagatttttaaaatgcgatttaaatgacattttagagctgtaaaaaatacgtttcaaaaattctcgataattcaaaaaaagtgatgagtgtttcgttttgttgaaacatttcatcacttttttgcgttttgcttgtcagttttttggattttgcttgtcaaacatcagcaaatacgccaatcagaaataaaataacatttattaagcaaacatagtaaatatgattttctaactcattattgccatctatcaaaaaaatcctcctctaagttcaataatcttcttatttcattaattacaagttttgaccgtgttactgaaaaggtccgatatacatgaaaaagcagtagatatgccttgattgcctaattttaatactgaaataagcaatggaaacagtgtatagaactcagaatcttcagcctttttagtatctgcttcgactgcattctcgtaatctattttaaattgtatcacagcttcttcaattttgcaaccctcatcgtaaataaattccgaacaaattcctaaagttgcatcatttgtcattgcatttgagtaaaggctttctcttgcatcaagatttgacagaatatttcctgcggctttcattttaaccgatatctcgaaaggatttgtatcggtatcaatatttgaaaagttttcgacatctggcggaacgtcaacttcaaatatatactccgaatcaggcacgccaaaagtctggggattggttcggctgagagattttgtatttttatttcaccggtaaaaccgttatcccaatcgttggtaacattcagcgaaacaatatattcattttctgctttatcggttctttgtgaacagatttcaaaaacttttggaatttcaagaccttcgcctgtcacacagtaaccgaaattcacttcctgatcgggctgaatttcataattatatcctgagttttttataatatactgagtttcgctgctgtaagcaatgccgttccaaagtccgcttatctctccatgagcgtcgtatttcaaagcccagtttgatatagtttctgaacctatatttttgatttttatttcaatattctgattattgccccatgagcttttaatatcataataaacaacataaccattgcctatatagacagatgaattgttatcagcgacatctgctgccgaagcgtagaccggaacaattatgttgatggggacaataacagacatgaaaattgaaatgattcttcttttcaatttttccctcctaatatgtaaaatcttgttttcataggaatccgacgcacagttttccatgctgaaaaattatgatcagaaatccgattaccgctcctatggtaatgctttcttatatttttttagtcatcaaaattagaagaaagtgtttttttgcttgctgaataatgtccgacgatactttctccgggtttcagactgattgtttcagactcgccgtcttttaaaagagccggtaagaatctttgaatatttttcttgtccacatttccgttttcccacggaataatatcaattattccattaggataaacaacagtcatgtcgtttacattaaggaattctgagtatccgctcaaaaaaagccaaaaagccaatcctattggtttctctattttaagagataccaacaaaaacggcaggcttagagcataatatactcaaagtctgccgttttgtttgacgatgtttaattgttgagggttcagatcctttttacgaaaaaggatctacggttttacgcctgaaatttttaccctcaaaacgcaaaaaaagctcgtaaatacgagcttttcgaggtgtgcatctattttattgcacaagtatggctccccctgttggactcgaaccaacgacccttcggttaacagccgaatgctctaccgactgagctaaggaggaatatgactaaacagagaagaataatatcttctctgtttagtaaggtgtcggcagcaccctatcttaccgggacgttaccatccaagtattttcggcgaagaagagcttaactactgtgttttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgcctttctgtttatatacgcaaaaaagcggaggtgttgtcctccgcttgatgtagcttatcatacagatagaacgtgttaaatagcgggcgaacgctgttcgcccctacacacaaatgttacaatcagagctctaccttatagtcctctgagcctacaccctttacagtgtagtaagcaacgccctcttcaggcttgatgtatactgaaactgtctttggtgttctgtgaccctttgccttgtagtcagcctttgcagcagccactacagcttcaacatttatctctccgcctgcgaactgaacgaatacctcgtcctttatctcagcctcaactgctttctttacagtttccttctttgcctttgttgcctttgctgcggtctttactgccttttctgccgtcttgacagctttctttgctgtttcctttactgctgcgcctgtcttttcagcggcagactttacctcagccttgacttcctttacagcttcttctgccttcttgtcagcggtgatcttcttttcagccattgtaaaacctctcctttaaaagtgttactaattacttatccacagcctctttaagagccttgcctgccttgaatgcaggaaccttctttgcaggaacatggataggcttctttgttgcaggattgatagaatccttagctgcacgatctcttacctcaaatgcaccaaaacctacgatagataccttttcgccctttacaagtgcctctgtgatagtttctgttacagccgcaagtgcctgctctgcttcctttttagaatagccgcccttttctgctattgcggatatcagatcattttttgtcattttgaatctacctccgttataattttttacattgtttttatgctgttattataacgtatttgacccctcttgtcaattaatttgcccgattttgcgtgctttcttgcaatctttgtagctttacataaaaaagaggcacagtcgccgcttgatttttgtacttattcacacgttggaaacagtatttataatttagccataattaacttttaatcagcatcattatttttttataaacgcctatttttcgcgttctgtaaaaatcacccataaaatattcttacatatatttcatctcaaagttcattaaatatttacattcttttatatattctctcatgcaacataattcattttttcaatccgtatttttcataaaaagcctcaacatcgctgtcgcttttcacaagctcgggatacattatctcacgagtgttgcggttataaaatccgatagttttctcgcctgtgcaggtgcttgacattatttttatctccattcccctgcactcctccggaatgggcttgacagttttctttttgaaaattcccatggaaattccccctaatatttttttagacgtcttatataagcgaaagtgtagtcctcgcctttatcacgaagcattgtaagaagattctccaaaaggtctgatgtttcagggtggatggctcttgtcttttttgctcttaaaaagtacgcaagaggtgcaccgtcgtcgtatttgtctttcatatatatcttgcttgcggcaactctgtcgcaaaacatttctttcacatatttaaggggcattttcacaggggtcatcaacttagtccgcaggtcatagtccgtccaatattcaaagtgatgcttatttcttcccttgtggtgcatccagccgtaagaaaatccgtattcttcacgctctgcttcatggggcgaacgtgtgccttgataatatttacagcccttgagaaactcctccggggaatattttgaaaggtcatgcctcagaccctgccacaaaatgcctgccttatagcagttttttatcactccgtggcgatgtcttgtaatggtcttgaaatgctcccatgcctttatcaaaacgctcatctcctctgcatttcatcttgtgaccttattatactacttttgctttattatttcaacagcctgcggtcattttctgctgccgcagatatcaagcaggggacactcgctacagcgttctccccttgccttgcagtattcacgtccgaacagtacaagacggtgacagaaatcagaggatctctcagggggaagtatctttctcagatcctcttccacctttgcaggctctttattttttgtaagcccaagtctgccgcatatccttatacagtgggtatccgttaccaccgcaggcttatgaaaaacatctcccataacaagatttgccgtctttctgcctatgcctgcaagggtagtgagcttttctatggtatcaggtatctcaccgccaaagttatccattatctgtctgcacattgctacgatagagcgagcttttgttttatacagaccgcagggacgtattatctcctcgatatcagcaacatctgcgttagcaaaatcctcaatggtcttatatttttcaaaaagttctttcgtgacgatattcacccttgcgtctgtacactgtgcagaaagtctgcctgctatcataagctcgtggggctttttatagtcaagggagcatatgccctcggggtagacctgctccagcctttccactatcatttgtgcacgttctttctttgtcatcggtactgctcctttgtttataagtgctttattactttatattgtacacttttttgcaggattcgtcaaccaaaatttcatatcagggacgaaatttcagcggggtctgtgcgttatatcggcataaaaatgcgttttgtcatttttgcgggctgaaacagctttggtcacagcgcaatgatttgtcgacatttcgcggaaattttacacgaattatgaatttataatcgtgattttacttcacatttcaaaaaaagcctatgatttttatacaatttcaataaaattatgaaattttgcattttactacttgcaaattgcaaaatagtgtgctataataagtaggtgatgtgcggaatgagtaaaaaagccgtgcacaaattataatttataagatgggagttttaataatggctttgaacaatgcgtatcttgaaagcgtttatgagaaggttgagaagagaaatcccggcgaaaaggaattcctccaggcagtatatgaggtactggaaagcctcattcctgttgtagaaaagagacctgaccttgttgaggcaggtataatcgacagaatagttgagccagaaagacagatcattttccgtgttccttgggtagatgacaatggcaaggtacaggtaaacagaggtttcagagttcagttcaactctgctataggaccatacaagggcggtatcagacttcacccttcagtatgtgcatcagtaatcaagttcctcggcttcgagcagatcttcaagaacagccttacaggtcttcctatcggcggcggtaagggtggttcagacttcgatcctaagggcaagtctgacggagaggttatgagattctgccagagcttcatgacagagctttgcaagcatatcggtgctgacacagacgttccagcaggcgatatcggtacaggtgcaagagagatcggctatatgttcggtcagtacaagagaatcagaaacgagttcacaggcgttcttacaggtaagggcctttcatacggcggatcacttgcaagaacagaggctactggttatggtctttgctactacacatctgagatgatcaagtgcatgaagaatgaaacatttgcaggcaagacagttgttatctctggttctggtaacgttgctatctacgctacagagaaggctacagagctgggcggcaaggtagttgcactttctgactctaacggttatgtatacgatccaaacggcatcaaccttgatgttgttaagcagatcaaggaagttgagagaggcagaatcaaggagtatgtaaacagagtacagggtgctgagtaccacgagggctgcagcggcatttggactatcaagtgcgacatcgctctcccatgcgctacacagaacgagatcaacgaagagtcagctaaggctctcgtagctaacggtgtatttgctgttgctgagggtgctaatatgccttcaactccagaggctatcgctgtattccagaatgcaggtgttctctttggaccagctaaggctgctaacgcaggcggtgttgctacatcagctcttgagatgtcacagaacagcgagagactttcttggacattcgaggaagttgacgctaagctcaagaacatcatgacaaacatcttccacaactcatacaatgcagctaaggagtacggtcttgaaggcaacctcgttgcaggtgctaacatcgcaggtttcctgaaggtcgctgacgctatgaagtggcagggtatcgcttactaatataagcgtataaacaaagctatatacgaagcggacagtcaactgactgtccgttttttttatatcatgccagacttatgggaatattcccgtaggtctatttcacctgattttcttttattatcctgccacgctcaaaagcacaagcattctcaagcgttgtgcggcttatggcggctagggcttcttcggtgaaaaagccctgatgagaggtgacgataacgttaggaaaagacagaagccttgcggtcacggagctttctaggatatcctcctgtcggttttcaaagacgttctctgtttcttcctcataaacatcaagacccactccgtggaattttctgcttctgataccttttataaggtcttcggtattcacaagcgcacctcgggaggtatttacgaaaacaacattctctttcataagggagatagtttcagtattgataagatgatagcttgattctgtcagtgggcaatggagcgagataaggtcgctttctctcaggacttcgctaaggggataatatttcacgaagtcaaggtcagggttttgataaacgtcataagctataacacgcataccaaagccgtggcatatcctgcacattgccgcacctatcctgcctgtgcctattataccagcggtcttgccatggaaatcaagtcccataagaccattcaggctgaaattgttctctcttacctttatatagcccttgtgtattcttcttgtgactgcaagcgcaagcgccatggcgtgttctgccacggcttccggagaatacccaggcactctaagcactgttatgccgtatttatcggcggcttttatatcaacattattatagcctgcacatcgcataagaagaagctttacaccgtgttcatggagccgtctaagcactgagcctgttatcgttgagcttacaaaggcacacacgccctcacagccctcggcaagccttgctgtgtcttccgtcaagtcggcttcaaggtaaacgctttctatatcgggatagttttttcgctgcttttcaaatgaatctatatcatactgctttgcgtcatagaatattattttcatgaaaactcctccaaattttaaagtattccagtttacgcttgtattttttgcagctgtttataaaaatatacggtttttgccttaataagataaaattatcaaaggttgacaattgtgcataaataggatataatataggtatcggtatgtaaaaatatactttaaatatactttaaatgcctgttttctacagaaaggatatgatgccaatgtcacaattttcggaacttctcaaagaatacataaagaaaaaagatattactataaaagcccttgccgaaaaatgtggtatcgacagaacatatcttcataagatactcaaaggtgaaaggaaagtgccaagcgtagattttgtagaaaatataagcttgcagctcatgctttccacagaggataaaagcaggctcatggagctttataacatttctgagatgggggaagatgtctacaatcgccgtaagcaggtgtcaaagataatacacgatatggcaaacaccaacatggaagatcctgacgctctgactttcaagacagaagttgatattgactctgtgcctgagatatccatctacaccgacaaacgtgagcttagaaaaaacctgcaggtgcttatatgcagcgatgttcataacggttctgacattcaggtcatcgctcagccaacagagtttcttaccaatctgctgtccattgccgcagaaggcagcgagtctgccataaatcatctgttcttctttgacaacacctcaggtgaaaaaaacaccgcaaaatacaatctggatatttttccgttcatatgtcaccttgcgcaaaagcatgaaaaatatgaggctttttattattatgagggtgcgtcggcatatttcaactccacgaacatcatgccaaacataatgataacgaataattttctgatcagaacagacagcgattattgcgagggagttatatacagatctaagcctatggtagaattttatatgcggcagtttgaaaagttcaagacaaaatgtgcaaagcttctcgaccacgccgtggatattttggaatatgtttacttttggtacgatgacaacgcaaatttcatcggcgtagattttcagccatgcaccatgctttgtcttacagaggatatatacaacgcccatgcacttttgccagctgacgcaaagaaatttgtaaaagcaaagctcaccatgggcaagaaggctctttctgaacacaaatttgtaaatctgttcagtgaaaagggtcttgcagagtttatgacgacgggagagatttttgagcttccgagaaattcatatacttttcccactcttgcagaacgcaagataatgctacagataatgatatcgctttgtgaaaacggcatggcagactacaggataataaagaacgactattttgcggtgtcgaaaaatctttgtatcaacatttctgacaacacaagtcttaacatcattgccagaaacaactgcttctctgatttttcttatttgaagataagcgaaacgagccttgttcaggctttctgggattattttcagcactttatagattctgacgctgtttgctcacatgaagaaactatcgagatactcaggtcttatttgtaaaaaatgggcgaccaaaagccgcccactgtaatgatattatttaagctgttcacgcattaaagtgagcagctttttttcacgtcttgacacctgcacctgcgacataccaagttgttttgccgtttccatctgagttttattctgaaaatatctcaggtatataagctttctatcctccgcttcaagggaagctatgacctgacggagagagagcctgtcagcaatttctatgtcaggagcatcaacagggatatctatttgtccgtggcggtcgtcttcatctgagctttcagtaagactaacagggggcagggcgacgttcatggctagagtaacggcttcttcgctttctcctgacagctcacaaagctcgcttactgtaggttctctcccctgctgtatggaaaatcgctcacgttctcttacaaggcgcatggaaagctcttttatgcttcgtgacacttttatcgtgccaccgtcacggaaaagcctttttatctcccctaatatcactggcactgcataggtggagaatttcacaccacggtcgctgtcaaaggctttcgcagcttttacaagacctatacagcctgcaccgtagaggtcgtcatactctatgccacggttgcggaagcggtttgcgcacaggtgaacaagccccagattttcttctgcaagaggggtctcgactatgctgctcattttatactctttctttcaaggttttttcaaggataagggtagttccttctccaagcttgctgcgcaccttcactttatccataaagctttccatgaccgcaaagccaaggcctgctctttcctcctcaggtgcagtggtgaaaagcggctgcatagcctgctctatatcggcgataccgcagcccttatcccttatttttatgtagacgtgtctgttctcgaatatccttatctgcatgaatatctcccctagggtgtttcggtatccgtggacaatggcgtttgtgactccctctgacactgcggtcttgacatctgcaagctcgtcgatctgagggtcaagctgagtaaggaaaccgctgactgcaactctagcaaagcgctcattttcagaatagctgggaaaactgactttcatttcattaaggggttttcgtttcaattttatcactctcctttgttttgtcatcggggctttcattctgttcctgagctgctttcttctcttgtatatacggggcaatatccgtgactatctttgtgagtctgtgcatacctgcaagctgcaagacctttcggatataagcaggaggcgacgccactatcacctcgccacccatttctgacattatcctgtatctgcccataacaagtccgatgcctgagctatccataaaagtcacctgagaatagtcgaggataagggtaagagggttatggcttctaatggctttatctatctctcccctgaaatatttcgctgtatggtggtcgatatcgccgcatatctctgccacaagagttctggctgacggatagttttttatctccacattcatgctttatcagtcctttcacttttttgttttatccgctgaaaatatattatcacttacagtgggatttttttgtcgcattattgtatgaatggaaaaagggcataaaaaaacaggaacacacattagtgtgtccctgcctaagaaaattattatgttctatgcttatgtattaaagtccgttaggattattcttaatgaagttccagctatctgctgtcatttcatcaagaccatattgtgcttcccagccaaagaccttctttgcctttgctgtatcagcatagcaggttgcgaggtcgcctgcacgtcttggctttactacatatgggagcttctttccgcaggctttttcaaagctgtgaagaacgtcataaacgcttgaaccttttcctgtgccgaggtttacggcttcaacacccttgttttccattacatacttgactgcacaaaggtgacccttagcaaggtcaacaacgtggatataatctcttacacctgttccgtcaggagtatcgtaatcgtcgccaaacacaccaagcttttcaagctttcctactgctacctgacagatgtaaggaagcagattgtttggtataccgttagggtcttcgccgataagaccgctcttatgtgcgccgatagggttgaagtatctcaggagtgaaactgaccaatcgttgtcggaaacataaacatctctcagtatctgctctatcattacctttgtatagccataagggtttgttgctgatgtaggcatatcctccgtatatggagctttgtttacagggccgtaaactgttgcggaagatgagaaaactatcttcttacagccgtattttctcattgccttgataagcatgagagtgcctgtgatgttgttgtggtaatattcaacaggcttctgaacagattcgccaaccgctttaagacctgcaaaatgtataacagcgtctatcttattctcttcaaatatcttttcgagcgctgcaaggtcaagaagatctgcctcataaaaagcaaagtccttgcctgttatcttctttattctgttaagagcctcaggctttgagtttgaaaagttatcaactataactacttcatagcctgcttcaagaagctcaacgcaggtgtggcttccgataaatcctgctccgcctgtaacgagtatttttgccatattctttacctcccaaatatgtcaagttttttcttacacttacattataccatattttcacgtttttgcaataccatttttgtttcaaacacatggatttttgttgcaaatagaataaaaatatgctatcatatctataacagaccatctcacagaaaggaacacacagaatgaatacagaccgtcattcctttaaatcagaccagacggacgcactttcgctgtcagtatacaacgtgggctatgaaaaatgtcaggggcttcacagttggggaagcggtgttcgtgaccattatcttatccaccacatcataagtggcaagggcgtatacaaaacaccgcagggagagtatcaccttagcgcaggggacacttttctcatttacccctacactgttataacatacactgccgacaagaacgacccatgggaatactactgggcaggcttcaacggctctgacgctgaatttatccttgatcgtgcaggcttcacaagagagtgtcccgttatctccgcagactttggaagcgagcttaaagacagtcttgaacgcatttatcgtcttagtggaaacagaagctcagatcttgtgaaaatgacaggtcagctttacatcacgctgggcattcttatggaacgctctggaagtcaaagccgttcggggagcaccgcaaagggatatgtcacaaaggcgaaaaactacatcgcacacaactacacccttgggataggggtcgagaatgccaccgatttcgttggcgtgagccgtgccacgctatatcgggctttcatggaatacgaggggatttctcctgcacagtatataactgatttccgtgtgaacgccgcctgccgtttgctggaagaaactgagcttcctgtgtcggctgtggcaaggtcggtagggtataatgacagcctttatttttcaaggatattccacaagacaaagggtgtgtcacctacggaatacagggctgacgctttgtgtacaaaaggtgaaaacaaggcgttttcggttgacaagggtatataaatgagatataataaataggtataatcagctacgaaagggtcttaaacaatgaatttctttatggtcggctcgtttttcatgcttttcatgctaaacgcaggctggacttctaattacgttataaagcttgtaggctttttatttttcgcagtgggaacggctgaggctgaagaacgcactgacgctttcgcacatcttaaaaagcctgcttacacttcttccgctatgtgcgctcttgcggtggtatgtcagcttctattgaaacttctctcccctgcggcaatggcggcgaacgttataagcattttgctgtcggcggcaactgtctatatgtcactgaaccttatgagaatgttccttgtggcgcttgacagccacagagagcttgtggaagacgtttcaaacattgtaaggcttcagggcagtttcaacaagcttgctcttatgacgtttatttactttgggggcgacctgctcaacaggctaataccaatagagttcgtcaccacccttgcaggcgttattgcggcaatagcaaagatacttgtgtatattttcctgctcatcatgctttacaacttcaacaagctgaggacagattatgaaaaacgccgtgaaagagaaaacaaataaggatatttcaagaacgtcatgttcacaaatggcgttctgttttgtgtataaaggcaacaaagaataggagaacgaaaaatgctatcaataataataccaagctataacgaggagggcaacgttgcaaaatgtgcttctgttgtttcaaagcttctcagcgaaaacggtatagactatgagcttgtttttgtaaacgacggctcaaaggacagaacatgggatataatctcaaaccttgcacgcaatgacgagcatatcgtgggcgtgaatttttcaaggaatttcggcaaggagagcgcaattttcgcaggacttgaaactgcaaagggcgacgcttgcgttctgctggactgtgatttgcagttcccgcctgaggtcataatcgagatgtacaacatctggaaaaacaatgacgttgacattgttgagggcagaaaaaattcccgtggaaaagaaaaccctgtatacaagttcttttcactgtggttttacaagatgataaacaagtcaagcggacttgacatggaagcggcttccgatttcaagcttcttgacagggctgtggtagattcactgaatgcaatgcctgaaagactgacgtttttcagagcaatgtcaagctgggtaggctacaagacggagcgtgtatattttgacgttgctgacagagagataggcgaatcaaagtggtctgtaaaggggcttttcaaattcgccataaacagcataacctcttttacctctgcgcctttgcagatagtgacagtatgcggtgttataaccttcatattctcagtgatattaggacttcatacccttatcaaaaagcttatcggtgcgtcggcggtaggattttcaactgtcataatcctacagcttctcacatcgagtataataatgttcagtcttggaataataggcttttatctctccaagatatacgaggagataaaacagcgacctagatacataatccgtgatatcataagaaaagacgacgaggagaaaaagaatggaaaagactaaaacatctcccctttcatttataaaaaaatggtgctatgataagcggctgtactttttggtgttttttctgcctgtggcaataatgttttctgcctatgcgtttttcaagatacaccctatcggcgacagctcggtgcttgtgcttgatttgaacggtcagtatgtttactactacgagcagttccgtgacgctttccatggcaacggcagttttatctacaactggtcacgaaacctcagcggagaaatgttcggtgtgtttgcatattatcttgcaagcccttttatgctgatacttgtgctgctgccgagaacgatgatggcgacctctatccttattttacagcttgcaaaaataggcacggcggctgtgacgttcatgttcttcttaaaaaagatatcagtgcagaagcctaagactatctcacttatcatattccctaccatgtatgctcttatgtcatacatggtggtacagcttatggaccctatgtggcttgacggacttatctatctgccgcttatatgctggggcgttcacaggctcgttgatgagggcaagcttgtgccttatatagtgccgctggcgcttatgttcattgcacatttctacatcggctatatggtgggaattttcacgtttttctacttctgctggtactgcctttcaagagagggcaggatattgccaaaaaagttcttctcacgctgtgtggctttcggtatcggcacgcttgttgcgcttatgtgtgcggcgttcgttcttataaccgtttacaattctttgaagcttggcaagtttgagttcactgaccctgatttctcacttgcaacacaatttgatttccttacgttcataacaaagcttttcccaatgtcatatgacactgtttaccctgagggtatgcctatgatatactgcggaacggctgtattgatacttgttccgctgttctttatgaacgacaggataacaatgaaagaaaagacctctacaggtctgctcactttcctgcttgtaatactaatgtatataaagcctgccgacatggcaatgcacggctttcaagtgccgaactggctgccttacagatattctttcatattctcatttctgatgatagtaatggcattcagggcgtttgaaaacctcgagggcataactgcaaagaacatcggtggaattttctttggacttatggtattcctcttttggtgtgagcgtgagaactactctcacttccagctttttgaaacaaagacaagtgaaacaggcgacaccacaaatgtgatacagggcatatgggtatccatgatagcactggcggcatattttgcacttatctatcttatcaagaaatatccaaaatcaaaggctgtttgtatcgtaatggtaggcgttcttgcggttgagctttttgcaaacagcgctgacactatcgacaagatagacactgacgttgcatacagcaaatacacctcttatgaaccttacatgacgcagacgagaaacgctgtgtcaatgatgaaggaatatgacccgtcgcttttctaccgcatggaggcaactttccacagaactgtaaacgaccctatcggaacaggctacaaaggcatttcacattcaagctcaacgatgaacgcacctgcccttatgatgctccacaagcttggctatgcttacggcggacactacacaaaatatgacggcacaacgttcatgacggacgctctgtttgacataaaatatcttatggacaaaacgggcaacacctcttttgtaggcacaagagttaaagtccctgaggaatacaagctcacaacagaatacactgagggcgacgcaacatataaattctacaacaaccctaacgctcttggtcttggcatggtatcttcgcctggtattgaggacgtgtcactttctgaagataatccttttgaaaatcagaacatggtattcaacgccctcgcaggcacaacaaaggaatatttcacaaagatacctgttataaacagcgaaatggagaacgtttctacatctcagctcactgacggacacacgaaatacttccctacagacacttcaattgcagaatgtcacattgactatgttgtgaaaatggataaagactcatatctttatatgtatcttccaaccaaatatgagcgttcctgcaacgtgtggatacaggacgaggacgattatatagacggctctgagcctatggaatatgcaggtcagttctttgtgggcgacaattattccattatgaatctcggcaaattctatgaggggcaggagcttcgcatacgcataacggtggcaaatgacgataacgaagcttactggaaagaccagcttttctacacctttgattatgacagctttgcacagacctgcgctgatatgcagaaaaatgtgcttgaggtcacaagctttaaggacacttatcttgagggcactgttaatgctgaaaatgacggctctgtactgttcacgaccataccatacgaaaacggctggactatcactgtgaacggcaaaaaggtgacagctgaaaaatctcttgacagccttataactatccctttggagcagggtgaaaacaagataacaatgaagttctcacctgattattggaaggtatctcttatcataacgggctttggtgttgccctgttggtgcttatattcctgtttgaatataagcgtggaaaagtcatgaaaaaggtgcttgcaaaagctaactttacggctgagagcagtgagaaagccacaacccctgtgataaatgacacaactgatacaacggacgagccgctgaggatataccgacctgacaatgatgatgacgaaaagcttcggcacataaacgagatgatgaaaaatattctcggtgaggacgaggatagcggcaaaaacgataaatagcgacggaagctgcgaaaaaaatctattgacaaggcttttataaaatagtattataatagggacggaaattctatccgcccctattttttcggacagcggataaagacttcacaaatgaaaggactaatcaaaatggcaaaaaagatctacacaaagaagcttacatatgcaggaatgtccctgtgtctgctgagttttttcgcattcattctctcggcagcaggtgctcttgctgaccctgtgggaaagctcgtttacaacaacgttttcacaaacaagatagactttttgttcacccccgacattttcgcttatgtgaacacctatggtctttcatgcgcactcgccatattcagccttgtggcgtttttcacatctgcaagagcaaagggcaagaaaaagcttgacggtgcattcgcaggctttcttatccttttcccgtttgttgtgatgataacaaagggcataatgatatactatgttacggtaaaaggtcacttctcaaacgctataacaatgggctatgacaatgacaagttcagggtagccctttcacttgctgatgatgttctgccatttattgcggctttcctgctttttatcggtggacttgttattgcaggcagacttatgggcgaagatttcgccgttgagatacctgttgccgcaaagacgcctgacaaggcccctgcgcctatcccaatgactacaccgcaagaacagagttttgctcagcctgatatgtcacagttcagaaagcccgacaatgccgagcctgttatgtcacagagcgtagttgagcctgagataccacaacagacagagcctatagaaccacctacagaaacggctgaacagcctgtggagcagaccgcacctgaaaaatgtcctcactgtggctcagagctgaagagcggagccaaattttgcagcgtttgcggaaacaaggtctaaaaagctacaccaatacacttccataaaaaacacggcatatgccactttttcggtgacatatgccgtgtttaatttttactgttctgatacgctggggcttacaagaccatgctttactcggtcacggacctccgctctctttgcgtcgttaaatctgtcgagagttccaacaagatagcctgttattcttcttatacgctgaaaaggcacgtctgcaaagtgataatcaacgtcaacaaagtcgccgtctattttaaggtcgatagtctggatagtcttttcagggtaaagcttctgcgccctgtcaatatatgaatttatctctgcctgggacatctccccgcctgttacgttcacatttaccattttacattacctccatttttctttgttatacatattgttgccacaataaaaggataccacaatatcttgtatttgtcaatagttaatacctacaaagcacatgagtatattttgtagggtatgactgcatagtcagcctttcatttcttctcttatacctcgccaatcgggacagaacttgcccaccaaagcccagaaatccttgctgtgatccataaagaccaagtggcaaagctcgtggaggcagacataatctatgcactctctgcggaaaacgataagctttgagtttatggaaatatgcctgtttgagatacatcttccccagcttgctgtcagcggttttattgtcaccttttcaggcacaagccctgtggaggcagacattttctgcatactttttgttatctccgccactgtgagatcgtttatgaacttggtggtctgctcttttacatagatctggtcgctggtcttgttcacggcgataagaagcttgccgtcctctatcttgggagaaaaatacttatcagcctgaacaagggtcagggtaagctcgtaccccaaaagtctgagcctttcgccatcacagaaatctttcggcagacccaccgccgccttgtctttttgctcctttatccagcccagattgttattaataaagctttcaagctgctgctttgaacagccgtaaggcacacgcactgtcaaagtgccgtcacgtatacccatattaaggcgacttcttttggcaacgtcaaggataaagtctatgcgctctccgtttttatcctcgataaaagtattatatttcggcacttcaaagcccccatatccaaaagcgccgcacattcttttgtgcggcgccgtattttttaccactgtactgctatagagctgtctgttgtaagataatccttataaatatatcctgtgagtggaccgtctatgttcatgaaatttatcttcacatatccgttatcctcatattcaagaacgtttacctgaacgcccggtgacatacaaacgatattctcagcgtcattatcaggtgccacatgaagataagcatactctgtgacatacattacttcaagcacatctgtctggctagactcgtcgctggacacatctgttaccgcaccgctttcgtccacactgctgttatcagtaacggacgtatccgcaggggcggtgctgttcactggctcagccacagactcatttgtatttatggtggcagtatttataccctttggcacttctgaactattgcttgcaaaaagccccttggcaagcagaagtatcacgcacagcacaaatatgcccacaactattattgcgacaacgctcgccgtatttcccgaagccttgcgggaaacgttattcttgttattatccatatattgcacggcacaagccgtcacatttcgcctccttttgcaggaacacacctgcacacctgcaaacaaagcacaggtacataaacatattataatattttttatcatcaatgtcaatgacagtttaattacaatattgtcacatttcactctttaagccctcttcttgagatatttgccatatttacaccgatattttgacattatagccaaataggcgtttgctaatttgattaaaatacatattaacagaatcaacaaaatgtgatataatgagatttaagggcgtgccttgggaggcgttgcccttatagtataaaagcaaggggggcaggaagttgcataaaaaaattatctgcggtgcattgtctgctgcaatgttcctgacccttttttcagcctgcggtcgatctgaagagagcgtggtcaatactaaaaactcctcgtttatcgaacaagaggaagtcgttgacagccctgcaaagatatttttctcagcatggaacggcagtgagataaccgctgacacagctaaagagcatggtatgcttttcatggactcttcagaagaaagcgatatgcgctgggctgagttctgcgagtgcgtaaaaagcggcactgaggctgagataacagtatgcacaagcacgcaggtgatacatgctgaaagctctttggagggggacagcggagttcttaccatagaatctgaggacttttctgagggcagcatgaagcttttctcaaaaaagctttctgccgacagcctttacagcgtttgtgaaaacggcttgacggtatattacgcaggaagcaacaagctttatcagacagagaatgtaacaagtgagcttacagacgttccttttgagcagaagatatacaagtgcagcagtgaagccaacatgacattcccatatcaaaaaatgttttcaaattatgatgatttcagtgaatattatttgaaatacaatggtgagctgcaaattcaggaaatgaaaaaggatatggaagcttttgaaaacgaaggcggcttcaacaaccatgttatttttctaaaaggagagctttcgggatatgagcatatcgactacaaagcagtaagggcggtcaaggacaaggattcccttttcatatatgtggctaaagagatacccgagaacaaggcaggggcgacttcaaaacgtcagataactgtcacagtgccgtcagagtatcttgacgagataagccccaaaaacataaaatggatagttttcacacaagagtgacaaaaggcggacaaggtgtctgcctttttttattctgaaagttgacagataaaagcattagtattataataaggtcaacacctcataaggagatatttatatgaagcttttttaccctgagatatttgatgaatttgtctgcacaggctcgcagtgttctgacaactgctgtatgaccgattgggatatcgagatagacgaggacacctacggcttttacgaaaagcttgacaatgatataggcaggaagtttgtgaactcagttacggaagacgagggcgtgaaatatcttgtccactgtgacggcaaatgccctatgctcaacgaaaaggggctttgctctgttcagcttgcttacggtgaggaaaacatctcagacatatgccgtgaacacccgaggttttacgagtggtttggagattacaaggaggcaggcgtgggacttgcctgcgaagaagctgtgagaatgtatctttctgacgatgagcctgtgagattttttaccaaagagatagatgaagagcctgacgaccttgagttcgatcccaagcttcttgaaaccatgctttttgcacggacggctttcattgacctgcttcaaaacagggaatattctctccatgacaggcttgtgaacgttctttcagcgtcagcggagatacaatatgctcttgacgaagaggatacagaggagataaaagccattgcccaggagctttcccaccctgagataattgcagagcgtgtggagagtttgaaaaaggctttgcctgaaaagcctttggaaaatgccgaaaatatgcttttatatcttgaacgtcttgactttataggcgacattctcccacagcagataaaggacgcaagccgctttgtgaaaaagctttccgcatccttaaaggctcagacgagcggtgagtacgaaaagcttgcggtgtattttgtatacagatattttcttaaagctgtgagagatttcgacctgctgtcaaaaataaaggctatgatagtgttcgtttttgccgcagaggtcataaacctcagtcgtgagcaggacgctcccgcacgctttgaaaccgtcaaggagctttgcaaggagatagaatactcaggtgacaacatggacaggatatatgacgacagctatctttccgatattttctccgatatttctatgcttgcacttcttgaatggacgctttagagaagaagataaccaagcgccagaagaagctttatgtctgcgccctgcttgtataatatgtaaataagcagaccgataagggctttttcctcgtctatctttatatcgcctaaattccccccaagcagaccgctcaaaaacgaactgctctgaggggctttttgtgggctatgagcattctgagtgcgaggggtttcctctgctttaggtggtgcaggctcgttattagggcttgcgcccacaatgcttcgtgaacgcctttgcatttctctcacacggcgaatggcttcctcctgcatggtggtgaaattattgtcatcagaataagccaagcagatcacctcccagaagtccgctttctttcagtgcgggatagaccgcaaaaagcttgaatatttttatgagcctgtctattttcgcctgattttcttctttcagcagaggtcgcagagcaagaagaagctggatatttttatcgggctttgaagctgactgcataatgctttgtatcttcataagctttgcaatatcaagaccccctgtctgtgtcgcttgcgcaggcttgctttccgcaggcggagaaacgccgcccaggctttggagaagctgagaaaagtccatgttctgtgggctttgtggagcttcgctctgaccgccctgttctccctgtccgccgttatccgccgtgagcatatccgcaagctcctttatctgtttcatgctttcctcgtcattaagcacattctgtattttgttcatcagatcgtccaattatttcaccgcctgttcaagcttttgccctgtaaaatactattttccctgaagctttttgaatatcgcccttgcctgtggtgaggacaatattttctcggcagttttcggatctgacaaagccttttgaagcatcatagcctcgttttgtggcataccctgaagcgccctgtcataaactccgctttcaagctgacctttcagcacatcaggagtagtgcctagctttcttgaagccactgcaagaagcgcctgcatggcttttggatccatagaattgaagctgttttttgcgctcataaaaaattctccttttttctatagtatttataaatatttatgttataatattgcttgttataactggtaaaggggtgtaactatgagaataatcgttttttcggatactcatggaaattattctgcaatgcacaaaatattcaagagaaacggcgacgccgacctgtttatttttcttggtgacggcgaacgtgaccttgacagcctgagagtgcagtatcttgacaaaaagatagtaaacgtatcaggaaactgcgactttgcctcgctcactcccgaaaatgacatatacatgaccgatgacggtataaagatatttttcacccatggccacaagtggggcgtgaaatactctaccgacagacttttttacaaagccaaggaaataggcgcacagatagcacttttcggacacacacactgccgctactacgcctatgaggagggtatccacattttaaaccccggcagtgcaggacagccgagagatggcaagcctgcaagctatgcctatatcgacattacaaaggacggtggcatattctgtagtcacgttgacctataatatgctcagagcttagatcttgttaaacaaaaagcggacgaacacctttcatgttcgcccgcatttttatgctaaaaaattattctgatatctcttttcttaccctttcaagctcatcaaggaacatctgatccgcatggctaaggcggtaattgctctgatagataagaacgtccttattggtctttttgaagctatgacaaactctctgcacaaggccataacgcttcaatatctcctttggcagaggacttacccacataaaagagtctggacaagccgagaggatatcgaactgacttcctctctcatagacgtaaatatgcctgctgtgattattaagctcagcgtttttcttctgataagtcgctgagatgttcggcacgatattatccccgtgcaatacctctatgtatttatcaaggacagtttcgtttatctctttttctttagcaagctgactgttttcgcttgtgataagtacataatcgaactcccacacgttatgatatttcagatttttctcttctatcatagacatgaaaaagctctcatatgccacagggtaacggattatacccatgttatattcgcattccaccactgcgtttatggcttccatggagtttgtttcccttatttttgcgtcaagctccacattcgtgcctaacttgttcacaaagcaagtgaaagcgtgggttatatagcttgctcttggcaaaagcagagagaagttcacagcgttttcaccattatccttataaaggctctccattttatccatttgcacaagtatagcctttgcatactgcaagaactgtttgcccttttctgtggcaacaacaccctttgcacttcttttaaaaatcggtatgccaacttctctttccatttcctttatggcttttgaaaggttaggctgacccatataaagtgctgaagctgcttttgtgatagacccaagtctttcgacctctaccatatatctgagatgagttaaattcatagtttccccttctttgttatcggtatataaaattttaaggctgtcatataatattatatatgctttctgtcaatttcattataaagctttgttaaaaacttgtcaaccgcagagagcgttttttaacatttatttaacataaagcgaaggcattcacctcttgacaatgcctttacactctgttataatcttatatgtttaaggcttacttctgccgccgggtagaagttttgcgtcggacctgctgtcgttaggctttaaaagacagcggtgttcggcgtttttttgtgggataaacggagggtaaaaatgaagaaaaattcacatcttagggactttgccagatacgcttctctgaacgttcttggaatgataggtgtatcgtgctatatccttgcggacacgttctttgtcgcaaagggcatgggtgcagacggtgttactgcactgaatatcgccattccaatatacagccttatccacggaacaggtcttatgatcggcatgggcggagcgacaaagtttgcaatatacaaaagtcagggacgtgacgaagcaggaagcagagttttcacctgtgcactgcttatggctctggtgattggagcgatatactttttgggcggagcgtttttctcaatgccacttgcaaagcttcttggtgcaaagggcagcgttgtgggcatgactaatacctacctaaaagtgcttatgatgttcggaccgttctttgtgcttaacgacactttcaactgctttataagaaatgacggaaacccaaagctttcaatggcggcaatgcttacaggaagcttttcaaacataatacttgactatgtgttcattttcccgctggatatgggcattttcggagctatccttgcaacagggctttcgcctgtcataagcctttgcatactgagcatatacaaattccgcaaaaagaacagcttccatatcgtcaggacaaggcacgaaggaagaacttttggcggcatattgtccataggcgtgcagtcgcttataactgagctttcatcaggcatcgtagtgcttgcgttcaatataataatacttggtcttgcaggcaacacaggcgttgcagcttatgcagtgatagcgaatacttccattgtggctgtatccatattcaccggtatcgcacaaggcggtcagccgcttatcagtgctgctcacggcattggcaacaaagaccgtcttagagcagtgctgagatattctgttatatcacagcttgtgattgcgcttatggtttaccttgctattgcatttttcacaacgcctatcgccgctatattcaacagcgagcatatcgactctcttcagcgcatggcagaggacggcatgaaaatatacttcaccggattgtttttctcaggcttcaatataataatatctgcattttttgcggcttctgaaaaaatcataccagcccagaccatcaccatattaaggggctttgctcttatcgtgccaatggctttcattatgtccaaggcagcaggattaactggcgtatggcttgcttatcctgtcacggaatttatcgtagcggcaatatccataatattctatataagaaacagacacaagacataaaacaaaacggcaaagtatcaggctttgccgttttatttttgcgtaaagcttgaaaaaagttgatttttatgctatcataaagaatagtgataaattttgcggaggtcaactgacaaatgataaacacaagcggcaacacgctgataatagatataagggacgagctttcttttgagtatggtcacattgacggagcagtgaacatccctgccgaaaagcttgataaaagcgacctgccaaaggacaaaaagcttcttatctgctgtaaaagcggacttataagcgacactgaggcagaaaagcttcgagagcttggctatgacgctgaaaacctagagggtggctactatggctggctgagagaaaagctttccaaagaggtcgtagaagatatctcacaggacgctgagcggagcatacaaaagaaattccgcaaggagatatggaacagattcacacaatctgtgaacgaatatgagcttataaagcctaatgacaggatagcggtgtgcatatcgggcggcaaggattcaatgctcatggcaaagctcatacaaatgcttcaccgccacagcaagttccctttcgaggtaaaatttcttgttatggatccgggctacagccctgcaaaccgtgagataatcgagcgcaacgcaaagcggcttggaatacccataacagtgtttgagtctgatatttttgactctgtatacaatgtggagaaaaatccatgctatctgtgcgcacgaatgagaagaggtcatttatacagcaaagcacaggagcttggctgtaacaagatcgcacttggacatcactatgatgatgttatcgagaccatacttatgtcaatgctttacggcggacagatacagacaatgatgccaaagctcaacagcacgaattttgagggtatgcagctcataaggccgctctatatggtcagagaggacgatatcaagcgctggcgtgactataacgggctgcgtttcatacagtgtgcctgcaagttcaccgacacctgcaccacctgcgcacctgacagcaggacagtatcaaagcgtatggagataaaacagcttattgcaaagctaaagcttgttaatccgcaggtagaatacaatattttcaagagtgtggagaatgttatgctcaatcaggtcattgcatacaaagacgacgagggcagacacagctttttggagagattcaaagaggaataaaaactcatcagccacaagcggtgaaacaggcgaacaaaggtcgcccctacaaaaaagtcatcgccgcaggcgataccttaattcctcattcctcacttatctataaggtggcataataatgatatttctatttcttctgcccttttatctgggcgtatcatcatacatgatgttccgatttttctactggatgaagcactgcaaccacagatttaactggctgcgtttcaaagtgccttttgcagtggtctatcttttcatggcgctttcgcctgttatagcttttctgcttccaaaatccgccgttgctatcgtcataaggcgaatttctacatactggataggcattatgctctactcactcttgtatgtggtgctttttgacctgctaagacttatcgcaaagcacacgaagctcaaaaacacgctgcttttttcccgtggaagcgttatttccataggttcggtggttgtggcttgtgcggtggcgacctgtctttacggcattttcaatgcacgaaacatcaaagtgaatgaatacagcgtaactgtcaacaagtcatgtggcagtgacaagcatttaaaagctgtgcttgtggctgacctgcacatgggttacgctatcggtgtggatcacatcaccaacatggttgagaaaataaaccagcaggacgctgacattgttataatagcaggagatatttttgacaacagctatgacggcatggacgatcccgaagggataaaggcacagctcaagtccataaagagcaaatacggtgtttatgcggtctatggcaaccacgatatagatgaaaaaattctcatggggtttacctttgactggggcggaaaacagctccacaacgagaaaatgacaaactttatgaaagagtgtaacataaagcttatcaatgatgagtctgttttgataaacgatgaattttatcttgtgggcaggcgtgacactgacaagcccggtactgaggacggcactcgtgcagagatatcagagcttacgaaggatcttgacaagaccaagccgatatttgtgctttcccacgagcctgacgagcttcaaaagaccgctgacgcaggtgcagacatagatttctcaggtcacacacatgacgggcagcttttcccaggcaatctgacaataggtcttttctgggaaaacccatgtggcatgataaagaaagataacatgtactccattgtcacctctggtgttggtgtatacggcactttcatgagggtaggaactgacgctgagatatgctctgtagatattgattttgcaggttaagttatatagtaaaaggtctgtcacttgattttggtgacagaccttttttatgctaaacaatatctttttcaaaaacggctttgatattcatatcatcattcaccttagcctttatctccgattgggtattatcgccctttacgccctcccaatggtcaaaatgccagcctgattttgcttgtgcgctcagttttatctcacagccgtcaaaatatgtgccgctataatcactttctatttcaacgccccctatcaaaacgcttccctgctcgttatccgctgatatattcaatgttctgcgctcataatagtcaaactctctttcaagatagccaagcactttatcatatcttccctcaataaaattctgccaacgtattatcatagggtctgtagctttcgcaaggtttgcccatgttggaaaacggtcgaaataattatcaagctcgccgtaatagatattcttataatattcgagatactccccgaaccgctccgcagtaaagttcacgcttccaagctgacacattgccgaggtgagcttcaaatcgaattcctcgttatctataaggctgcaaagtattccgccaaactttgtatagctttggcttctaagatacgagaacatatttgtttccagatccttctcgttataatgcgagcatgacgattccgtgtcgaaaagcacaaagcgccatctgccatctgcatagctattgccctgctctatggttcttgtgcgccagcaagcatagttgttctgcggccaatcgtcattgaagatatacatttccgtggcggcatactccacaaggttatccatatctatcattgcgcaggctttgcgataattctcctcaatggacatatcgttttctgtgataaacttatacatatcattgaaaagcttttcgtcctcagcctcaccctcgctcagctcatcatttttatacatgacaacgttgctttttgcaacattatatctatccgcaaaatatctgtcgctgtaatccgactgcaaggtataaagtccccagtattcaccgtctataaacagcacgcaggctgttccctgctgagtttcaacacctctgcctgacaccatattttgtatcatcatgtccttgaactttgaataattggcgtcatttccgccgtttctaagcacaaaggtcttgcaggaggtgatagcctcgccgtttacatctttaaagctatcccagaaagctgtatcaaaagagcttttgccataatcgtttcgagcataaagcctgaacgacttttgataatccgccctggaccagccgccttgtatccttatgccgcaatcctgagaaataaggctgttgccctcgctgtcgaaatactcaacataacattccttttcccactctctgccacgctgattatagtttgcagggatagatccgttcaaagggtggtcggggttttcttcgtcatattctttgtatacgtcaccaagacagtaaatgcccgttttttcattgaaaagcccgtcaggatcggtggtaattgatactataggcagatcgttatgatctgcacttgaaacgtccacaaaataagtggcagtaacagtttttccacactttccgcttgtgccctctgcacaggctcttatgacagtgcctttatcaactgcgcttttgtcaggcagttttatgctgtcacgatagtcaagctgtatcttcatagggtcataagccgaaaggacattttcatcatctgacctgtcgtcaattctcagggcattttcatagacctttcttgtgtccgacgtggcagggtcggtgccgtcggtggtataatacaccgtctgactctctcctgcggttatctcaaggtcaaaagccttttcatagctacctgccgcctgagaaaacacaggtgtatctccgatagttttctctgcattcgccgtaagaggtgtaggctctgaaacgtacatttcacccttgacatttttagaatagctcacgcccttgttaagcttaggcatttttatgctctcacactggaacgagtcatatttcaatattatctccgcttcgctgaccttgcctatgctgaaatcagcgtggggaaaatcagcattttcaaagcctgctgacgagcagtatactattatatagtcattggctttaatgacatatccgcccaaaggctgatctccaccgccattttttgaaagtgaaaatcccgtaagtgaaatatctttatttgtaggattatatatctctatccaatcgcttggttctccgtttttgtcctgcatagctgttttcttagatgtttcgctgtttgaggggcatatctcgcttatatatattttcggcggtcttattataactgcagcgagcattaccaccgctgccaccgccgcaagacaaaaccctatcatggaaaccctttttagtcccaatacaaaacctcctgctctgcaatattacagatatcattatagccttttttcacatttctgtcaaccaactgcaaaacacacaaaatccatggggattttctctgtggcttttactatttctacaatccttttaacttttacttgacaaacttttacggctgtgctttaatagagtagtagggtaaaatccccgtaaatacgaaaggaatggtacatatatgaagttaagaaaagttctggcacttgccgctgcagcggtaatggctgtggctgctcttgcgtcatgcggcgttaaggaggactcctcaaacgattcaaaggcaggcggctcatcagaaaagcactataagataggcattgtgcagataatggagcatacatctctcaacactatcagagatgctgttatcgacagacttgcagagcttggctatgttgacggcaaaaactgcactatcgacgctcagcaggctaacaatgagtcaacaactgttcagcagatactcgaccagttcaaagctgacggtgacgatatcatcatcgctatcacaacaccatgcgcacagctcgcagctccatactctgaggagatacctgtagtattctccgcagtaacagaccctatcggtgcaggtctttgtgactcgcttgaaagcacaggggcaaacatcacaggcacatctgacaagctcgctatcacaaagatacttgactttgcgcttgaaatgaagcctgaaataaaaactctcggttatctttacaacacaggcgaggacaactcagtttctacccttaaagaagtaaaggcttactgtgaggaaaagggcatcactgttatcgaaggcgctgcttcaaacacatctgaggtgcaggaagctgctcagaaccttgccgcaaagtgcgacgctgtattctcccctaacgacaacactattgcaggcgctatgggtacagttacagaagttatgaacaaggctaaagttccaatgttcgttggcgctgactcaatggtaatggacggcggtcttggcactgttggtatcgagtattccgaccttggtaaggaaactgcaaacatggcagctcagatactcagcggtgaaaagaaggcttccgagataccaataaaggtattcaacgaggacctcagcacttatatcaacaagacaactgctgacgctatcggtatcactattcctgacgatattgcaaacggagaaaagacagtttactttaattaaactattgcaaaatcaaagcaaacatagtataatagtagggagcgggactttcgctccctgctattttttattgaaaggaaaattatatgaaactgaataagaaaacagttatctcgcttataccgaaagctgtgcttttgatcttacttcttgtgataataaacactcagctcacggaaagcgttgttacgggaacatttgaaaagggtcttgttttttctatccttgcacttggaatattcatctcattcaggatacttgatatccctgacctgtcggtagacggaactttcacccttggcgttgcagtatcagttatgcaggctttcaacggcgaccctatcaagggcatactgctgtcaatagttgcaggagctatcgcaggaagcgtgacaggaatacttatcacaaaactcaacgttcagcctatacttgcgggaataatcacaatgacggctctttactccataaacctgaaaatcatggacagacctaatatttcactctataagaaagatactatatttacaatggcacagaaatatttcggcgactattacaaacttgcggcggcaggtatcgtgcttgttattgcggctgttctgcttttctggtttcttaaaactcaggcaggaatgtcacttagagccacaggcgacaacgaatacatggttagggcttcttcaataaactcagacagaatgaagataatgggctttgccattgcaaacgctttggtatccctttcaggcgcaatgtacgctcagtattcctcggcaggcgactcaaacagcggtacaggtatgctggtggtaggccttgcctctatcattatcggtgagatattcttcagcaagcactcgatcctctgcggaatacttgcggcgatattcggtgcgatagcatacagattcgttcttgcttttgcaatgaatctcggtatggacagcaactacacaaagcttttctcagcctgcatagttgcccttgctatctctctgcctgctatcaagaagtatatcacaaaggcatacaagcgtgtatgcagtgacaaataggaggtttaaaatgcttaagcttgaaaatataaacataaccttcaacaagaacactgccaacgagcgtaaggcgctccagcacatagaccttgatgtggctgacggagatttcgttactgtaataggttcaaacggtgcaggaaaatccacacttatgaacgttatcagtggcagctacgaggctgacaccggcaagatattccttgacggaaagaacatcactcacctaaaggagcatcaacgtgcaagaactataggcaggcttttccaagacccgctgagaggaactgcgccaaacatgaccatagaggaaaatctcggccttgcctacagtcgtggaaagcgtcgttcgctgactatcggtatcaggaaaaaggacgtttcagtgttcagagaaaggctcaaggagcttgacttaggtcttgaggacagaatgaaaatgcctgtgggcttgctctcaggcggacagcgacaggcgctcacattgcttatggcgactatcgttacaccaaaacttctgcttcttgacgaacacactgcggcacttgaccctaagaccgcagaaaaggtcatgaggataaccgaaaagatagtaaaagaaaacgcactgactactcttatgataacacacaacatttcaaatgccattgaatacggcaacaagactatcgtaatgagccaaggcaaactgcttcttactatcgagggcgagcagagagcaaacatgacggtggaaaagcttatgaagctttattccgacaccgccgaggacgaactttcagacaagatgatacttcaagaataatcagacatacaaaaagctgcggagggaaaactccgcagcttttacttttgttctttcacataagactaaacatatgttatatctattcctgcgatctttgctctgccctttatgataaggatcttttctttttcatcataagctccgttaggctggtctattccgccaagaacgcagtcggcttccacctttatgccccagttcttcgggatataaagctccactccgccgcaaagcacatcaacattcagctcgacttcgtttcctgccatatcggcagaatcaaagtacacctccataccgctgtaacggcagcttatgtcaactcttttcaacacctttgaggttatatactttgtgcagcctgaaaattttgcgtcgatacgcacatattccccgttgtctgaggacttatcccatgcaggattatcggtagtgtgggtggtccacttgctttgggtaaacctgtagcggtaagggaaaataaatgaaaatcccacgctgagaagcagtgccgcacccaaaacaggccatggggtgaacttctcgataccgagagtttcgtcaaagagtatcgccatgatagccatagggaagaatattccccagaagttaaggtgtctgacgctcgttacgataacaggaacgaggagcagtgagatcacaacgctccacacgcttacacttccaagcagacctgtgcggtcaaggataagcgcaacgcctgcaaggataaagaacaagccccatataagatttttgtttttcatagaaatctcctttctccaagtctgagcttcaaaagcttgtaatagcttcgtgaggcgtaaagctgtttgtgagtgcctgcaaagcttataaggcttgcagaggttatgtttcgctcaacggaatagatgtgctttacattcacgattgctgattttgacactctcacgaattttctcggaagtatctcttctagctcaaaaagtttcattttcacttgaaaaacgtcgtcagaggtatgtgcgttaagattatgttcccctgtttcaaaaaacagtatggaatcaaggggaggatagaactgaactgcgtctttgaaaaaagctatctcaggatcgccctctgccgactccgccgcccttttcattttaagcacacgttcatcgggctgggcgcaccttatgactatctcgtcttcagacatattctcgtctatctctatcctgaccttcacgctttcacccccgttttatctgacagccttattataatctatttttcttttcatgtaaaccccttttggctgacaggtgcagatttctatgcaagaggtaaattttatggtccaaaggggtgctgaccatgcagcacccccttgatttagttttttaccagtagcttgcctcgctgcctgtgccgttttgcatatatttgtatatgagttcaaaaagctcgctgttgtcaacattgttttgttccatataatccacaacgccctgagcggtaagaccgcttgcatagtcgctttttctaagcaccattgcaaactctgccgcagagcaagcctttgcaaaattctgtgacacagcctctgtatagtcagaacacataacagacttgtctataagcttgctttcgctcgcctccgggtctttatacctcactgaaactgtgagcatttctccgctgagctcgttggtttcagccttgctctcgttatcctgatatttcagcgacttttcattgccgttatttggcactatctcatacaaaaccgtgacctgctgacccgagccgatatcgcctgcgtcctttgtatcgtcctcaaagtcctcgtcattgagaagtctgttttcatagcccaccagcctgtatgctgaaacattttcgggattaaactctatctgcacctttgcgtcttttgcgacagtaaaaagagttccgctcatttctgttacaagcactctttttgcttcgtcaacgctgtcgatataagcatagtttccgttgccgttatcagcaagggcttcaagcctgttatccttatagtttcctgagccgaagccaagcactgagagatatatccctgagtcacgcttttgtgatataaggtcggtaagctcttcttcacttgacagaccaacgttcagatcgccgtcagttgcaaggataactctgttgttgccgccctctatgaaatactcctctgcaagcttgtaagctgtggtaattcctgccgcacctgctgtcgagccgcctgctgacaggctgttaagtgctgaaactatctcctcgctgttgtcgccactttcgccctcaagaacaacgctgtcgctgcctgcataagtgacgatagaaactctgtcatcagccccaaggttttcagcaagcattgagaaagcctgctgaacaagaggaagcttatcctcgtcctccattgagccgctcacgtctatgaggaaaacaaggtttgtaggaacgtccttgacctttgcttcccttgcctgaagccccaccagcataagctttgcttcactgttccaaggacaatcggaaagctcggtatttatagacaccgcaccctccgcaggcttttcatagtcatacttgaaatagtttatgaactcctctgttctcacagcgtcagggtcgacctcccagccgtcgtttatcattcttctcacgtttgtgtaggaagccgtgtcaacgtctgtggaaaaggtggaaagcggttcgtctgaaacaagcttatagccgttttcggtcagatggttatattcctcggtattgtaaccccctcctgtattcgccgtgccgtcagtatctccggctgtaacattgctgtatctgtagttttccgcagttgttctttcattgttatagctgccgctctttctgctctccgagccgtcataaccgcttccgcatgaagcaagcattgtcgccgtcatcataagcgacagagtcatggtcaagtttctttttatgctgtttgaagttgtctttttcatagctgtcatctcccgtaaaatagcgtgggcgatatgcccttgcgttgttagctacatagtcctccacttagcaagcaggtcttgcagatcgtttttcgaggaatatctcattcggtcatagaaataatcgttcttgcttttctgcgagtctttaagaatacccgaatcatcgtcaagacttttccagccgttttgaaaaacgatatccccgtcaagagaaatttctatctgaggtgcattttcaaaggccatagaataagtgctgttttctttcctcagtggtatgaaatattctctgttttcctgcatgatataaggggtagagctttcaatggtgatatttgtttcgctttcttcacctgtttttgatacaaggctgtttattctcagagtgtaatgtgcgctgtcgctgtcgagccttgctgaaagcactgtcacatctgcaaagaagtctgtatcttccagaacgctgtcctctgtgaaataatcatcgccctttggaatgtagctgtactcataagcctttgtgtctgtgtggctgaaactgagctgttcgtatgtcttttcttctctgttttcaagcctagccttgtcagccgtttctacgctatgctttgaaacactgtccgactctgagcggatatcggcgtaaaggcttacgccgccgataataagcacgagcgaggctgctgccgctgcaaattttctgtaatttctgcggcttacttttatctgtgtctgatctttgtccgttttgttttcaagctgtccctctatcctgtcccagagcttttccatgtcaggggcagtatcagaaatatgctttttgtaaagaaattttatgttcttagccatagatactgtcctcctttatggtcttttttagtttgaaaacagcctgacggtatttccatgtgacagtacccagcggcttccccactgcccgacttatctcacgaaatgtcatatccattccaagcctcatgttcaagatatccctttcgccctctgaaagcagcttcaaagcctcctcgaaggtgagctttccgatcacatcgtcgtctacccgcatactgtcctgctgttctttgtgccctacttcatcatcgtcaagggtcggcatttcgtgccgcctttttcttataaagtcaagagcgagatttttcgccattacagtcagatatcgcttatgccccgttccctttcggtactgacctgcggtgtcccatagctttaggaaaaaatctgatgtgaggtcctcagcgtcctgaggacttttcacaatgtcaagcatgatgttatatatcaccttgccgtagcattgatagatctccctaagcccgtttttgtcatttttcaggatcagctccaccctgaaatcgaactcagtgtcggtcaagtctttcacacccctcgataacttatatacgattctgcacgggagattttatggcaaaatagtatacaaattttacttttattttttgtgcattgataacaaacttatgtacaaacacgattgtgccgataagatattttagcacattaaagcatatctgtcaaataaaagaacacacccctgtccatatgaacgaggatgtgttcttcgtgtgaagatctatgagaaatcatttggagaggtcaatatttcttacagcgtcccttaccttaagaacaaaggtcggagaaactgaaagctcgtcaatgcccattctcaggaaggtttctgtgagagtagtgtcagccgcaagctcaccgcatatacctatccatgcgccgttcttgtgtgcattctctgcggacatctcaataagtctgagtatagcctcatggtgagtgtcgcagaactgctctatatcagggttctgtctgtcgcaagcaagggtatactgagtgaggtcattagtgccaacgctgaaaaagtccacaagctttgcaagcttatcgcttatgatagccgccgcaggggtctctatcatgatgccaagctcaacgctgtcagaaactgttataccctgttctttaagctcagccttgacttcaccacacatagcaagggctttttctacctctgaaacgcttgttatcatagggaacattatgcccagattgccgtatacggaagctctgaaaagcgctctgagctgagttttgaatatctcaggtcttgtaagacaaattcttattgctctgtatcccaaagctgggttttcctcttttttcaggccgaaataatccacctgcttgtcagcaccgatatcgagcgttcttatgatgacctttttccctgccatgctctcaagaacgcgcttataagcatgaaactgctgttcctctgtaggaaaatctgagttttcaagatagagaaactcgcttctgaaaagacctattcctcctgcgtcattgagaagcacagcaccgatgttgtcaacgcttccgatatttgcataaatgtttatctttttaccgtcctttgtgacattctccttgcctttgagggtctgcaaaaggcgctttttctcctcgtctgctttctgctttgcggtaagctctgcggttgtctgctcgtcagggtcaacgaatatctcccctgtaaagccgtcaacgatagcaaagtcgccgtcctttatttctgacagaaatttgcttcctacgcctattaccgcaggtatgttcatatttcttgcaaggatagctgtatgtgaatttgatgagccatgtgcagtaacgaaggcaagcaccttgtctttatcaagagatatagtttcgcttggtgcaagatcatcggcacaaactatcatcttgtcgtcacctgctgagccgtcgctgacattgcccgtgaggtttgcgatgatcctgttggaaatatcctttacatctgcggctcttgcctgcatataaggatcgtccatagaagcaaacatctccgcaaagttgtcggctgtcaccgccaccgcatactctgcgttgaccttctggctgtcgatgatattctctatagactcgttataatcatcatcttcaagcatcatcatgtgtatctcaaagatctgagcgtttgtttcgcccacctccctgagtgccttgtcataaatgctctggagctgttctgtggccgcctgcttagctttggcaactcgcttcttttctccctcgctgtcttctgtgtgaatacgttttatagcggtatcctgctttttgaatactgagatcttacccattgctaccgcaccgtaaacgccttttcctgtatacttagtcataaatatccgccccttttctcatagatcttattatttttcatgctttttccagccgatgggacgcccctgcgaacacaccgcagaaacgtcccgccggctggacggcttttaccgcccagctgacagataataattaaagtgtttcctcaaaaaatgccttgagtgcttcggaagccttgtcctcgtctgcaccctcgcaggtaacagtaacagtatcgccctgcttaacgccaagacccataagagccataagctttgtgatgttcacgctctttccgcccttttcgatagtgcaaacgctctcgaactcctttgctttctttgcaagaagtccagccggtcttgcatggataccaacttcgtctgtaatagtgtagttaaatgttttcatgatgaatacctccaaataattattttatcttcaagatcatatctcctgccgaaacgctgttttgtgcgacaggttcaacagacgcataatcgtccgtgttgcctattatcaaaggtgttgtcaccttatagcctgcggcttttatcttatccatatcaaagcttatgagcaggtcgcctttcttgacctcctgaccgtcactgacatgggcttcaaaatactgtccgccaagctttacagtgtcgataccgatatggagaagtatctccactccatcatccgataccatatttacggcatgctttgtgtcaaaaacgctgtctatttttccgtcgcatggagcgtaaagcttgccctctgacggctcaacggctgcgccctcgcctagtatcttttgtgagaacacctcgtcctcaacgtcctcaagcttaacggcagtgccgttcatgtgggagtaaagcgttattgtcttgccgttagtttctgtgttttctgcgccctcggtctgcggtttttcttctattttatcagaagctttctcagtgccgataatgctgtcagggtcatcgctgtatggcgagtcgataaagtcctcaagatctgattttataactgagaccttcggtccgtaaatgacctgaacgccgttgcccttgtggataacgcctgaagcaccgctggccttgagcatatcgtccatgacctttgaggcgtcatttactgtaactctaagtcttgttgcacagcagtcaacatctgaaaggttatctttacccccaagacctttgagtatcattgcgcttacaacgtctgaagctctcttgtctgtgctctttaccttcgccgccttagcctcgttcacgtcgcttctgcgataaagcttaggttcaacgtcatcaggctctctgccaggtgttttaagattcatctttgttatcataaagtagaacacaaagtagtaaacaactgcatagataagccccacaacaactatccatatccagtgggtctttgcgttgccctgcaaaattccgaaaagggtcatgtctataagaccgcctgagaacgtcattccaacgccaacgttaagaatgtgcataagcatataggaaagtcctgccaatacacaatgaacagcgtacataagaggagcaacaaacagaaatgtgaactccaaaggctctgttatacctgttatcattgaagtaagagccgctgacagaagcaagcttcctactacctttttcttttcaggacgagcagttttgtacattgcaaatgctgcagcaggaagaccaaatatcatgaacgggaattttcctgccataaatcttgttgccgatactgagaaaacttctgttgactttgaagcaagctctgcaaagaatatgttctgtgcgcctgctaccatgttgccgtctatcatcatcgaaccgccaagttctgtctgccagaaaggcatatagaaaacgtgatgaagtccgaacgggataagtgcacgttcaagtattccgtatatccatgtgcctgcatatcctgagttgagaacgagcacgccaagctttgagataccaagctgtactataggccacagatagaacattatgataccaacgataaggtatgtgacagttgaaacgataggaacaaatcttgttccgccgaagaatgagagcacctgcggaagttctgttttatagaacttgttgtgcagtgccgcaacgccaagtcctacaaggataccgccgaaaacgcccatttgcagcgtggtgataccaagcactgacgttgtggagttttctgccattgcctcaacgccgccctttgcggcgataagagcgctgatagtggtgttcattacgatataggcgatagcacccgaaagggctgcgacttctttttccttctttgccattccgatagcaacgcccattgcaaacagaagcgcaaggttatcgaaaacggcgcttcccgttttgctcattatgtcgaggatagtgtaaagcacaccgccctcatagatgaatttgccaaggtgataggtttcgatagttgtggcgttggtgaaagagctgcctattccaagaagcagacccgccaccggcagcagtgcgatagggagcatgaaagagcgtcccacacgctgcaatacgccgaaaattttatccttcataataataatatcctccaaaaaattatatctcagtcgaattatcattatggtaccgttaatgataataccgcagcgaatacattatatataagctgtggcaataatgcctatccgcttattttcttcagatggatcgaaagagttatcatttcatcttccgatatagttttagcataattcttcaaaatatgatcctgcatatgctttgcgcatttatactgctttttgaatttcttttttatgatatcagcgaactcctcgtccctgctgagaacattaggaagctcctgagatttgaagagccttttcgcaagatattttaaatgcacaagaaatctttcatatgccaccgagttcttgtttatcttccctgccagacaagcgtccgctatctcagcacagctgttcaccattttagtgatatcctgtatctgttccatttttgtgccgagccttgcgtttattatgtgcattgcgataaagcccgcttcatcacccctcagctcaacgcccaaacgctgatatatctccgccacgcaatatcttccaagagcaagctccttcgggaagcagtcgcttatggcgtccatgagaggattatcaaattcaagtccctgcttttttctttcaatggcaaatgagatgtggtctgaaagtgttattatgagcgactcgtttagctgtccgtcgatatgtgaagaaatatagtccacaagatctgccgtaagctttatatgctcatatggtatctcggtcaggcactcgataagtctttttctaagctctgagtctgtgacaagatacattttctgaatcttatccttatcaggctcgtcgccgtatttttttccgaagcctatccccttgcctgagattatctgctcttttcctttatcgtctatgacgcttacggtgttattatttatcaccttgattattttcattaaaaatccccctataaaataaaaaaaccaaccttaatacgaactcacacaatatgtccgtacaaagttggtcatgcccagtctataaatgaaaggtaacactccaataaaagatgttatgtatcaatttcactataattatattaacacacctgcatttatttgtcaacagcatacataaaatttgtttttcaaatctgtttttttaacaaataaacttattttgttttgtataaaacctacaattatcagcctgaaaagcacaaaaaagccgtggaaacactgctgttcccacggctttcggtatgttaagagagtatctgtatggctttattactttgtcataagatcgcaaacaaggtttgcaaactcaacagggttgtcgatagacattccctcgataagcaaagcctgatcgtaaagaagctttgcatagtctttcagcttgtccttatcgttagcatagaggtctttcagcttctcaaagatagggtgatttggatttatctccagtgccttttcagccttgaccttgttgccgtcattctgaggcatagcgttgaggaccttctccatttcgatagttatgctgccgtctgatgaaagacaaacagggtgagttttaagcttctttgaaagacggacagtctttaccttgtcagcgatagcttcctgcatgaaagtgaacatatccttgttctcttcgtcaagctttttagcctcttccttttcttcctctgtgtcaaggtcgagatcagcatcgcttatggacttgaaaggcttgccgtcatagtttatcatcaccttgatagcgaactcatcaacgtcctgtgtaaagtaaagaacttcatagcccttatccttgatcttttcaagctgagggagcatttcgatcctttcctttgtttcgccgcaagcatagtagatctctttctgatcttctttcattcttgaaacatactctttgagtgtaacgttcttgccgtcaaatgaggacgggaacataaggagatctttcagagtttcgtttgcagcgccgtatgactgataaataccaaacttgaactgaagcccgaatacgctgtagaacttctcatacttctcacggtcgtttttcagaagctttgcaagctcgttctttatggacttttcaaggttctttgcgattatcttgagctgtctgtcctgctgcaaaagctcacgggagatgttcagtgagaggtcctcagagtcaacaacgccctttacaaagctgaaccagtcaggaagcaggtctgcacatttttccattatcattacaccgcttgaataaagctggagtcccttttcatagtcctttgagtaatagtcaaaaggcgcacgggcagggatataaagcagtgcatcatatgttgcaacgccctcgttctttgaatggatatgtgcaacaggtggctcatagtcgccgaacttctccatatagaagttgttgtaatcctcgtcctttagctcgctcttgttcttcttccagataggggtcatgctgttaagagtttcgatagccttgtgtacctcaggctctttgccctcctcattataatgagtatgctcgacttccattctgatagggaatctgatgtagtcagaatatttctttacaagtgactgtatctgatactgatcaagatatgttgaatacttctcgtcatcagtatcgtccttgagtttaagtgtgatagttgtgccgacgccgtcaggcttgtcacactcttctattgtgtagccctcaacaccgtcagatgtccacttgtaagcctgatcgctgccaaaagcctttgttacaacggtaacttcctttgctaccataaaagtagaatagaagcctacaccgaactgaccgatgatatcaacatcgtctccaaggtcattgtctttcttaaaagcaaacgagcctgagtttgcgatagtaccaaggttgttttcaagatcttcctcagtcataccgatgccgttatcagaaactgtaagcgttctgttttccttgtcgatagcgatattgatagcgaagtcgctctttttcattcccacagaagtgtctgtcagggacttgaaatacagcttatcaatagcgtcgcttgcatttgagattatctctctgagaaaaatctccttatgagtgtagatcgaattgatcatcatatcaagcagtcttttggattctgccttaaattcttttgtctgcataaaatctcgacctttccttaataatattttactttctttgaatactgttccatataattagcactctatctatttgagtgctaattatattatacaacaaggttgataaaatgcaatagttatcacaaaatttctcttatttatttacaaatccataacatttcatcacatacctgacaaaataccatttgcaaaagcaccatgttgtgtgttataatatatagataagaccgaacaagggaggaataatatttgactaccaaaaagtctgtttctctgctgacccctgaaaaacagcaggaaaagaaacttcttactatagattgcgtgaaaatttcacttctgctcattttatacaacctgctaaacaggatattcgcagtgttattcttttacgttgcatacacttaccactcaggaaaattcactcttagctactcggcagttctcagctatctgaaaaagcagaccgcttttataagttcaactactttttccatgacggcaaatttgtttatcactcttatgagcgtgcttgtttttgggatagtttttgctatacttttccgaaaacgagaatcaagcttcataaagccgaaaaaaggcacggcagtaaaagggttaaaatggttttcagcctgctttgtgataaacattctgctgtcacagctcatatctatcctcacgggtatacttggtcaaaacggagtgacagttcccacaagcgatttttccattcatcagccctctgccattgcagtaatagtgcagttctcatacgttgtgataatagcccctatcgtggaggaatttatctaccgtggagcgatcctcacggctctaagcccatacggaaggggtgcggcggtgcttttctcagcgcttgcattcggacttatgcatggaaatattcctcaggcggcttcggcattcggcacaggacttgtttacgctattatcgccgcaaagtgcggctcgatactgccaacagttataatacactgtctaaacaatctgcttgcaaacttctcgtccatatctgatgcgataggacttgaacactatgaaacattcatgagcgttgctgagatagtcataggtctggtgggctttatggttcttttcacaagtcttaaaaagcttatcattgatgacagcgaaaacgtgcttacaccgaaagaatgtcgcagatacgtctttacaaaccctgccactatagtatatatgctctgccttatcataccgataataaagagtcttgtccaagcaaacagctaaaaatcacaaacaaaaaacgggtgactgccaataacaaattgacagccacccgatatttttttatccaaaaagcctattaataagccttgccccaaagcaccatatgctttgcaggctttccacagcatacgcagatatctgctatctcttcctgctcgaacgggatacatcttgaacctactcctgtgagttcctttaccttatcctcgcaagcttcgtcgccgcaccacattgccttaacaaagccgtcgcccttttcctcaagagcctttgttatctcgtcaagtgtcttgcaaacataggtacgtctttctctgttttcaagtgccttcgcataaagaccatcatgaacagcctggagtctttcattcactgtttcaacaagctcaccaagcttgcagaataccttttctctgttgtgtcttgtaacaagcacacactgatcgttctcaatatcctttggaccaatttcaagtcttacaggaacgcccttcatctcatactgtgcaaacttccagccaggtgactgttctgaatcgtcgagcttaactcttatgcctgcatttttaagtgtgttgtaaagctcgttagccttgtcaagaacgccctctttgtgctgtgctataggtacgataactacctgaacaggtgcaacagcaggtggcagaacaagtccgttatcgtcgccgtgtgtcattataactgcaccgataagtcttgtcgtaacgccccatgatgtctggaatgggtgtgcaagcttattatctcttccagtataagtgatatcgaaagcctttgcaaagccatcgccaaagtaatgcgaagtgcctgcctgcaaagccttgccgtcgtgcataagagcctcgatagcatatgttgcttctgcacctgcgaacttgtcgctctctgtctttctgccctttacgaccggcatagcaagctgctgctcgcagaaatcagcgtatacgttgagcattctctctgtctcctcgatagcctcctcaggtgtctcgtggatagtatgaccctcctgccacaggaactctcttgaacgaagaaatggtcttgttgttttttcccaacgtacaacagatacccactgattgtaaagcttaggaagatctctgtaggaatgaactatattagcataatgctcgcagaagagcgtttcagacgttggtcttacgcaaagtctgtcttcaagcttttcacttccgccgtatgttacccaagctacctcaggagcaaagccctcaacgtggtctttctccttctgaagcaggctctcagggataaacataggcatgcaaacattttcatgaccaagctccttgaactttgtgtcaagtatatgttggatattctcccatattgcgtagccgtaaggtcttattaccatacagccctttacgcttgtgtatgaaacaagctcagccttcatacatatatcagtataccactttgcgaaatcctcgtccatggaggttatcgcatcaaccattttcttatccttagccatttataaaacctctttcttatatcattcaggcattgtcattattcttgttgccgtcgtcttttttaacagcttcactgctgacattcttctttttctttttaaaattaagagcatagatatcctcgttatatatcttatagttgggatcccagccgtcaatgtgggacttatcaaatatgccctgtaccttatagttctcaggatcattccctgtattctcaccgtccaccctttcgggatcgtccttttcggcaagctcagggtgacgtttttcaataaatcgtgctatttttggagtgataaggcaggcaatgacaataaaggtcattattacgacacagcctgctgccagcttcaacagcaatagcagtaattctttattcagacaagtcacctcttttcgcaaacataaagttattatagcacaattattatccaaattcaagaggtgaaatatgaatttaccgccatttctgacctttagcacgaaaaaaggcggaacaaagtccgccttaaagcattttctttcgtttgaaaaagattatacacactatcactactattatactaagggctataacacccggatacccttctttaagttcgggcatattctgaaagttcatgccataccagcccgtgataagggtcagagggaaaaatatagtggatatgaccgtaagaaactccatattcttgttctgctgagcattgacatgggactgataagcgtctcgcacctgcgttgcatattcaagaagatgtacagttctgcccatgagcctgtcggcacggtctgagatagtgccgaaatattttttctgctttttctcaaagaagccgttctcgtcctcttcaagctctctgcccagatccattatttcatcatagtagcttctcaaaataagaagctcttttctgataggcgttatggtttcaagaaaatcgtccgtcttgccatcgtttacgttctcctcaagctccataagcttttgctcatgttccgcaagaagttcggtgtcacggagcataaattcgctgaaaaaattgtagataaaatgctccctgctctctccctgattatgcctgcttctctgtatgcgttgaactaacctgagtgaaaactcctcatcgtctattatcaccatgtttttgttgtcgataaaaaactgtatcctgtggcggcttccctttatgtcaataagcttggggatagaaagcgtgcctgccagacagaaaggctgtgattctatcttacagaacacaacgtcacgcagggatatcacgccctcgtaggttatgttcgccgttctgagggtttcctctgcgtgagcagagtcggtaataaacacagccgagcaagtttgctcgcttagctgtgccggtgttatttcttcaagtgaacccttcagggcaaatattgtcatttatcctcgacctccgcctttgaagctctttcataggcaaggtcatagaaaagttcctgagaattgagtggctcttttccgtctgaaacaagggtatattccccgtcagaatcaagctctcttgcctgacaattatctgcaagcattttgtcgaacatcatgcttatctgagacttgatatcctcgtcaagaataggtgtggcgacctcaacacgtctgagggtatttcttgtcataaagtctgcggaagcaatataaatctttctttcctcgcccttgccaaacatatagatacgggaatgttcaagaaaacgtcctacaatgcttattatcctgatgttgtcggtttcgccctcaacgcctgggataagacagcatatgcctcttaccacaaggtctatcttaacgcctgctcttgaagcttcgataaatctgtcgattatcttcttatcagtgagagaatttatcttcacgccaatatagccctctccccctgattgtgctatggctatctgctcgtctatcatatcaagcaccttgttttgcagacaattcggtgcaacaagaagcttgtcaacgctctttacagtatcgtcagaagcaagagcattgaacacgtctatagcgtcctttgcaatgtccttatcgcaggtcataacagacaggtcggtataaagtcttgaagttttctcgttgtagtttccagtgcctatctgagtataatactcggtctttgtgcctgaacgctttgtgataaggcaaagctttgaatgtaccttatagccctccagaccatagataacagtacagccagccttttcaagtcggcgtgaccactcgatattattttcctcatcaaatctcgccttaagctccaccaatacaagaacgtccttgccgttctctgcggcttcacaaagtgcttcgaccacctcactgtgctttgccacacgatacaatgtcatttttatagacaccacatttttatcgtcagccgcctcacggagcatattgataaaaggctttatgctatcaaaaggataagaaagcagtctgtctttcttttttatctgcggcaggatcggcttgttatcgtcaaaggcagtaaacctctgcggaactctctttttatagaaaagctcggttttctgtctgagtatatcctgtatctggaacaggaatgacagatcaagaggagtactgtttctgaaaacagattttttattcacttcaagctgtttgcagagcaggtcaacgatattgttatcaagctgccttgaaagctccagtctgacaggtgcaagacgttttcttttctttataaggtcagccatgaactcacggtaatcaagatcttcgtcgtaaagtgcgtcagcgtcaatatcagcatttcttgtaactcttataagtgactttgacttgacggtgtagcccttgaaaattttaggtacatagtggaggataagctcttcagaaagcatatacttgcctgttgaaccgacctttataaggcgtgggaagacctcgcttccgcaggagataacacccagcttctccttggaatttttgctttcaaggacaacagcggcatagatatccttatttttaaggaaagggaaaggctgtcttttgcccaccaccataggcgacaggagcggagctatctgattaataaaatactgttccaactgagaattttcctccgctgtaagcttggaaaaatcaacaagagcaacgccctgctcggctattttcttcataaggtcagcgtagatcttatttttacgctcgttaagctcgcccactctagcgataacggctttgagctgttccttagcggtcatatttgttttattttccctgctgtctggatcgacctccatctggtcagtaagcgagcctacacgaaccataaagaactcgtccagattgctctgatagatagaagcaaaagaaagtctttcacagagtggcacgcactcacgctcagcctcctcaaggactctttcattaaatttcagccatgacagctctctattcataaacacatttttcattgtgccatactccttttattatgatatcaaaacacctatacttatttaatatattatatcacaaaacggcaaactgttaaagagttttaagcaaaattcatgtaaaatattcttattttacacttcctatattgtagctgcacacaaaaattatgcaaaatgacgcatttgcttttttagcaaaagcataatactgtgcaaaaaggcaaaaatcaaaaaagtccaaactttttgcgcaaaaaaggttgacaacggggcataaatagtgtataataatcaagtcgctatgagaaacgcatatggcggtatagctcagttggctagagcacttggttcatacccagggtgtcaccggttcaaatccagttaccgctaccacatttctcatagcgaaaaatcggcccgttggtcaagaggttaagacgccgccctttcaaggcggaatcatgggttcaattcccgtacgggtcaccagatcacttccctgaaaataacgcatttgcgttgttttcagggatttatttttccctaaaatctcctcaaccacttatctgccacttattttgaaaataaccgctttcgactacctcttggctgtgttctatgtaccccgcaaggcttgcgccctgcggttgtttttatgccccgaaaacttgtccgaactgttcttcttcctgctcgtcctcatcttcgtaggtgccctctgtgctgtcctcggagtgcttttcttctttcactttaacctcgtttgtgaagcttagagcgttgcttatcgcatcgcagttgcgtgctctcgcctcttggaacatatgggaatataaatttaaggtcgttccaacaacgctatgtcccatatctgcggacaccgctacaacgtccacaccctcaaaaatcagtagcgaggcatggaggtgacgtagagagtgaatatttcggaacggtattccgatacgctcgcagtaaccctgaagccactcaaagggagtctgcggattcataggtgcgccgttccatttggtgaacagcctgtcgtgaccctcccattttgtaccgagctgtttcgcttccttggcctgctctgtcctgaactgctttagcagattcattatagacggcggaaactttgacacacgcttggactttcgcgtcttagtggtatcggtgtatatgcctttttcttttgtatactgagatgttctgcggacatggatcaggctgttctcaaagtcgatgtctttccattccaatcccagcatttcgctgcgcctgaagccgctgtatatcgaaagcagaaggtacacctggtatttcataggctcgtcccttaaatgttcgtagagtgtttttacctcgtccagcgtatatatctgcttttcctcttgctcggattttggaacaaccacccgtctgcaagggttgtcagtcagcattcccatacggatagcgtagctgaacacatcgctgataaggctgagatgatgcaccgctgttttgcgtgacagcggctttccgttgttcatgttcttgccgttgataagcaagtcagtcacaaatttctgaatatctcgactcgttattttgtcaagtcttttatgaccaagtgctgggtatatgcgtttggtgagttgtttcattctcgaatatgatgtggaacgcagattgacctttgcatattcttcaaaccactgttcggcaaatgtctcaaacttgactgccgcagttatctgtcctcgcttgcagtcctcctcgaaaagtattgcttgacgctgcacctccttttcgatctgccgaggtgtcataccaggctcaggtttgtagctcttgtactggttgcgctgcttaccgtctacgccgtagccgcatgatacctttatttcgtaagtcccattgggacgctttctaatagtcgccatatatattaaaacctccgtttcaaaaccatggcgcatttctaccgacaacattttaccacatctcggtggaaaagtccagagaaatgcgccgccgtatacttgtatctttcctatgagctaatttcttacgatgtttttccacggagatagttcagaaaaatatctttgttaatgagatactttctgccggccattatgtgcggaatttgatcgttgatgcacatctgacgtactctgtactcggtcatgccgtttacaagagcagccgcctccttgatcgtaagcatggtgatctttgtttcgtttttgttttctgccattgtattatcgctctccttgttgttttggtaattctgcttatggtatgtgtgatgttcatttttacagctgtcctttcatagtgttttcaagggtacagtgaaatgttgtacccttggtatgtcggaaatatattacgtgttctcatgtcagtaaagctgacatacagcaacgttttgttacacaacttaatatgaggtaaggattcgtccactcatcggagacctcgtcacgttccgttactctatcgatgcttgttcagattattcatcatcggctataccctcatcaaagtttcttgttatcagatcatcaagattgattttccctcttgtgcgtctgacattgttgaccgcctcgcgcctgatgtccttcaactcgttcttgctaacctcaaagacgcctgcgagaatagctatcagcatttcaacctcgactgcatatctgaacaagccttttgatatttttgttatgccttcatcgcttgcctgagcaatgcactccgcaagctccggcacaagaacattactcttggtatagatagttcttgtcgcaagaaacaatttcagtgcctgctctatcagttccgagcggctgatgtcctgctttgtacaataatcatcacactctgcaagcacatcaccggacacataaatccctgttctgattttatccaaggtcaatcctccttctgatatttgtaggcatttctgaaatcaataatgccgtttgtcctgcgcacatcttcagtacacattccgtacagcttaccgacatcggtttcatcgacatctgtcaccgccgcaagtatgtgcgactgtattgcagactgcaccgccagcttgaacaatgctctgctgatacgctgctcactgccttttacgatcccgtcaatgacagctgataccgtttcaccgagatactctgtcatattctccgaattacaatcaagatatcctgcataaaaccttatcgctttttcaataaaatcgctctgcgactttgcatttgctgccgccatatgagtggtcagcagttcttttacttccgggtagagccacaccgcttgtttttctttgttcgccatggaaacgcctccttaatactgttcgactttgttctttcgctgatatttcggtcgtgatttcgcagcgttgccctcttatggtaacacaccccaaaaccacaaccccctaaaatactgcacaagaccttgcccaaaagctcgcaattgcggtcggctttgccgtccgctgtgaatgcggcgaccccgccgctttaacctgcaatcttattcctctacgtcataaccgcttggaatttacccggcccgtgcaatatgccgacagccgattttactccatttttctcatcttccttctgcaaaaaatatcttgctgtacctcgctcacaaacgccgacaaatcgctcacagcggcgttttgttggctcgttggttaaactatccgacctcggctgtggggcggtacaaatcgcccgatagccgttcttccatctttagcttattcagcatcgccacattcactactgtgttggagttatccctgaccgagaccgtgttgcggcttgtccttgacagcagcaagccctctttacgaagctgacggagtagctcatttttgctaatagaaaaatgctcgccctgctcggcgcacagctttcgcacctcggagtgtgttgtgtctgcgaacaggtagtagtgctcatcgtcctgcaagccgatgcagtttctctgacggggcgtggagtcaagcccttttgtttctacatagcacctgccgctgtccagcagacttttcagcttctcacagaagcgagtggtcggattttcaagctcgatgatttctgcgtttgcagacacagctttcaaaacgatctcgtcgaacaccttttcaaatttatcaagctccgacttgttgatttgatttttcgatttaagaaacacaagcagaaatgcaaacccgattttcaagtgtgcaagcatgtcgggtgtgcggttgtgaaacttaattctgtttgcacacagcctgtccagataaaacttgcggtatttcaaaaacacatcttcgagtgtttttacaaaagcactttcatcatcaagatacacatttttaatccactcaatgtagctttgcataatcccacacagcactccgtcatttgctaactgctgatattctgacaggtcatcaagctgaacatcgttttcattaagttcaatattgaagtatctcgccgaacccgacacggaaatttcaggagtgtactccgctgtgataattgcattgcctgtaggcggttttgaagattgtaactccgcttttgaatttagtcgcgcacgaccaattctatcaccgtagtatcgcgaaatattctgcgcaatgcttttcatctcctgttcgtgaaacattccgctcggatgaaaatcgtcaatgcaagtcaacacgtcttttaaatagtatatgttgctcaaaatgctattcgctgtgtcgtggaatgacatcggtaggtcgcttgctgaaaactttccgaagaacgaaaggaacagcgctgcaagtgtggatttacgactacccgtcttaccaatcagcgcagtcacaaactttggctcacagcctgcacttttcagaaagtgattaagcggacacagaaacgttaccgccagcagcggtagcataacacactgcggtgcaaaactgttttcaagcattgcagacaagtaaatcaagtcctcctgcgaacccttttcagtgaaagaatagtttttcagcttgccctgcagttcaacggtaaacggactgttctgcgtcggcatcaggaacacatactcaccgtttatcttcttccaaccagtttggagatacatagtttcaaatttcacctcacctttcgttaacataattgcgtggcagattttacttagcacgttttgcttaggctgtgcagcacccaatgcaccccagcggtttaagagccatttcatgttttgcatttcgtctgcggaaacaatctgctccgacagtttaattcccgacttgtgaaccgcaccgaccttgaacattttcttttgctctgtgccgtcatctctggtgatttccgaaataagtgtgggaacaaagtctgcaagtttcattggaacgacctgatctttcacctgaaccatttcataaaggcaattgcttttaacaacgtagggataattgtagactgtttcatcaatcagttttgctttttttccttctgtcatgatttctgacattggcatcactccttttttaatttatgtagttgttgtggtgtgtcctgcgctttcaaacattagccgaacgcccgacagcttatcaggctcatagagcagcgttcctattgcttgcgacggttggtatcacgctcgagaacgtgcaatgtcagcaagctgaaacgtaagtatccgtttctgattttcatcgccaactgcagttgctagatgcaggttgaagattgtatttgtcgctcgttttgaaatacaaaagtcatggcgtacatcttcagcagctggaacagttcatcacccctccgtcagaaataacgtattcggttaccgattattcaattttcaagattccgtcaatcattcgctctgtatattaattaggcgaattttttctaatttatcaaatcgcattacaggcaaaaaatccattcactacatggtttcaaatgcttatatcaattgtacaataaaagttaccacaaatctgaaaaagtgtgatataataaatacaggtcaccgctaaaaacctccaccgcacatctgcggcataggattttagagctgacctatagatacacttttgaggggtacttgacatgaacaatgcaatttcaaacaatccgaattacgatatgcccgacgacagcttttttaatttctattttcttattcacaagaatagaattttcacaacaaaaatagctttgaaggttggcgaaatcacaacggctctgctgaatatgaaagctgaggatatgaaaaagatttatgacttaaccgtctcttttgcggggtttgcagataataatatggcgatgaaaaacgagcagactatgacggaatttgttgaccgcataatcgaaatcgaacaaattgcggtgactttaccaccgtactgctatgtgaatattgacctgaaaaaagaaaaacagcgtgccgaaataatgaagagcaaggctttctacggcaggctgtatgatatgacgtcggaggagtttgcggagtatgagaggtacaaaaagttgttttcggggtacgggattgggctttacataatcgcctgctgcatagccgaaatgtcagatgaatattttacacggcttaagaaacgtgacgaaagcaactatgcgattgcgtggggtgcgtttaacgaatattccacactttcgagtgagctgatggcgagcgtgccgtactatgaaaaggcaagagttcgtgaaaccatggacgtaaatatcggcgtttcgggaatgattgatcccgatgataaagacaagacatgggtggttgatacctgcgaatttcataatgcgcaaagcgttattcaatacgattttttcagaggaatgcagcacggcagagcgccttttcgctgtcaccactgcggacgttttttccttgcgactgacagctacaagacgttttactgcaatgaaaagtctcccgaaaatcccaacagaacctgccgtcagactggcgcgaaaaacaagcacaaggaaaaggctgagaacaatccgattatccagacctaccacaaggcgaggaacaaatattatcagcagaaattccgaggaagtatttcggatgcggattacgacaaaattctgcactaccttgaaaccatgcgtgacaaggcaattcggggcaaaagtgacgagaatggaaatctgataacgtacaaaacgctcgaagagctttttgaaaagcacacgctttacaagacattaaatatcggggaagaacaatgaccaagaacacaaatgaacagctgattcaggataattaccgcaacgtatacgcacttgcacattctcttgcaaaatcatacaatcttgcatttgaggcttttgaggacttgcagaaggtcggctacatttcactgattgagcagtcgaagacctttgacgagaacagcggtgtgcctttttggacatatgcctgtaagggtgttaagttgaaaatgctcgaagaactccgctttattctcgatacggtgagtatttcgccttatttgaacaagcagataggaaaggtgaggaaaatcgtttcagccaatgccgaaagcaacacatccgaacttattgaaatcgtaagtcaaatactcaaaatatcagcggacaaatccgaggagttgctgattttaagcacaaaagagaaaacaagcattgatgagtaccaatcaatgcttgaaagtggtgagggtatgcaggatgacaagcttgaagataagcttaggtccgattgtctgaatcccgaagatctaatgctggagcaggaaaatcaggcttttgccatgctgttggcggacagtctggacgacattctaagtcatcggcaagcggaatatatccgaatgtattttggcatcgggtgcgctccgcagacctttgaacaaattggggaggagttctgcgttaacgccggcacggtggaaaagggcgttaagtcggctctgaaaaagttgaaagagtatattgactgacctatgttctatcgagtttccagaatgggaattcaggtagtatgcgtactccatttttgctccgtattaccgcattacaaagagctatttgcccagtattctcagcgttttgcgaggtttcggctcgcattacatttgcataacacaaaacaaacaagcatattacaacggagtggctgtagtacgcttgtacgctattgtatgctttttttgaggcgtggtattactcataaagtgcgggttttacggcacttgcgagaatgtaagctttgtacggcagattttgacggagagctacaccttactcagattttcattcttgccgaggagcacgtcaatcatcagcttttcgccgtcacggaatccggctgagtagttatccacggacattacatcgttaagctaaaactgggtgtcacatatctttttgagcagttcaccgttttcatctccgagaattttgattatctggtcatacagatcagcctcggttttcatcagcttggcatactgcgaattgtcccgaatttttgcgtcgaaaagcctaaattgccgtagtaaaggtcttttatatagttcatttttgatacctccgtgattggtttggaagtacggtatatcacaattattcgtggaatggtagtggcagatgtgatgaaaattgagtggtggatttggggagaagtgataaattagaatcattttactgttcaactggcgttttagccactgttaaaggcaggtgtgtgttacatttacgttaaaaaatgtaaacatatattgaaaaaatatgaaaagtatgctacaatgaaatgaatgcaaaaatgactttttcaagcttacgctgatgaagggtgataaggcggtcgaggtgggtgaaatactgcccgatttttcgttgttcagttagtgacggactttttacatcggttgaatttatattgatttttgataaacttggcacgcccgttgattcatctttctttttccaatcaatattttgaaaaattccaaacacaaaattaatgtcatacgtttcttttggaatgcagtaaaataacgtatctactgtccaaaatggagcttttaaaacataaggattatcaatagttcctttacgaccaattccaactgcgtcctttttatatgaaagtgctttatcgacactaatcatatatccacccgttccataaacaggaatatcgccctcgttcaaatctttgtaatccattccattgcctacaataatcacctcccccaactcacgctgttcccaagtatcagtgaaatccttgaatcttattgctggaacgttcgattttttcgtcattttacacacctcccagcagttttttcagttctgccagaccttgcatatcaaaatcgttgccgactaaatcgtcaatcattgtacaaagtgatttttcggtctctttgatttcttcgtcaacctcttcaaaagtggtttcatatttcttggaaagcacctcaagctttgaaatcaactcgtttacaatattaacgggtagcttaaaaagctcggtcacaacaggggtgatccattttgctttcaggaattctctgatctgctcgtcggtcagctgttcgatcgccgcctttgtttttataatcaaagccgcattgtcttccttgatttgctttttcaaagtcttttcctctttggcaagatcggtatatttcttgagtacagcaatgatctcgtcttcaacatctctcacctttattgactttttaacctccgccgcaacaaaagcagttttgtcatcatttacgaaagcccttgacttgtcctcttcgctaagtccgtcaagcagtttctcatattcggatgcaattttggagagccttgtttcatattcattcagctttgaaagttcatcgaaaaaatacgcagactgaacaagaccgaacggaataacgtgtcctatccagccttcctgaacttcgatttctttattgtctttcctcttgataaccatattgggatcgacctgtcttgcagcaccaaatccctctgtctgaatgatttcaaggtcaattgcgattctgctccactcgttatcaagtatctggtaagcctcataaacgtccactagaggaatgtcagcaagtcttgcaaaaatattgtcagaaagagtgctttcttccttagatgtgttaattgcggtctggtcacagccgatcagttcatcataaagataagtatcaagatctgcaaaagctgtttcaaacaagcttgcaaagccggttacatcggaatgttcgtgtacagccttttttatgtcctctacagaaaagtggacatactccgcaccgttatcaccaaacagcgcacttctcaggttcggaaaagcattccaataagtcgaaagtccatcaagctctttggcaggaattccaccgaacatagacgcataaatatcccagctttcagcattctcggaagaatccacataacgtgggatgttcaggttataatcattttttctgatttcttcacggctgacagtccttgaaaacttgtccacattcttgcgtgcacttacggtatcaacaatacgcttaatatcagatgaacgcagtttgttgttctttccaatcttttcaaagccttttgatgcgtcaataatcagaacgtcgttgcagtcgccacgctgttgcttcagaaccataatgattgtcggtatacccgttccaaagaatatatttgcagggagtccgataattgtgtcgatctggttcttctcgataaggttcttacggatttcaccttactcaccgccacggaacagaacgccatgtggcagaacaattgtcataattccatcgggtttgatatgatacaaatcatgcagtaaaaacgcatagtctgccttgctctttggtgcaagaccgtattcactatatctaggatcggagtcctttccttcgggattccacggctgagagtatggcggatttgaaacaacggcgtcaacacgcagtacaggcggatagctgtccaaatcaatcggccagtcatcttcaagggtgtccgcatttcttgtaaagatgtttgccggtgtaattccgcgcattacgagattcattcttgtcaagttgtatgtattctctttcaactcctgagcataatactgaacctgctcgctatccatatattttgcggcactgcgtccaatatttataaggagtgagcctgaaccggaggttgggtcatatatagcaatattttccttgcttttaaggtgatttgcaacgatttcggacataagcagcgacacctcgtgcggagtatagaattcgcctgccttttttcctgcgttcgctgcaaaattggaaatcagatactcatagatgaaaccaagcacgtcatatccctgtctttcatccatcgggatatcctttatcagtccaagcaagtcactgattgcctttgttcttgcaccgcttgtctcacctagtttagaaagtccggtctgcaaagtatcaaaaatcttgtcaaaaacttttctgtgagtgctgtcaatcagacggtcaaacgccgataatgcatctgtaatgttggaaacatcgaaatctttgccttttttcagccaagttgaaaaaagattttcatatgaaataaaatagcctatattcttcttgcactgttcgacaatgtcggtatcttcctcaacgagttcggacagatctgcatcttcccagtcattctttttcagatactcaacttccttatcggaaagaaatttataaaaaataaagccaagaatatagtccttgtactcattcgcctcaattttggagcgcattttatttgcttactcccatattttgtttgcaagttgctgtttattcatagtttcctcctaaatatatatttttaagtgtttttatagccgtgcttattagctgacgcttgggaacagcgtaagttgggcgagatttcagaatcatttgaatatggtctaaacgctgccgccactgaatttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgcctttattttttgtatggagatgtatgaacgtgcagaagtggaaaataataaacaaggattaccttgactatctgagagaaaattatgagtcgaggataccaaggacagactacggaaatgataagctgaagccgttctttggagagcttatgcgtgtgggtgaccttgcatatgtgacgcaggtatcttctgcaaagccaagacacaataaaataaaggcaaatatagattttcagaaaataatacataatgacgtgcttatagctgttgtaaatcttaattatatgttccctgtgcctgtgtctgaaatgacagaccttgaatacggaaaaatcgaggagtatgttgatttcaaaaatgatactgccaaaagcaaatacattgaccttctgaaaagagaaatgaaatatatcaaagaacttcctcttgaaaacaatgcacgctcattgtatgctctcaaatatgacaagcctgaacacgtaatatcaaagcgttgttttgatttcaaaacattggaaaatggtgcgcataaatggacggagaagctcataaaataatcatgcagatatgggggactgacgcttgcagggcggcagtcctttttaagctttaaacgacgatttttcggggattttcttgttaaaatcgctgaaaatccttgcagctttgcggtgctgtttgtaagttgtgctattgacataaaaggggttatagtatataataatcgtatgtgtggatattgccctgaaaagataaaaaatacagataatgggtgataaggaagaagcagaaaatgataggaggaaacttatgaacaagattttttgttctgctctgacagccgttgttgcaggtgctatgctcacaggctgtgccatgccttgggaaaagggtgctgatgacgacgttgcccctggtggttattcctatacggctgactcaaattcagaacagaaacaagcttatcgctggctcatagagccaactataaacgccgataatatcatttcttttgacggaagtcaggtcgaccctaacaacgaaaagaacacagcttatgccaactattctgttatcagacagaatggcaaatatggcattatagactacagcggaaacatggtagtgcctgcggaatatgacgattactacacctgctggtgcggagaggtcacgcttttcaatattataaatgagaagaatgatgagtatgagtattgcagtatcgacagctcaaatcaggtagtttactatgcggcggaacatcatgacagctcaccgaaatattactggaacagcaatgaggaaaagatctatgtaaaggacgctgacgaagaacagggcgaagaatacactggcaaaaaggctgttgtggtatgtgaagctgacgtgaaaaagtctgacaatggtttttatgacatttctcctgtgagcgaaccgctttacgggcttgctaaaaaggacaagcttatacttgatatgcagtacactgatttctatgcccctgcatacaaaggcgcaggacttacctgcatcgcctttgagaacgacaaaggcaagtggggatatgttggttctgacggcaagactataatcgactttaagtgcgacggtgacatgagtgcctattgcggaaaggtgatagatgacgagatggctgttcatccttatcttttcactgacgattatctgccggtatccatagattcatcatatggttattatgacatagacggcaactgtatcgtaaagccaggcgagttcgatcaggcaagacctgctcacaacggcaaggcgtgggtaatgaagtctggaaaatggggcgttatagcattcggtgacgcacctgtggaggaggactcatcagaggaagagaccaccacaactacgaccaccacaagctacatcaccacgaccacaacttcaaagaccaccacaacaacttcggtttcaacagaaacgaaaaaagcaactgaaactactccatctttgacacagccaagtgaaaccactgaggtgtcaacgaacacggaaactgttacagaaacagtaacggagcctgttacggaaactgatccgcctgctcctgagcctgagcctgagccgacacctgaacaatagtaagaatataaacggcgttatcccactttggggtacgccgtttttttggtgcatgaatatgtgcggatattgaaaatgcgtgcataaacaaagcatcgaaagcgggacgtcgtatttctgcaaagcagaaattgcgccgctcccctacatggtttgtgcgtttttaatatattttttttgctatacaaaaaaagctctgccgaaacagagcttttattttttactggttatatatatctttcctgagaagtgctttgcaggcttcaaaatccacttcgagaattgattgaccgtcagatgatgtgccatatgaataggaatcattatcaggtattctcatggactttatctcgtaattcatggagaatatcgccttataggtaagagcaaaaagctgtgtctgggacatattggttgtaagatgtgacattgatgcttttgcgaacttgtctatagtcagcggatctgagcttttcgccttttcgattatctttgtgataactgttctctggcgttctgttcgctggaaatctgcgttgccaacatatctaagtcttgcataggcaagtgcctgattgccgtttacaagaagcttctttccgcccttatcaagatagtctgtaccctttttattgccaagaagcttgttttgctctgccattggaggcttcatgccctcggcctcttcatcggaaatgtcaagctcgataccgccaactgcgtcaacgatatcaacgaatgacagaaagtcgatataaacataatcgtcaacggcaatatcaaaattatactctatggtatccataagaagctctgcaccgccgtaaacatacgctgcattgagctttgaccatgtgtctatatcatttccgtcagcgtcaatgcccttgatattcacatacatatcacgcatgaaagaggtcattgttatctcttttgtggtgctgttaatggagagaagtatcatagagtctgttcttccacgctcgtcagcgtttcttgtatcagagcctataagcaggatatttcgtacatcagagctgttcatggaagcatctgtgttcgttcgctgacctctttgcaccttgttcaccatgcctatgtatcgccatataagcacgttcgccaatatgaaaaccaccaaaagtatgatgataagcaccttgaaaaaggtttttatagggtgtctttttttattttccactttgtttttaccttttttgttcgtctgaccgttacggcttttattgtttttgccaaattgcaggtcattattccgtctttgtgctgaggtcttgttgctttttgctgacttgcctgaacctctctgtttgctctgtctgttctgtggacgtgacgtttgtctgctctgtgtctgccgtcttggagtgctttctctgtatgagcctgagtgatctgatgatgaacggcttccctgcccgtatgactgagctgtaccctgtgtatgatcatcagggtagccagcgtcatagtaatcgtcaaagtcgttcacgccctcgtctatttgctgaacacgctgtccgcccgcaccgcttatgcgattgaactcgtcaagctgtcgctgatattcctgttcatagtagtcctgaggcttattatcgtttgtgtagttttgttgtctgtctttattagccacctgactgcacctccgttcatttttacaataccaatattatagtacatatcaggcttattgtcaatgacagaaacaaggcggagctttttccagcgtccgcctttaaggcaaaaccgcacaaagattgtgcggttttgccttaacatagttttttattttattctgctgcttcttagggcgttgaggatagctattacggctacgccaacgtctgcgaataccgcaagccacattcctgcaagtcccaatgcaccgaatataagcacaagggcttttactccaagggcaaaaattatattctctcttactattgtcatagtctttcgggatatctttactgcgtcttctatgcttgacggatcgtcgttcataagcacaacgtctgcggcttcaatggcaatatctgagcctaagccacccattgcgataccgatatcggctcttgcgataacaggtgcgtcatttattccgtcccctgcgaatgcaacaagtctgcggtcggggtcttttataagctgttcgaccttttcaaccttgttttcagggagaagctcactgaagaatgtttttatgcccactttctttgccaccttttcggcggtatctttcttatcccctgtgaggaggacagtttcaacgccaagctctctaagtcttgaaacggctgtggcagaggtttcttttatctcgtcgccaaggagtatctcgcctatgaacttgccgtcaagggcaacataaactgccgttgcggagtcttctgagctttgtgcggcaatgccgtttgtttcaagaagagctttctttccgcaaagtatctccttgccgtcaagctttgctcttacaccgtttcctgctatctcttcaacatcagaaagtcttgcaccgtctatttccttgccgtatctctgcactatggagataccgatagggtgagttgacatactttctgcatatgcggcggcttcaaggaggatatcctgtgaaacgccctgtgggtttacgctgaggacagtgaacttgccctttgtgagcgtacctgttttatccactgcgagagttttgcacttcgccattgtttcgagattctttgcaccctttataagtattccctttttagatgctccgcctattcctgcgaagaacgagagaggcactgagataacaagtgcgcatgggcaggatattacaaggaacagaagtcctctatagagccattttgagaactggtcaaagcccagaatgaagcttggtataaacacgagtgcaagtgcagcaattactaccgcaggggtataaactcttgcaaaacgtgtgatgaacttttcggtcttagcttttctttcgctggagttttgcaccatatcgagaattttcgacactgcagactcgtggaaggtatttgtgacccgaactttgagaagtcccctcaggtttgttgagccgctgaggacgctgtcccctgctttgacctcgaccggaagaaactcaccggtaagtgctgatgtatcaagctctgattcgccttctgttacgataccgtcaagaggtattctctcgcctgtttttactgcgattatctcgtccttgaggatatcctcaggaggaagctcgtatgttttgccgtttcttacaactgttacagactcaggcttaagctccataagctttgtgatagattttcttgacttctctactgcgatagtctggaaaagctcgcccacctggaagaacagcataacggctgcaccctcacggaagtctttaagtgcaaatgcgccaactgttgcgatagtcatgagcagagattcgtcaaaagcctcgcctttaacaaggtttcttacggcggcgatgacaacgtcaagacctgcgataaggtaagcaactattgcaaggcctgcactgagatactcacacacagtgccgtttccaagcttatccaagagcattgatgcgataaagaacacgatagccacagaaagcttgactatctcgccattatggtcattcacaggctcctcctctgctgtctggacaccataatccttaacagtaacgtcaggctcaagctgatggacggtatcttctatcatgatacgcaggtcaggattagaaccgtctgttttgacagttagctttttgctgataaaatcaacgtttgatgaaataacgcctgcaagctcacccacacggtttgctatcttttcaccgcagttagggcaatcgagatcctccagcttcagatagagagttttctcagcacaatcgccaagctctttcacgctaacgtcaggttcaagcttatggacgacattttctatctcggtaaagagggcgtttttatcgccgtcaaaatcaactgtgagctttttattgataaagtcaaggctagagcttttaacacccgaaagctcgcctacacgtttctcgatcttttccgcacaatgcggacaatcgagttccttaagaagcaaagtcattttactcatttcacattctcctatactacaaaaaacagatcactttctttactcgctgatatgctcgatacccatattgagtatgacagcgacgtgttcatcggaaactgaataatagactgtttttccctcacgtctatacttcacaagtctggcctgcttaagcactctgagctgatgcgagatagctgactgtgacatttccaacagctctgcgatatcgcacacgcacatttcatcctttataagggtaaagagtattttcactcttgtttggtcgccaaggactttgaaaagctctgccacgtcatatatctcctcctcgacgggcattgtttttcctatttcctccattttctctatattctttcctccgcactgtttatgctcatgctttactgtattctcgctcatttattttcgctctccttttcttattattgttttagtatattcgatatgggtcatttcaattcatcatatgaataactgttcatatgtttattatatcatatattcatgttttgtcaaggggggtttgaaaatttttttttgatttaagttattgggggtattttgtttacatggtactggttgcataccatgcgggcgaacgatgttcgcccctacggattattcgggcgagtttgctgtgccgcaaaatcgcttcgctctttgcggatttacatttgctttgggagaggggaggcggtgcaggtttatgcttcgatgttggttttatttgatgtttgggttctatgtgctttttggatttgttctgcaccgcttagtaggcttacgcctattgaggctctgcctcaagctccgctaggggctttgcccccagacccccacaatgggtttcaccccttgaccctgaccaggggcgtgcccctggaccttttgctcgcttcgctcggtgttggggcacaactctggtcagctttgcccattcctcactcctcactcctcattcctcactcctcactttttacacctgtatttaaacttgacaagtgtctaaaaaaatgttactatactatagtaataaaacttatatgcaaattctcggtcctatcggaaaggaaatgatactatgtcaaaatctgtcgagattcaatctcaggatctaaccaaaagatacaccctcggcgaggagatcttcaactccgtttcacacggtgcaggcggtctgctatccattgccggcactgccgttcttatcgttctcgctgccatttactccaacgcttggggcgttgtaagctccgctattttcggagcttctcttatcatactttacaccatgtctaccctttatcacgctatcaccaatccaaaagccaaaaagtttttcaggataatggatcacaacaccattttcttcctcatcgcaggaacttacacccctatcacccttgtgcctttgagaggtgcgtttggctgggttcttttcggaatcgtttggggtgcggctattcttggcattgtgctgaactccattgaccttgaaaagttccgcaagccttctgttgtatgctatatcgcaatgggctgggtagttataatcgctgtcaagcctatgatagaaaaggtttatcctctgtccttgtggtttattcttataggcggacttttctacactgtgggcgttattttctatgttaaaaagaacaaaaaatattttcactcaatatggcatttgttcaccattgcgggaagtgttttccactactttgcggtgcttatgatgataactcacgaataagataaaaaaatcccgagggcgttttgaatgctctcgggatttttttactcattttcttcgtcgtcatcattttccaatgtatcgatatacttattgtatttctttatggtgtgctcatgcaggagatagtcgatcaccatagatactgcaaagcctataactacatctaatacagcagaggaaacgctgaatttcgtatcgacaaccagatctataacggtaaacatggctgcaaagaccaatgaatcaagagcataaaacttaattctgctctttctgctctttttgtccgtacctgtgtcaagagtcttgcctgtgaatgatctcggtatatcataaatatgatttttactgttcaccaccgtataggttatcatcatcaccacaacgcttataagatcaggcaacgggttctggtcggtatacaaccgatacaaaagcgagatcaacacgcagaatatcgacactatgcccactgccgcaagggctgaatcgttcgcctgtttgacacgctcgtcaacaccatctgttacctgagtttcaagcttttctttgttaagtttcatttgtcatctttcctttcttccttttctgtccaaaacaggtcgttgagagtcttatccaatgcatcgcagatagcgacacaaagctttaaggtcgggttataattgcctgattctatcattccgatagtttgtcttgttacgccaacggcttttgcaagatcctcttggttcatatccttttcaagccttgctattttcatttttttatttttcaagttttgcagccgctcctttctttctcgttgatcatagtatacattatattttctaaagtgtcaagtatattttgcatttttctcgatatttttttcattatgtcatgatcatttttatatgacaagtcagggcggcaaaattaaaatagttcttaactgaaatatatggcggtttttctattgcaaaaatggggaaaaagtagtataattgcaatggtaagttgtacaaatatgaaaggagcattttatgcgtagatcgggtattttaatgcacatatcctctctgcctaacgattatggtatcggcaagcttggcaaggaggcttatgcttttgtggattttcttgaaaaggctcaccaaaaatgttggcagatacttcctatatctcctacaagctatggtgattcgccatatcagagcttttctgttcacgcaggaaatccgtatttcatcgaccttgaggcacttgagaaagatggttatctgaaagctgcggaatacaagaatattgagtggggcgatgacaaagggtctgttgactacggcaagatatacgaggtcattttcaaggtgcttaggacggcacacaagcgttttcgcaagaagcctgaaaaggcatactcaaaattcgtggtggaaaacaaagactggatatacgattacgctttgtttatgtcactgaaatttgccaacaagggcaaggcttggtatgaatgggacgaaccgctgagaatgtacaagcctaaggcgataaaaagtgcaagaaaagaatatgcaaatgatatagacttctggtgctttgtgcagtataaatacttccagcagtggaaaaagctaaaggcttatgccaacgaaaagggcatcgagataataggcgatatccccatatatgtggcatatgacagtgttgaggtgtggagtacaccgcagtatttcagccttgacaaggagaaaaagcctgttgaggtggcaggatgtccgcctgacgcattcacagcagacggtcagctttggggcaatcctctttacaactgggaatacatagcaagagataaattccgctggtgggtagagcgtataaaggcggcttctgacacctatgacgtggtgagaatagaccatttcaggggctttgaaagctattactgcataccatacggtgcaaagaacgccaaaaagggcaagtggagaaaaggtcctgacatgaggcttttcaaagaagtgagaaaacagcttggggacgtgaagataatcgcagaggacttgggcttccttacaaagcacgttgtaaaaatgctcaacgcaagcggataccctggcatgaaggtgctggagttcggctttgattctgacaacacaaacggctatctgccccacaattataagaccacaaacagcatttgctatacaggaacgcacgataacgaaaccatacttggctggataaagagctgtgacgaaaagaccagaagctactgcaaggactatcttggagttacaaaagacgagttcgtgccttgggcaatggtaagactttgttggtccagcgtgtgtgatacagctatcgcacaaatgcaggatatactttgccttgacgataaagccagaatgaatacaccgtcaacagtgggagcaaattggaagtggagattggaaagctttgataagcttgatgatactttggcggagagattggcgaagataacagcggtgtatggcagatagagcagggataaatgaggaatgaggaatgaggagtgaggaatgtgcatagcttatcagagttgtgcacaagcaccgagcgtagcgagcaataaagcgcaggctcaagcccgacgctagagggcttgtggggtcaaggggcaaagcccctgcggagtttgaggcagagcctcaataggcgtaagcctacaagcggtgcagaataaaaccaaaaagcacatgaaagtttgatatcagataaaagtaatatcggagaattaaatctgcaccgcttttttattccttagcgcaacgtagatccgcaaagagcgacagcgattttgcggcagaagaaagttgaccaaaacattgtagggaaacggctcaatttctgtttcacagaaatgcgacgtcccactcgaagtgacaaggtttaaattatccagaatttgtgcagagcaacattgtacggataacacaaataagatcgcagtcgaatcgtcgaggggtgcgggacgccgagggcgtcatcccctacaggtgtgatagggaaggttttagttctatcccataatgttgttgccgtgggtttgtttcttcgacgggcgaacaatgttcgcccctaccatacgttgtgcggataattacaaagtacaaaatacaatagaatacataaaatgccagaaaggataaaaaccaatgaacaaagaactgttttacagcgaacttagtaaagacctgaaaaagaagtttggcacgagcgttgaaaaagctctgccttggcagcttcacgaaagcctgtcggctactgttatggagcttattgacagcgattgggagaacagcaaaaaggctcaccttgacagccgcagagcctgctatctctctatggagttccttatgggcagagccgtttataacaatctcctttgccttggtatcactgacgaggtggacgagcttttgaaggctcacggcagaagtcttaatgaccttgaagaaatagaggacgctgccctcggcaacggtggtcttggcagacttgccgcttgcttcctcgattccgccgccgctcatgacctgcctttggacggctacggaataagatacaagtatggtcttttcaagcagaagatagttgacggcttccaaaaggaagaggctgacaactggactaagtacggcgacccttggtctaagagatgcgaaaatgacaaggtagtcgttaaatacggcgaccagactgtttatgctgtgccttatgatatgcctgttatcggctttggcactaagaacgttggcacactcagactttggcaggctgagagcgtggaggattttgacttcgctcagttcgactgcggtaactatgacggtgccgtaaaggctaaaaatgacgctgagaacatctcaaaggtgctttaccctaacgataactgtgaagagggcaagatactcagacttaaacaggaatatttcttctcctccgcttctgtgacggatattctcaaaaagcatttggctaagttcggcactcttgacaaccttggtgactatattactatccagcttaacgatactcaccctgttatcgctgtgccagagcttataagacagctttgtgctgagcatagctatgactttgacaaggcttttgagatcgcccacaaggtctttaactacacaaaccacactatcatggctgaggctcttgaaaagtgggattgcagacttgtggaaaaggtagtgcctgaggtctacacatatatccttatgataaacgagcgttttataaaggatatgtacgctctcaaaaaggacagagaatatatttcaaagctttctcctgttggcgacagcatggtaaaaatggcgtttatggctatctatgtttcaagctatataaacggtgttgcggctatccacactgatatactgaaaaaggacgctctcaaggattggtatgagctttatcctgaaagatttcagaacaagaccaatggtatcacacaaagacgttggcttgcactttgcaaccctgagctttccgcacttatcacaaagcttttaggcaatgcagactgggtgaagaacctggacgagcttaaaaagcttgaaaaatatgctgatgatgaggctgtgctcaacgagttcatggctgttaaggaggctcagaagaaccgccttgccgcttttgtaaaggagcatgacggtgttgatatcgacccgaacactatttttgacattcagatcaagcgcctgcacgaatacaagaggcagttccttaacgctttgtctatactttacatttactatggcatcaaggacggctctataaaggacttcacaccgacaacatttattttcggtgctaagtctgcaccgggatacaggagggctaaggctatcatcaagcttattggcgagataagcaagcttgtgaacgctgaccctgacacaaaagaccttatcaaggtggttttcgtacagaactacaacgtttcctatgcggaaaagcttgttactgcggctgatgtttctgagcagatatctacggcaggcactgaggcgagcggtacaggcaacatgaagcttatgctcaacggtgctgttacgcttggaacttatgacggagctaacgttgagatcgttcaggaggcaggcgaggagaacaactacatcttcggtgcaagagtagaggagctggctgagataatgccaaagtatgaccctagggagatacttttctcaaacgacaagataaagcgtgttcttgacaagcttattgacggcagtctttcagacggtggcgttccgtccaacgaggagggcagcttcaaggagctttacaaggcgctcaccgacggtgcaagctggcacgttcctgaccactactatgttcttggcgaccttgaaagctatgttcaggcaaagctcaaggtcaacgcagactacaaggacaagcttgcattcgctaagaagagctggctgaacattgctaatgcaggaaagttctcatctgacagaactatcaaggactatgcagaaaacatctggaagatagagcctgttaagctgtaattggaaatcaaatttctatgcaaattgaatttgttaagggtatcgcgcatgattttaagctttttatacacgaaaatgaacttatcataatattaatttgcgaaaatatgaactaaagcattaatacacaaaggacaggctcgttttttgacgggcttgtcagttttgatgtaaatatattcaagagatagatttacataaatggcaggaggataaatgttagacaccttacttaaactagacggcgacatactgttatggatacaggacaacctgcgtgcagggtggctcgaccccataatgaagttcataacatatcttgcaaacggaggtgcgttatggataggcatatgcgttttacttctcatactgaaaaagactagaacaacaggcatcgtgtgctcatgctcccttgcggtgacttttcttataaacaacatcattctcaaaaacattattgccagaacaagaccttacgaggtggtcgaggggcttaacaggataataggggcacaatcggactactcgttcccgtctggacattcgggagcttcctttgcagtggcggtggtaatgttcatggagatgccgaaaaaatatggcgtgcctgcacttatagtggcaacactcattgcgttctcacggctgtatgttggtgtacactatccattcgacgttatcgcaggcgttctaacgggaacgatttatgctgttataacagtggcaatatacagaaaattcttcaaggacaagaaacattctgaaaaataaaagacatttgacgggcggtttttgaccgctcgtttttttgttgctttatcatcaaattctattgaaaatcaagtgggaatatgctatcatagagataataaatatgaaggagaaaatcttatgaaaaaggtgcttaagactattcttatgggtgcggtggcgttcagccttgctatgggagtgggctgtgggactggtgaaaacagcagtctggaaaaagaaagctcaaaggctgaggacagcagttcacagaataagcgcagacagcttcgtgacaagtctgactacggaaaagtgatagccctcacttttgatgacggccctaacactgacacaactccccttgtgcttgacaagcttgaagaacacggcattgtggcttcgtttttcgttatcggaaacaacatcacagacgagagtgcagaggtcatgaagcgtgcttacaacatgggctgtgacattgaaaaccactctcagagccaccctgacatgacaaaaatgaccgcagaggagataaaagccgagatagactttacctctgacaaggtggaagaggctgttggcgaacgtccacagtttttccgtccgccatatattgcggtgaaccagacaatgtttgacgttatagatatgccgtttatatgcggatacggtgcagaggactataacaatgccataggcgttgaggagcgtgttgaaaaggtgcttgcgcaggctaaggacgggggaattatcctgcttcacgatatgaacggaaacgttcagacagttgaagcccttgataagataatccctgcgctcaaagaacagggctacgagttcgttaccataacagagcttttccacgcaaagggagttgccattgaccctgactccgagataatctacagctacgctgagcagacagagatgtacggctaaaaatgacaaacaaaaccgcctgagagaaatagcttctcaggcggtgatttttttatcaagtaaatcgtgccccaggctgatcctctggtgggataggcgctccgcaatgaggacattctgtacaggtgtctacgacataggtatagccgcaatattcgcaggctttttcctgagctgcgtcagaacacggctttgctttggcatattttctcgcctttggatttatacctatcataaggcaggcgtgcagacacacaaatgccagaatggcgatcgaagtaaatagtatagtccaattcactttactcttcattacggtaggcgtcaggtcgtcaaatgatgtgctgatagccgaggacactgtatagcgtgttctcgccgtgagattattctgcagctcgtcattgaagctgttcgttacagattttgtcagaacatcatctgtatcattgccctgcataccctcccaataccaatcctcaaagccgtcagaggaagaatagccgtcaggggtagagtaaactatgagccaatggctctcgtccgcaaagtggttcacatacagatcataggcataattttcaagatctgaataatttccctgccaatcggaattttccactgttatgaccgcaggtgagataccggtgcggttataaaatgccaccagcgagttcctaagctctgcggtgttgccaaggacatttgctttatcctccacaactattttataatcataattttggggaagcttatgagggtgatgataagcctcggcaaacatagaaaatgtgaataaaataaacggcagatagaaaagcagcataagaaatctcaaaggacttcttttttcggttatgtcataatctgcatagacatagacaggtctgtgatgatcataatatacatatcttcttgcgtccggaaaataggtgcttcttacgtggcgtgagcttcttcctgagcctccgtgcgaatggctgctgtgatgcgagccgctgtgtgaccctccgctgtgagagcctccccctgatgaatgtggcatttattttttacccctttcccctatacaaatctataaatccatcaatactgcacacgctcggctgtgtagccgtctttttcaagcaggtcgattattcctccctcgcctgcatagtgtgccgctccaacaacatagaacacgttcttgccctgagacataagatcctcggcagcttttgccatgttcttgtttctgtcatagagcatttggttattataatcctcggcgatctttttgtcctcctcggtatagcctgcaagctcctcctcgttatcttcctcaaggaaggtttcaatatcccccgacttccatgcggtatagaggtcttcaagagcctgcttctggctctccttggtttcaccctcgcagcttctgaacataaggtcatagatatcgtcagagaagtttatgagcagattcatctgaaaatccaccgactcaacttcatatatctccttgccgtctgcatgggcggtggtaagaaggtagttatcaagacccttttccgaatcaaagtcggcatcctgaataagcagggtatcaagtgtgcttgaaacagcccatggtctgtagacctccaaagctgaaatatccatgccccaatagccgagatatgtttgcagtgctgaatatgcttcctcggaaatatgctggctgagctttgtgttatcattataaagcatttgcttcataagatttttcatatactctccgtcctcgcttgtggaggttatatcgcactccaccgcaagtatatcagcattgttgtacgcatttgttattgcctcaggtagcggataacactcgtctttcagtgcatggaaagagccgagcatcaccattgtgttgccctcaggtgaagtcactttccacatagcaggtgtgataccgttcgtctttgtatcgtccgttactgctgatgagctgtctgaaacactgctgtcaggtgcagaagtggcagaagctgtactgctcgcttcccctgtggtggttgtatcagccgttgtgtcggctgttgtagttgtggctgcctttgagctgctgtcggtctgtgaactgtcaggcacctctccgcatgagcagagaagtgtggcgcacattgcagcgactgtaaaaaggctcaatgttctatgtatctttttcatggttttatctcctgtcttcatagttgtatgtttcagtatatcacacatcaaagaaattttcaagtatggttacaattttgtaatagtcaggctttattctctcttatacgcttttctatcgtttccatatctatgccgtattgtttaaggatagtctgagcgaagctgttgtcacggggcattccacggactatcttatactttcgctctcctgtttcatcatctgcgtcggcaacaatgcttgcaagctttgttctgagcgtactgtctttattaagctccacggtcttgtatgcgatatccacaagatgtgttgcaaaaactcctcttacgcccattttgcagaatatcctcaaaagctcgcaggcgacctcaacgcactccctgggggttgtgctttggatagactcgttcataagaagcaggctgtttgctgtgatagtgtcgcttatttcacggaactcttttatctctgtggtgaaacggctagtgtcgatacctgttttttcctcttgcgggaactgagtgtagatatagtccacaagggatatttcacagtatgaagcaggcacataaagtcctgtctgcgccattatctgacacagaccaaccgcacggaggaatgtggtctttccgccgttgtttgcgcccgtaagcacataaaagccctcgctgtcacctcccatggtgatatcgtttgtgacaacggattttttctccttgtggtcaagattatatatcctggcttcacggaaataaacagggtcaaagatatcctttatgacggcttttctctcacctgcaggaagaattttcggacggcacattttaagcccctgatcttcgcaggcttctatcacagccactgcgcccatgtaatattcaagctgatagtctatatagcgcatatcggcaatgcctgctttctgatactcagcaagcaccttgtctatcattttcacaaaagtatcagtaagatcgctaagctcgtcaaaaagggtcttatccacagtgttgataagtttatcgtcagacacctcgctgtcattatacttttttctgagatttttcacaacagccttatcgttgaactttgccccatggtaaagtatcctgtcaacaagggacggctttatatcgtaacgctcttttgaaagctctataattcctgctgaaacaggaactagcctttcatcgaggtttatggcaaccgtaacgcttcgtatacggtcatagagtgcctttttaagcttctctatctcacctttcagggatatataatgcttgtcaccgtaatgctcctcaaagaacgcaaaaagcttttttacgccctctgagcgtatcttatctttcatttttccataaaaatcgtgcattatctccatgcactgtatgtaagcgtcaaaaccgcttatggcatcatcaagctgtgaaaagctgtcgggagtagtaagattatagatgttttttctgtcattttccaccatgacgtttatcaccttgcgtatggtggcagacaatgacggaagccttatgaaatcatcaaggatatcaaggcggtagtttattacctcctcatcgtcgcaaacctcacaaaaaagcctcattacacgatactggtaatggggcgtgataaaatcagccaccttttcaagctccagattgtcaacaaacgctctggggagcttttcaagggcggcagctctttttttcattgcgttgtgcttttccacagagggataaagcaggtcagccacaggggctttcatatcaaattcgtcaagttttgaagccattttcatttcctcactggtctttggcaagggctttcaggtctattattatgcccacctttgcaagagcctttgacataagctctgcacttaaggggtagatatcagtttttccgcactcgtggtcatactcgtatctgaaaaactgcacataattctcctgataatcctcagacgtataaacttttcccatgatatatttactttttatggcataatagttcacaggcttgagcctgagaatagctttcgggtcggcagacatttccgaagcgagggtatcaaagccctcgtcaacgtagtttatttttctgcacttcatatcctttattttctttttcagaggcagttcgctctgagcctgcttctttttgaacagtgaaaacatttttacacaccaagcctctcaaaaagctgtttgcggcaatcttcttcaagcttatcgtttataggtgcagggatatacttttcgccaagcttacggctcatgcagtatgaaataacatagtcgctgacctttggatttttagacagaagcggaccatggagataggttgcgataacgcttttttccatatagccctcggtactgctctcaaactcgttgccgttgcctgagaggacttttccgaagggtgacttgacgttggtggtctgtccgccgtggttttcaaagcctatcaccttgtatttttctccgtcaagctgagcttctataacgatattaccgatacatctgcatcttttatcggtagacgccacagtatagtaatcaaaaagccccaatcccggcactttctcgccgtttgagtccttataatactgacccatgagctgatagccgccgcatatcatcaggaaaaatgttcctgccttataagcttccatgatactgtccttgcaggaaacgaggtcatctgcaagtatctgctgttcaaagtcagcaccgccgccaagatagatgatatcatactgggtgaaatcagtttccttgtcaccaataagatgctttgaaacttccagctctatgccacgcattttacagcggtaagaaagcacttcaacgttgccgctgtcgccatagaggtcaagcatattaggatacatatgaagaattttcagcttttccattttacttttcctccccgttttctttcaggctcttatatctttttattgcggctcttgtcggctggatagcagtataattggctatggcgaacttatcaccctttgtggagaagagtgacgctgttgcttcgtcaagatcaggataaacgaatatcttgtcagggtcatagcctgagcattttattcttatggcgatatcatatgctcttgtgcctgaggtcacaactcggtcaacattattgaacacagagaagtttatatcccatatccaagaaacgtcatggccgtctgcaaggttatcgttaaggacaaaaagcagttcctttgagcctgcctgctcgttcatcacacgcagggtcatatttgcgccaacagggtttttggcaaggttcacaagaaggcttgagccgtctacctcaaagcgttcaagtctgccgttattcacctcgaaatgctcaaaggtatcgtgcaggatagccttatcaaagttataaagctttgcggcggtatagacagccgccatgttatacatataatagatactgttatgagcggtcttatatgtttccccgtctgcttcaaaggacggaacagtcaggtcaacgttctttatctccacctcaggctcgatattgccaaaaccacactttggacaatggaacttgccgatatgtgaatactgataatagtcatagacaagctcggtatcgcagaaaggacagaacttgccctcgccaacttcataaggcttatccgttgcgccctgatatctgtcaacgctgaaatagtggatattcttgttattagggttagcaagtccaagtcttgccacgtttgggtcatcggcattgaggacaacgttgccctcaaatgtttcaaggaattttttcaccttgagaatgagtgtttccacctcgccgtttctgtcaagctggtcacggaagaaattcagcagaacaagggtctgcaaattgagctttgaatagaccacaggaacgtgtgattcgtcagtttcaagcacaagataatcggcgtggactctgcccctcatatcgcagtgattgagcaaaagtgagcatattcccgtatcaagattgttgccctccgggtttgtgattatcttctttccaccgcttgcaaaaatgtggctgagatagtttgtaacagaggtcttgccgttggtgcctgtgacggcgacgatagggcaatccaccttgaaagccttaaggcagtctttatttatagtccacagcacaagcccgggaaagttgcctgcgtccctgccaagcaggtgcagtgttttaaccataagcttgccgaaaataatggtgaaagcgttttttaaactcatttatgtatctcctattaaaataaagtcgtataaaataataatagaccataacgcccataatgtcaagcattttagacatttgcaaacaaaaaaacaccgcacaaagacgataggcgccccttgtgcggtgttggcttctatataatttttgagagaaaatctttcaaacgctgattttcagggtgtgcaaagaactctgacggcttgttctgctcgagtatttttccgtctgccataaacagaactctcgaagcaacttcccttgcaaagcccatttcgtgggtaacgacaaccattgtcattccgtcgtttgcaagctgtttcataagctccagcacctcgcccaccatttcagggtcaagtgcagaagtaggctcgtcaaaaagcattacttcagggttcatcgccagtgaacgtgcgatggctattctctgcttctgaccgcctgagagccttgaaggatactcgtcagccttatcaggcaggccaactctttccaaaagctcttccgcctttttgtcggcttcatcggctgtcataaggccaagcttcacaggggcaagagtgatattcttttttattgtaagatgtgggaagaggttgaaatgctgaaaaaccatgcccattctctgtctgagcttgttcatttcatgctcgttcgcctgagtgatgttctcgccctcgaagaagatatcacctgaggtcggcttttccataaggttaagacagcggagaaaggtggactttcctgagcctgacggaccaacgataacgaccttttcgcccttgtcgatagtttcgtttatatctttcagcacttcgacctcgccgaaagacttgctgagatgtttaacgtctatcactttgcgacagcctcctttcaagctttcctaccagatgagtaagcacaactaccattataaggtagataagtgcaactgttataagcggcatgaatgccgagaacgtctgagaacgaattatatctccgcccttagtaaggtcctgaattgcgatatatcctgcaacagaggtttctttaagcaaaactatgcactcgtttgcaagggcaggcagaacagttttaaaagcctgcggaagaactattgatatcattgtctgacgatagctaaggccaaggcttcttcctgcttcaaactgaccgttgtcaactgacatgatacctgaacggactatttcagccacatatgcgcctgagttcacgccgaatgcaagcacagccacaagagtcttgtctatgttcacactaccaaaaataacaaaatatgttataaggagctggactaccataggagttcctcttatcactgtaagatacactctgcaaagggcgttgagtatcttcattttgcctgtcttatcatgagtagagcggactatagccacaagaaatcccaacacaaagccaagtatgaccgcaaagaaggttatgataagtgttgttttaagaccattggtaagataatgccaacggctctcgtccaaaaaattttgctggaaatcgtcgatcaatttgttcaattcagcacttcctgttctttatcaaaataatttcggctgccgctctacgacagccgaagtgtgaaaaattatttctttcttacgattattacctgacttgatgatgtgtaagtgtcagagaaaagaacgtttttctctctgtcaggtgtaactgtcatacctgcaacgccaacgtctgccttgcctgactgaacggctgagatgatagaatcaaatgccatatcgtctatcttaagctcataaccaagcttgtcgcaaactgcctgcatcatatcagcgtcgataccaacgaccttatcgttctctttgctctcgtatggagggaactcagcgtttgttgccattacaagcgtacccttatctctgctaacattatcaggggacttgtatgggttcttgccagcgttctcgccaacgtagtttgccttgatagcgtcaagtgttccgtcagccttaagctccttgagcgcaccgttgacagctgtctgaagctcagtgttgtcaagcttcatagcgatagcgtattcttcctcagcaaaaggctcgtcaagtatttcaagatcgtcattcttctcaacgaataccttagcaggctcagcgtcgattataacagcgtctatcttgccctgcttcagagcctgaacagcatcagcgcccttgttgtatttttctaccttagcgtccttaacgtcctcggcatagatgtcgcctgttgttccaagctgaacaccgatagtcttgccctccagatcgtcaacgctgtgaactgtattagcaggcactccgcagcctgcaagcattgtaacgctcattgccactgcaataagtcctgctgcaaatttcttcataacatacattcctttcaaaaattaatagcgacagtcctccaataccgactgtgcataaacctatatcatatattataactgaacacacggctttttgcaatagcttttatcagtgatttaatatataaattatgaattttttgttttgccaaaccattttagtaaacaaaaaaggtatccacccaatggggacacctctttgtgaaaatcagcttagaaattcattgtgaactgaactctgtggttgccgtctgcgtcatcatctatcatttcagcctttacgatagtgataggcgtaacaggctttgactgtgcgttgtctgaacctgttgttctttccactttaagaaagtcatcaacaacgtccatgccctctgttaccatgccgaaagccgcatactgtccgtcaaggaaagtatccttatcgctgtagcagataaagaactggcttgaagcactgtccatatcgtttgctcttgccattgaaacaacgcctcttgtatggctcaggctgttttcaacgccatttgctgagaactcgcccttgatagtttccttgcttccgcctgtgccgtcaccgttagggtcaccgccctgtgccataaagccgtctacaactctatggaaagtaagtccgtcatagaacttttcctttaccagcttctcgaaattctcgcaggtgataggtgcgtcattggcataaagcgtgataacgaacttcttgtcagtgtcagccgcagaggtctgtgatgagctgtcacccttatctccgcaggctgtaagaattgcgcaggcaagcacgcctgctgtgcaaagagccaatgctctgaatagctttttaagtttcatttttatcgtcctttcgatcattattaatagcacttctgccttttcactagcctattatagcacctccctgcaaaaaaatcaacatcagaccatgtttttcacataattttcatcatacgaagcctaaagttggcttatttaatattgatttttggctcttaatggagtataattataatgtttttttaaagaaaaatataaaaactatgttatgtatggaggactgaacaaaatggataagctgaaaaaagctctgccctttatcttcccacctctggctgtattgctcataatgggatttgctttttatcggcacgggctttacccttttggtgacgggactgtatcatggtgtgatatgtcacagcaggtgatacctctgctcaccgacttcaaggatattttcactggcaaggacggaatgttccttaacttccacaatgcaggaggaatggacctgtggggcgttttcttcttctttatcgcaagcccctacactttgcttgtgctttttgttgacaaggctgacataatctaccttgtgaacattctcacagtgcttaaaatgatgacagcggctgtcacggcgcagatatatttccgctcctgtcaaaaaaagctcgacccttacattggcgctgtactcagcgtcatatacgcattctgcggctatggaatgttctattatcagaacaacatatggctagacatgatgtatcttttccctctccttatggtggcattcagggagcttttcgagaaaaagcgcattatcccatacactgtcatgctcacacttatgatgatagtgaactactatatcagctacatgatagttgttttcataatgattttcatggcgctttgctgttggcgttaccgcaaggaagaaaaatacaaggacgttccatgcagatttgttataggctcgctccttggtgcattgctttcggcggtggtatggataccatgcttcctgcagtttttgtcaagcggacgttctaaatcagttatccaacagatcgaaaccgcctcattcatcacaaactacaacaccacattctgcctgctgttgtcaacggcttcggtgatagtgatagttgcggtgtttcttcttgacggcaaaaagaggagcaagcgtttgaacaccgaccttataatgctctttttgatgctcgtacctattttaatagagcctgcgaaccttatgtggcacacgggaagctatatgtcgttcccatgcagatacgctttcattaccatattctttgcacttatctgcgcaggatattttctgtcatcggaaaacgcagtggcaaaaggaaagaaaaactgcgaccactttgttattttcctgatacttgcggcacttatctacggcttttacaacttctctgagggctttgttgagaacaatcgtgacggaatgtcaaaatacactaaaagcctttggcaggacagcaccgcctttgaactttgccttgaatttttcattgtggcggcggctttctatactgttatcgttctgctgcacaaaaagggctggatatcaaagaagatatttgctgtcttccttgcaatgttcgttgcggctgagtcctacgcaaacgtgaacatttatatggtatccccaagcatgaacaatcctcagcgtgcggctaatcatcagaagataatggatctttcagacagacttgacgaaacagagggcttttacagagtaaagaccgcaagcaagcttttcgaggtcaatctggtcggctcaatgggctacaattctctgagccactacacctccctcacaagccgtgattatatgtacatgatgaagcagcttggttactcctcctactggatggaggtaggctcatatggcggaacggagcttactgacgctttgctgtcagtaaaatatcttattgaaaaaagcacaggctcggctgacgctgtatattcaaacgatacctacgagatagtgccgacagaatactatctcccccttggcattgtgaccgacgctgacctgagcggcagtgaggagctttccacaggcacaagaagcaacgttcagaagaagctttttgaacagcttttcggtggcaacggtaacgagcttatcacagactacgaatactccacgatctatggtgtgcaggacgacagtaactttaatccgaactacaccctcactactactagcgatgtagcctacatggactacagcatagatgtgacagacaagcagacactttattttgactgcttcgacaagctttcaaacagcctcagcgaggatataaacggaagcttcatggtaacagtgaacggtcaggtaaagcagatggattatccgtcacaatcgagcaacgggcttttgaaacttggggaatttgaaaatgaacacgtcaacgtgcgtgtgaccttgaagaaagacatcataagctgccgttcctatggcgttttcgggcttcaccacaatgttcttgaaaaggcacttgagcaggcacagaccgccggtcttacagacagtgacggcaagctttcaggaagcgtgaacgcaaaggcaggacagaaatgtgtgcttcagataccatatcaggagggtctgaaaataaaggtcaacggcaaagctgtttcatatgacaaggttttcggtgaccttgtaagctttgacttgcaggagggcgagaacacaataactgtaacaagcgtgccaaagggcttttatgcaggtcttgcactgactatcgcaggcattgcgctgacagcaggatatttcttcataagaaagaaactgaaattcggagaaactatggaagccgctgcacttgtggctgttatcggtgcgggagctatagtgatcatagtggtttatgttgcaccttgcatactgaatatttatagctgataaaatataacagatataaataacataggggcaaacagcgttcgccctccttggtacaagcattgtaattaaaaaaaactgcggatagcattttgccgtccgcagtttttattttatccgaatttacttatgctcctccagatacttttcagtatccattggatagcatttcaggtttggaagctcgtcaagggtgagaactctttcgctgttgtagatcttgttccactcgtcaaatgtggtgtactgatctgaaagctgtttatccttgatacagaactcgccgttccatgtactgaaccacgcccagcgtgtgccgtcgttgaatgctccgtcagggtcgaacatagagccgttctctgtcattgcgattatctttttggtcgatgtgcttgacttcacaaggtcataataccacttctgtgaagagctgtcctgctctgcaggataacagtcatagcccatgatgtcgacatactcatcacccggataccagtcaggattctgtgcgttccatacccagatcaggttgttaagaccatactcgtttgtgaacttgtcatacatgagctgccaaagctgaatgtatgcgtcctttcctgctgaaccccaccagaaccatgcgttgccgggatacttagggtcgcctgccgcctcgtgaagaggtcgccaaaggataggcacgtttgcgtctgcaagctctttaagcacccctgccatatggtcaaggtctgctatgatagaatcgtagccctctttgtcctcgccgctgagagcctttgcaaggtcgaagtctgtatattcagaatagaagccctgccaccatgctccgccgttcttttccaggtttttatcaggggcataccaatgccagcaaagtgaaactataccgttttcgttgttgtaccagtccatagcctgcaatggcaccatatctccgccgcctgcgccatgtgaaagtgcgctgtttgaaaggtttgaaacgtcaagaccaagtatagcaggcgtcttgcctgtgtgcttctttatctccttgaactcacggcagtccttgccctcgttatctcctgaaaactgacctgagatagtatacttgccataaacgtccgtaaggaagttataaagtctttttgcctcgtcagaagcgttagggtttgaaagctgatttgatacctcatactgtgaaaggtcgatagcaggagctggggttatctttatcttgtcaatatagatatgaccgttgtcgccctttatgcctaccttatgagtaccttcgtcgataagcacattttcagccatagtgtcgccaaactctgttgtggtcgatgtgaagtttgtgagcgcagcaccgtcaacagtgataagatttgactgaccctcgccgtctgccgccattgtgagagtaatattatagcttccctttgcaggaaaatctatctcgaactccaccatatctcccgatgaacctatggaaacaaagccatcgccagaaaacttaccaagaaaattcttatcaagcactgccgcacctcccgaaagagttcctttttccgcctcggactcgtaactgaaatcctcaggaacgtcatactctgtcgttacgtctgaaaggtcgatattgcccatatcctcaacgacaggggctgttgtagtggtagtctcgcctgctgacgagctgcctgagctgctgtttcctgtgctgctgcagcctgctgccgcacaagcgataagcactgccataacggcagcaactgttcttttcattatttcacgcataatgttctccttatcattactaattaaaatattcaaattttcataaagccaaactttgcgaagctctcgcctttaggctttatattccatacttttaaatatatcatataaaaaatcattgtcaatagccgtttttaatgtttaacatagtgttcaaaattgataacgtttacttttatttggactaaaaaaatatgaacccacacggcattgggttcatattttcatatataaaaatattattttctgagaaacgttctgtatacccaacgggtgaattttctgggaaatataaacaagccaagctgcagagcgcatggcatgaaaaagtcacggaagcctgtataccctgaacggtgtattatccacctcacacgaatgaaagcctttgtatgctcccagcttttgcgtgtatctacagtattttcatctatgcggtagcgcacaagcacctcgggtatattctgcccctttgcaccatgctgtaacattcgtgcgataaactcatagtcctcgcacattttaaggtcactgtaaccgcctatcttttccgcaaaggacttgcgaaaagccacagactgtctgttgaaagggttgcgtcgtttggaatatgaagcgatatccttatgcatgacaggcacttttttcaccgaaactacctcgtcggtgtcagtgtcgaactcctccacatatgtgccgatgatatcaagcttaggtttcaccgcaaaaagggtcatctgcttcaagcagcggttagggagagatatatcgtcgctgtccattttcacgatataatcgcatttacacgcctttatgccctcgttgtaagcctttccaacgcccacgttctcgtctatctgaacgatatggaaaatatgcttgaactcgtcctgaaaagacttcacgatgatattaagctcgcaggtgagcttgccgtcgcacacaagtacgaagtcagagggaggatatgactgcatgagcatagactcaagactctcgttaaggttctcaggaagctcacggtcatacaccgacataagcacactgtattcaggcagcgtatattttccaacacgatacgtcataaaatccctcccctgcattattatcaactcaattatactataacagctccaaaaagtcaactgcgaccaacaaagtatactatttatatagtacagaccaatacacaaaaaagaccgccccattcggaacggtcttgtaagctactttgaaaaattagccaagcttcttagcaagctgtgatacctttcttgcagcagcattcttatgcataatgccctttgtgcaagccatatctaccttcttgatagcagctcttactacttcttccttgttttctgcattctcagctacagcagcgtcagccttcttgagtgcagttttaagatcagactttacagccttgtttctcattgtcttagtgttgataaccttgactctcttcttagcggatttaatgtttggcataccgacacctccctcattctgtataaatttgcacttatttgcacaagctatccgcagactgagaggaaatgcggaaagccctttaaacaagccttgtaaaatattttaccacatttcaaaagaaattgcaagggggtttactgaaaaaaatatataaattttgcggtctaaattgtaggaacacacaaaaacttacacgatgtcacagaaaggtgaataaaatgagcattagaacggatatggcggcggagagcttttctcaggcaggcggtgcggaaaagcttcagggagtgaaagtcaaaaacaaggttattgaaaacgctaggcttgaggtaacggacatcaccatagaaacacaggaagccgccgaaaagcttggcagacctgtcggcagatacatcacccttactgccacagattcaacattcgatatgtacagcgacagttttcgtgagcgtgcagaagtcatagcaaaagccataggggagctttgcggtgattgtgaacgttttttggcagtagggcttgggaactatgccctgacttccgacgctgttggtcctcttaccgctgaaaagatcttcgctacccgccacataaaaagccttgcaaaagagattgatactgacgatctgggcgaggtcacagtgattcagacaggagtgcttggaaacacgggaatagaatcctcagagcaggtaaaagcaattgcagagcgtgtagcaccgcaggctatcattgccgttgacgcactggcttgcagcgaactttcaaatcttggcaggacaatacagctttgcaacaccggcatttctccgggaagcggagtcgaaaacgcacgaaaagagctttcgctttcgaccctcggggtaaagtgcattgccataggtgtgccaacggtcatagacctttgcactgccgcacagcacattttcggtcagaccgcacctgaaagctccgaaaacatcatggtcgctccgaaaactgccgacaaactttcggaaaactgcgcaaagctcattgcaatgggcataaaccgtgccgttcaccctgccctgtcgcaagaggacattcaaactctcacctgctgacaaaagacaggtgatacagtaatgtaaaacctgtatacaacaattgtaaactttttattaatatgtatgagcgaaattgcgaaaacgttttctgaaaacgaatactcacacaaattcaacacacctttgtcataatcaacaaaaacgcttgagctttatattgcaaaatgctgattgactaaatttaaactttttgttatcattagtaaggacgaaaaataagcgttatggcaagcgttgtcgggtaacaatgcttgtcgatcgtaacagatgaacgttttgggtaaggaacattcgtctattatcaaggaggttactataatgaaaatggcaaagagaattttcgctgctgcttgtgcgctttcactggcttgcagcatggctgcttgcggcagctcatcaagtgacagctcatcttccaagaaggaagctaaggctatgacagatgatcagaaggagcaggtaaatgcacttcaggataagctccctgacatcgagctttcaaacaagacaatcaagtggatggctcactatgacatcaaccctagtgatggtaagtcagaatcacctgctatctcacttttccagactaagtacggtggaaagatcgagtacgttcagacaacttgggataacagatatactgatcttgcaaaggcagttatggctaacgactcacctgacttcttccctgctgacgacatggacgcattccctaggggtgctatcaaggccatgttcgagcctatcgacgatgtagttgatttcagctcagacatctggtcatcatcacagacacttaacgattcattcgtattcaacggcaagcactatgtagctgctatcgacgtaaaaccacagtatgtttgtacatacaacacaaagacaatatcagactttggctatgacgatcctgctgagctttacgctaatgacgagtggacatggagcaagttcacagagatgtgccttgactttgcagactctgaagctgacagatgtgctcttgatggttactggtacggcgaggctcttaacgatacttgcggttatccacttatcggtcttgaggacggcaagcttgtaaacaacatgggcaaggctgaagttggtacagttcaggatcttatgtacaaccttgagaagaacaacgttgtattcgacatgtcaagcaacaactggaagacaagaggtgacggagctaacggtgaaggtcttggttcacagctcacactgttcattcctatcggcacatgggctctcgaggatactcctgaaaagactaagacattcggaagcgtcaaggacggcgaggttatgttcgttccaatgccaagaatggacgattctgacaagtactatgtatctacaggtgtaaacggctatctcctctgcaagaacgctccaaacccagacggcttcaatgcgttcgtaaactgctgcaaggttgcaaactctgaggtacagaacatcacagaagaacagctcaagaacgactacggctggacagacgatatgatcgagatgcgtaagacaatttacgatctggctagacagaatcctgtatttgacttccagaacggcgtatctgctgagctttcaacacttatgcagacagtaaaccaggctacaatgataacaggcggcggagctactacatggacagagtgcgttgctgagaaccagaaggctgttgattacatcattaaggaagcaaacgctaacgttgctgaataattcagtattttcaagcgggacgtttattcgtcccgcttttttattgcctttgtatttgtcacgaatttgttaaatatatttgtacgcaaaatgcacaatataaaatacataaatttgtgcaagaattttacggatttttatgtacaaatcacaaaaaatatgctataataaatgtacgttaaaaagaatatatcaaagaagggagatatgttttatgagatcgattattactatcagccgtgaatttggcagcggaggacgtgaaataggcaagaagcttgctgatgatctgggcatacctttctatgataaagagcttttggaaatggcttcaaaagagagcggtatatgtcaggagctttttgttaagaacgatgagtcctatactaacagctttcttttctcactggtcatgggtaattaccctgtaagtgcagacggcaggatcaatcctgatatgccgctgaatcacaagatattcttggctcagtttgaaactatcaagaacattgcaaagaagggtccttgtgttattgtaggacgttgtgctgactatgttctgaaaaatgagcctaatattatcgacttcttcatttccggcaacactgccgaaaagaaaaagcgtatccttgagagatacgatatcgaaaaaaacaaagctgaggactttatccgcaagactgataagcggagagcttcatactataattattacaccgacatgaaatggggcgaagcaaagaactatgacctttgtatcaactcgtccaaaacaggcgttgacggtgctatcaagcttatgaaggcttatatcgaaataaaagaagccaacgctgataaataggaatttttcgttttaattcattttactttccttactacgaaagagggctgaccatagggtcggtccttttccgttttatgaggagttttattactccagcttaaacaaagtgtaaccaatatgttattgacaataacaagcaaatatattatactgtataaaagggcagaagtccgtcaaaaaaataaaaaaaatgcaaaaggagaaacagaaaatggctgaaataaaagttatcactatcggcagacattattgcgcaggcggttcgactatcggtaagcttgtggctgaaaagcttggtatcccatgctatgacagagagataatcgacatggcggcacaaaaaagcggcattgcaatgagcgagatacaaaaatacgaggaagccgctcttagcattctcaaaacaccgataaatctgttttcaaaggagaaagagtatcctataacagagaagatattcgccgctgaaacagaggtaataatggagcttgtttcaaatggaaactgcgttatcgtgggcagatgtgcagattttatactgaaaaacaaagtcaagacgctgaatgtcttcattaatgcaagctttgagaagcgtcaagagtgcgcaattgagaagcacaacatctccgaggacgaggtagaagcaaggctcaaaaagtatgacaaaaaacgtgccgactattacaactccaacaccaacaaaaagtggggagatatttcaagctatgatatgtgccttgacagcggcaggcttggctacgaaatgtgcgccgagataattgctgacactgtgaagctttcaagggggaaataggggcaatattttattgggagcgataaaaaatgtcaaaggataaggaagtcaagaccaacgccatgcgtattcttgacagaaataaggtaaaatacaaggtcaacacatacgagtgcgacgagtttatcgacggcatacacattgcagatatgctcggtcagccatatgaaagctcgttcaagacccttgtgacagtgggtaaaagcggaaattactatgttttcgctatccctatcgcagaggagcttgacatgaaaaaggcggcaaagtctgtgggcgaaaagtcggtggagatgctccatgtgaaggatataaactctgttacgggctacattcgtggtggctgtacaccccttggcatgaaaaaacagtacatgacagtagttgacagctctgcggagcagtttgaagagataatcataagcggcggacgtatcgggtcgcagataatgctttctccgaaagaccttatcaaggtcacaaggggtaaattcgagagcataacaatgagtgaataaacaaaaaaagagagccgcttggctctcttttattttgcatttatgttgatatattcgggctttgtctttgagtacattattttctggctggaataaagtccgtaatagcccgaaagcatatagcttactccgcaggcaaccgcaaaaagcacaagcccacttccaccgaaaagctcatagctgagaagtatggaagccacagggcagttcacaacgccacagaaaagtgccacaagacctatagccgcaccgaatgatgggtcaagccccaaaaagcctgcggctgtacagccgaaagttgctccgataaagaaggtcgggactatctcaccgcccttgaagcctgtatttatagttatggcggtgaaaagcattttcagggcaaaggcttctgggtgcgccttacctttctctaaagccgccacgataacgtctacgcctgctccgttataatcccttgtacctacaagcaaagtcaatgcaatgatcacaacgccacctacagctatcctgagataggtgttaggcagatacatctgaaatcttgaatgtgaaaactccattaccatgcaaaggagtatggatatcaccgcacaaagagccgcaagcgccgctatctgggtcacagacacaagggaaagccttggtatgcctgttatgttgaactttgttggcgcaagccctgccaacagcgatattttatatgcgataagagaggaagctatgcaaggcacaagacccacatagtatataacgcccacgcttattacttccatagcgaaaaaagtcgcagtcaaaggcgttccgaaaagtgcggcaaacactgcgctcattccgcacattatcacaaggctggagtctttttcatcaagctttaaaagctcgcctgactttgcgccaatgcttccgccaagttgcaaagccgcaccctcacgtcctgccgaaccgcccgtaaggtgggtgagtacagtgcctagaaagatgagaggcgccataagcagcggcactttgatgtttccacgaacagagcttatgataagatttgtaccggtctcctcgtccaccttgcagacacgatagctgaaaatgataaacagacctgccaacggcataagatacaatgtccagctatgacactcacggaagcctgtggcaaagtttaccgccatatggaacagcgagccgactattccccctattacacccactgcgcaggcgataaagacccactttgcaaaggctatggagaattttttcaccgtccgcattttgctttttataaactcactgcttattttcctcacccctttttacagaaaaacaacgggcgacatatgccgcccgaaatacttgaaatacagccccacaataatgggacgtcgcatttctgtgaaacagaaattcagccgttccactacaagatgatatgctaaattatacctcagcgattacctctacctcaacgagaacgtcctttggaagctcttttgcggcaacgcatgaacgtgcaggctttgatgtgaaatactcaccgtaaactccgttaaatgcaccgaaatctgacatattcttaaggaagcatactgtctttacagccttaccgatagatgttcctgcggcttcaagaacgtttgtgaggttcttgcaaacctgatgtgtctgctcctcgatagttgttgcctcaacgttgcctgttgcaggattgattgctatctgacctgatgtgaaaacaaggtttcctaccttcattgcctgtgaatatggaccaattgcgtccggtgcgttctttgtgtaaacaacttctgccatttttatctactcctgtcttaaaattacttattgactatcttaaagcctgcggctgtaagagcctgtcttatctctctgatatgatcgaagtttcttgtttcaagaacaagtctgagcaggcaatctgtgatatcgctgtcctcgcttgctctctcgtggtgaacagaaacaacgtttccgccaagctttgaaattatctctgaaacatctctaagctgaccaggtctgtcctccagctggatagtaagagtatcagatctgccagacttgagcagacctctcttgataactcttgaaaggatagttacgtctatatttccgcctgaaacaagacatacaacctttttgcccttgatgtcaggtatcttattaaacattactgcggcaacaggtgttgcgcctgcgccctctgaaacgagcttttgcttctcgataaggtggaggatagctgatgatatctcgtcgtctgaaacggtaacaacgccgtcaacatacttactgcaatactcaaaggtatgctcgccaggctcttttaccttgattccgtctgcgatagtgtgaacgctttcaaggcactctatcttgccgtctttaagtgaatttaccattgaaggtgcgccttcagcctgaacgccgtatactctaacgcttggcttgagctgttttacagtgaatgcaacacctgagataagtccgccgccgccgaccggaacaacgataacgtctgcgtcagccacctgacttagtatctccagaccgatagttccctgacctgcgataacattctcgtcatcgaacgggtgaataaatgtatagccgttagcgtcacgaagctcgatagcctttgcataagcgtcatcataaacgccaggcacaagacatacctcagcgccatagcccttggttgcctctacctttgagataggtgcgccgtcgggaagacagatgatagactttataccgttctttgttgcggcgagagcaacgccctgagcgtggtttcctgctgagcaggcgataacaccgtgtgacttttcctcgtctgaaagctgtgatatcttataataagctcctcttaccttgaaagaacctgttacctgaagattttctgttttcagataaacgtcacaatcagggtttacctttggcgcatggatacacgctgttggtctgatgacctctttaagcacgtttgaagcgtcaaaaaccttatccaatgtaagcataaaaaacaacctcttttttctatgtaataaaaaaagccctcgcctgactagaggcgaagacataatatctccgtgttaccactctgattgcagaccataagcctgccactcatatctctttctaacggtgagaaaccgtatccgcttaacacatctgcttaggcggatcagctcagagatgatcctgacggcgttatccctgcgggctttcaccaaacgtccgctctctgcgaagtattcgcaccgtcacctttctcgtcacagcctttatgatattcaatacaatcattatatcaccataaatatgaattgtcaacagcaataaaatgaatttttctctaagacattatacaaaaaataaaaacccgcacgctcgtgcaggtttttattcattaaggaagtatagaaaaaatatatgaagaaaacaatcatgaagtctttttaactgtcggtctttcctttccgactgtaataatattaccactgcaatgtgatagaattatgtgcaaagagagtgcatttgcaaaaatatcaccttttgtttgcgtaatgcacaacgatatgacgaagcttccctgtggtcatatccctgccctttatatccgctccgttgtggctcataagctcagcgcagactatgccgtcggtactgcacctgaaaacctcgtgtccgtcacacaccaccacaagcttttcactgtccacagatattccgcctgttcttccgataacattttcctctgcgccctcacgctccaccacataggaaactcgtttcccatgatagcgttcaagctctttcaagggcgtacctttatttctcttaaaaaatcccattttacgctcctatatcattgtatctgacgtttctctgtcaaaggaagaataatctgccaccatatgcagatactaatggcatgaatcaaaaagggggtcacgcctatgaacatcgctcacactattcttgccactgtgggttctataatcgttatgttcgcaatatcaaagcttcttggcaacaagcagatatcacagctcacgctttttgactacatcaacggcatcaccataggctctatcgcctctgaaatggctgtttcgcaggaaatgaacgagcttatcgtgcctgttatcgcaatggtgctttacggactgacaggctttctgctgtctgtgcttacgatgaagtctatccactgccgacattttctttcgggcaagcctatcctgcttattgaaaaaggcaaaatatatcccgaaaaccttaagaccgccaagcttgatgtgaacgacctgctttcaagagcaagaacatcaggttatttcgacatctcaaagatatactacgctattctggaaaccaacggcactatctctttcatggaacgtgccacagaagcacctctcactccaaaagacttaggatatgagaagcaggacgaaaagctttgcaccgaccttatccttgacggtgttattatggaggacaacctgaaatacgcaggcaaggagataaaatggctcaccaacgaaataagaaagcaaggctgttcatcgcctgacaaggtctttctctgcatagttgacggaaacgacaaggtgacagtgttcccgaaaactcaggagagcaacaagaagatctacttcgactgaaccttcttcaaaaactcgtgcagctcctctgcaagcctgctcacaggcagaccaacaacgttataaaagtccccgtctatcttttccacaagaagtgctccaagcccttgtatgccgtaagcccctgccttatccataggctcgccgcttttcacataggcttttatctcctggtcggaaagctctctgaaagtcactgcggtatcaacggaaaagctactgtaacgacagcctctgccaagggtaacgcctgttacaacatgatgagtcttgcctgacagcatttttaacattcttatggcatcagcttcgtccacaggcttaccaagaactttcccatcgcatattacaacagtgtcacagccgataacaacgctcaggtcatagaccgaagcgatacatctgcattttatccctgaaagatactcaggggcaagctctggtgtaacgtcctctggtattttttcgtcacaatcagaggggataaccctgaaattctcacacatcaatgacagcagttcttttcttcttggcgacgctgaagcaagtataacatcataatccataagctcgcttgaaatattcactgacataaagatcttcctttacttcttttacttcttactcaaaaaggcaacgcacttattatcctgcgctgccttagttttttttattacaacttcattccgcactctgagcagaacttaacgcctgccggctctttgtggccgcactgagagcagaatacaaaactgctgtttgcaggctcttgcaccggagcttctgctatcaccggagcaggctgtggcattggtgcaggctgaggtgctgtttcaggctgtgggataggtgcagcagtctgtgtcacagcaggctcagggataggagcggctgtctgaacattctgctgagcaggattgccataaacaggattagcctgtggctgattataagcaggtgaaacagggtgattatgatagccctgactgttttgtataacaggctgtgcgcccattggaactgcaccgccctgagcaggctgctgataaacaggctgagccatttcaggctgttttgttccgcagttagggcagaacgccatattcactggtatctcgtggccacagccggaacaaagtttcattcctctgatagtaagaagctgttcattaagatttttcagttcttcaagagttgcgtctatctgagcaataaggtttttcacctccggctcttctatcttgtcagccattctgagcttgacaaatctgccaatctcagtatacttatcgtttataaaggcaagctttgcatctatctgtgcctttactgcattttcaggtgtattcttaggtgaaaaaaatcccatttttattctccctttcggttataatatttcttctgtattttgctctatggtgatattatcctcagactgaacgtcaaacgaagttgttgtagtatcaggtgcttcggtatcaggagcggtggtaacagtgccgttctcggtcggctgagtctgtgcaggctcactgttctctttgctgttccctgaagcgtttccgccctcgtcaactatctctgaatcctttatctccttatctatctcgtcctgcgacatctgacctctctttacagctttgtcatttacagccgacagaccaagatagcaattcacataatagtgagtaagtatctgatcatatgtatagccagcctcggcataatagcaagcgccccactgcgacattccaacgccgtgaccccagccataggacttgaaagtgaacacaccatccttatagcttatctccatggcgttcgatttcacatcaaagaggttgcagagggtgatacctgttatcctggcttcactgccctcataggtacagctcgtatgaccgtcgatagtcactccgcttatatactttccgctgaaagcagagtctattttaaaccagttcttcacgtcgtcggaaagctttatatcagtttggctctcgatacgctccttgacctcgtcttttgtatatgtagcttcaatgccccagttaggatctttatcgtcaaactcgctctttacacgcttgagatacgggtaagaaacgccccatatatcctcgctggtggtagaataacctgctgttgaagcagaataaactgcatttatgatattgccgttatacataacggtctgaccctcaacggcatttacacatctttctatctttgaagaatatccgcttttaagccccaccgtaggtatagcaccgatagaatcgttaaatctgacccatgtataagccgccacggcctgcgcctttatggcttcctcgccccactcaccgcctatctcgctgttgactatctgacagagcagttcatgaccattaagagtgacgatatttcctgagattatatcgttgacagtataatactcatcagcgacgcttcttgtatctgtaaagttagcagggtcgttctttatatcgtaatactcgcccttatcctcaggcatttccacagtaaactcactggctgaagcctttttatttgtggtctttgcctgctttttctgctgaacataagacatatcatacttatccacagaggactttttgaacttcacaaagtcatagacctcagtagcggcagtggtcttaacgctttgagcttcaacgtttttgacctgcaccgcaggggctttttctgcgcccacgcttttattatccagcagcagctcaccgcatataccaacggcagttatgctcattaccgctgcgcagacatttgcacatatcttttttgtcatcaaattcatcgtcaagacactgtccttaccttcaagcggtcacaccgcaaaacattcccaatggcagcaaaatactcactgcatacctaaataatagtttatcaaatactgaaaaaaagtcaagacaaagctaagtttcgtcctgacttttcagcataatatacaattttacatctacaatatcggcactttagccaaaaacttcaaatattacttgaagtatctctgaccatcaagctccatgcagaatgtgagtgattcaaaccaagacgctgtgcttccaccgcaatactgtggagcgtagtaataaactgcaccgtttgaattatcctcgccgttcagcgctctctttgcacaatcaatagtgttctgagttggcttgtttctgccgctgtaatagccgtttattgcagtgaactgatttggcgctgtaagaacatcgcttatagagcttccaaatctgcctgttttcactctgttgataataacatttgcaacagcgatcttgctctgctctgagcagtttcctacctcgccctgaagaacgtagcaaagcatatcaaactcttcatctgtatagcttataacagaactgttcgagcttgctgttgttggtttctttgtttctgtcttttttggttcagactttgttgtcttagcctttgttgtcgtagtcttttttgtttcagacttcttagctgctgttgtagtttcggacttcgcagcggaagttgttgttacttctgcctttttaagatagtccttcattacatatccgctgtagtcgccgtatgtaaccttataccaaccgtcacttgtttcagccgtaacgataacttcctcgtctgttgcaacgatagcttctatctctgagttcttgtcagccttttctctgacgttcacgatctcagttgcaaccattgttacgttattgacctttgtttcttttgctgcatttttagtagtttctgtcttttttgttgtagtggctttggcggaagttgttgtctcagactctgcctgtgccattttatactcgctgatacccgcttttctccatgtaacggtgttcattgaagtataggtctcatctctctcagtttctgcttctgtcacagaagtggtcttagtgttggttattgcagcttttgtgtccttctgagcctcgttgttgccgcttgtaagtgcaaagatacttactgtacctatcatcagcactgccagcgcaccgctgcccagcattgttcctactttcctgaccgacggcttagctgttcgctttatgctgtcttcagtttttttctgcttcattttaatcacattaccctttccgaccgtctgcacgcaaaccgtcttcactgccgtccgtgagcttgacgtcagctaaaatttattttacaccgatttggtgtaataaacatcaataatcccagccgaaatacttcttattgtttccgtatacgtttctccagcatttagggaaataaatatccttatttgccttgtccttataggaatctattataagatccaggttatcgtcagctgtcattttctttgccacgattacccacctgagatttgaagtttcatttgtacaagttgagagcgatatatacttatcgtctgctgtacactcgatatcgtttgaataccacgaacgctttctcacttctgagatccaatcgtcgaacttatagtcggcgtcgtcaaaatatctggtagtccagtatttgaagagctttccgtcgtcctgattttcaagtattcccgtcacgaacgcacccacgataacatacttgcagttgttgtcatagatagtattgaactctataacaggatatttcttaagaaaatcaacgccctttttatactcagtaaggtgagtaaaggaagttcccacatatctcatattgtggccgtatatcgtgatattgtcagactgcccgtccttatttatggtagaccaagcgtctgcataaatacttcccgattcgtaatactgcttgtctatattcttgtaaagataatattcattatccttgcctttgagaactgggaagtttatatattcatcacctgcggaatttttaaagccgggtatctttatccagcctacgacgtccttgtttcttttcagaagcttcttagcccaatcctgaacttctctgtccttcgttgaagcctcagggtcagaaacgtctatatcgtctgagccgttattcttgctcaggtcaacgttatcgctaaagtcaggctcgtaatttacgatctcctgcatataggactgatcctgctcatcggctttcagaaaatcagaaagctcattaagagaaacacagaaaagcacgatagagaacatgaacactatctttctgaacacttctcctgctccgtcgcccttccacgggataaaatatcttactactcttataaaaaagtttgtatcgtccttttcggacagattcattgtttcattagccattgacatttatttcaagcctccgccttttgttcatacagctcaagcaccattctcagtgctgcttctgttgtaagcatacggatctttcttctgtccaaattctcatattctttataaaggtcaagccgtctgactatttctttctgacgacttctcactgaaacatacacagttccaacaggcttttcctcagagccgccgcttggtcctgcaatacctgtgacagccactgcacaatctgcaccgaaaagcttcagcgcacccttgctcatctcactggctgtctgctcagaataaacagtatactgctccagcgtttcctttttcacgttcagaagcttcatctttatttcctctgtataggtgcaagcaccgccgaggaacatttccgacgctcccgaaacggaagtgatcgtctggcttatcattccgcctgtacagctttccgcagtacacagcttccgaccgctctttatcatatattttactacactttttgtaactatgtcaatactatctgtaaccactttgtcaccttcagcaaatttcatagtaataatcaccccttttagttatatattgcacataaaaaatcggctctttttgtccattttgttaattcgacgattttcaaaaaccaatgttaatagcaaattctgcaagcagatgttacacttttgttaccaaattactgatttttcattattatcaagcccgttcaacacccttttggacgcaaagaaaagccctgaaaattcggggcttttcggcatttttcaccatggaaagacacaatattcgggtacaaaaaagcgtacaattaagctacaagctgttacagttttaacccgtttgtaactttttcacagacaccatgcaacgggtgtacgccatgaaaatacgctatgcgtttttgataagataaggctttgttccctcgatagctttctggatataaggctcccaatcgaaagcgttctgagcggcttcaacgtctgcaagatttggtcttgtcttagggtgcttaggcgtgaaaactgtacagcaatcctcataagggaggatagaggtatcaaaagtatctatctttcttgctatctccactatctcagatttgtccataccaacgcatggtctgaatacaggcatacggcaagcggcgtctgtgcagaccattgcatacatagtctggctcgctacctgaccaaggctctcgcctgtgacaagggcttggatatcctctttctcgcatattctctgtgctatctccatcataagtcttctcatcaggatagtgaaaagctcctcagggcagttatctctcagaagctcctggatctccgtaaaaggcacgcagaagaagtttatatcaccgcagtaagcagtgattatcttggcaagcttttcaactttcatcttcgctctgtcggaagtatacggtggagcttcaaagtggatagcagagattatcgcaccacgctttgccatcatatagcctgcaacaggcgaatctataccgcctgagagaagaagcattgcctttccgcttgagccgacaggtattccgccagcgccctcgatagagcctgcgtgaacataggcgttggtttctcttatctccactgttactacaacgtcaggatcgtgaacgtcaactttaaggtgtggaaatctttcaagtatctttccgcccatttctatacatatttcaggggacttgaatgggaacttcttatctgaacgctttgcgtcaaccttgaaagttcttgcagtttccatttcgtcctcgatatagtcaagtgactttgtgagtatctcgtccatatccttttccagaacgcagcagcgacagagcttaacgataccgaaaattttcgacagcttttccaccgccatgtcaacatcgctgtcatcattaagtggctcaacatacaaagtagattgtgcttttgatacgctgaactgtccacagcttttaagtcttctttttacgctctttgtcatcatgctctcgaagcttgatttgttaagacctttcagagctatctcgccatatttgcagagaatgatttctttcataaattttatcctttctttacgaaaactgcacaaaaaagtcctcgtcaaaaacctgtcaaaagcgacctttttcgccgttcccctttataaatagtacaaaacatttgtttgcgtgttttaccttaccttgcacaggtcgttctgcgcagactttatgccctccataagagcgtcgatatcggcctttgtggtgtcgatgctaaagcttatcctgatagtggagtcaaggctctgctcgggatatctgaactcttttagcacagagcttttcttgccctttgagcaggctgagccgcttgaaacatatatctcacgcttttcaagatagtggagaagcacttcggactttaaccctttgacggcaatgcttgtgacataaggcgagccgccttttcgtgaatttacgaaaacatcgccgttttcgttacacttttctatgagataggcttggatatcagccgccttttcaaagttcgcagaaacattcggcgcaagctttttcaccgccgcaccgaaaccgcatatgagcggcactgactcagtacccgaacgaaagcctttttcctgtcctcccccaagcataaaaggcggtatatgaacgccctttttcacatacagcgcaccgatgccctttggagcatatattttatgaccgctgagggatatcatatcggcattcagctttttggctttcacaggaattttcataaatccctgaacgcagtcgcagtgagtaatcaccaggggatactttttctttatcatagaaaaagccttttccacagggagtatgtagccgttttcgttgttcacgagcatacagctaacaaggaacgtatcctcgttcacagcggcaaagatgtcacgggcgtttatctcgccgttctcgtcaggggatatccttatgacctcacagcccatatcttcaagctcctgcgcaggatttttcacagcagggtgttcaacagaggatatgacaacacgctttttacgttttccgtgagctttgtaagctccgaaaatagcggtattgttgctttcagtagcacctgaagtgaaatagacctcatcaggggtaacaccgagagcgtcggcaatgatctcacgagcatcagaaacaagaagctcagcgtcaagacctgctctgtgcagagaagaggggtttccgaagacctccaagcctttcattacagccgctttagcttcatcacaaggttttgtggtggcggcattatcaagatatatcaattatcacaagtcctttcatgttttatcgcaattattcttattataacatataattgtgaataatgcaaacaaatctggaaagcgggaatgaagaatcatgctatcgcctgcagtgatgtatttttataaagcacaatgcggcacggcattttcagccgcaccgcacagagcactatttatcacagttacaattacttccccatgaagccattgaaagcctgatataatatccctgcgcttctccgcaaacaggacacctctcaggggcttgtgtgccctccacgatataaccgcagttcaagcatacccacgtttcagactgggaggaagagaacagctttccctctttcataagcttgccaaatgccgcaaaacgcttgccgtgaacattctctatcttggcgatattcgtaaagtcctgcgctatctttccatagccctcctgccttgcgacctcagcaaacgcagggtaaacatcttctgattcctgacgctcgttgtggtctgccataccaagcaaggtacacatatcctccgaaatatccacaggataaccaccgtcaacaaacacgctctcccctgacagctctttgagatgctcgtagaatatctttgcgtgaactttctcctgattggctgtgaatttgaacaggtcggcaagcacataaagcttctgctgtcttgccttttcctccgccattgtgtagcggtttcgtgcctgactttcccctgcaaaggctctcataaggttatcctttgtctttgaatttctgaaatctgacatttttttatcctcctactttatacagtcagtgttcctgacttgctttccacaagaatgagtatctgctcctcctcagcggtctgtgcatttatatatacaagcacgttcctgccgttttctgccctgcacctgaactcataacacagcttctcctccaaaccgtcggtagggataagtgcaagcctgccggatactatttcaaggcgcggggacacgctctctttcgctcggctttgggatatatccgcttcggggatatctctgtcatagtggttcaccaaaaagccctttgcgtcaaagcctaatatctcaccgtcgtccattgctactgatacctttataaggtcggtgtaacagcacacgtcaaggtcgttgtaggcgaaattcactgtgagaacgttgtcgatattctcatagtaggtggttttcatggacagtatgccgaggtcatcgagaaaatcctctgctgcctttactccctgctcgtttgtaagctctgtgctttcgctgatacggcttttgaggaaatatgagatatatccaccctgctttgtcacctcgcaagccaccgtcttatcctcgtttgaaaatctccagcatggcattttgccctctacctctgagatatctgtgaacactgtggagttcatgttaagccccagggaacagcgttcaagggctttggtctgtgaaacgttctctgcctcagatgtcatgcgtggggtacgctccatgatattgtctgagaatgggccgtcataaataaggcttggatagctttcaaagcttccctcaaagtctgagaagccctctgtcactgtgggcgggtcgctctgctgtgagcctgtttgggtgagggctatctcaccgctgttcactgagctttcaagctcccacatatcctcggaaagttctttggaaaagtcatagagcgaggatatgttctcatactcctcgtctgttatctcctcgccgtttatgagcctctcgctcactgccatggagtagtttcctacctgtgagagaaatttgtaggtgttttcaagctgcagctcttctatgggaagctgtgacagagccgcctttgccgaggacgcttctctgtaaagcttcaccgcaagtgactggtgcatttttcctgagcctgcataaagttccttttcaagagtgtcgctcacgttctctactgcgtcgcacagatcgcccatggctcttgaataggtgtagttcacactacgcaacgcccttttttcgctgctcataagttgtatatttctcaccgcaagcacacccacgacagccactgtgaaagacactatcctaactgcgtttcgctttgatatatccattttttatgctctccttttcttttttctccattattatgccagctaaaatgctgattattctcattaactgtgccttgcagtgccatttaaggcatatcatgatacacaaaatttctttcctaatcttgtgtatcatgaacatctttacttacttattattacataaatctcaaaataagtgtaatgatttaactttaaaattactgaattgtatttatttgtataaatgcgaatttgacaacgtgctgaaaaagggctataataaagggtgtgtaaaaattatcgtgtaaaatggcaggaaaaatgttaactctgcctacaattctacgggaggaaattatgaaatttattccaaagctgactggtgtggttttgtcagcggcaataatggctcagtctgttccattcgtgtatgcggcagagaaaagcattgcgtcaagtgagctttcaaatgatatccagatatcaaagcctgaatatgctacaggcaatatggaggctgatggtcttttagagcctgtcactgaggacgaccctgagtatcataaatatcttgaaaacaacgatccatacggcattatgacaatgtctgctctgtggggggctgacagccttactcatcaaaacagattcagcggtgtttcaaaggtctatggcattgacgtttcctattatcaaggcaacatagattggaaaaaggtcaaaaacagcggtgtggaatttgttatcataagagtaggctaccgtggctatggcagtgcaggaacgcttgtggaagaccctaagttcaagacctatcttgacggagctaccaaggcagggcttaaagttggcgtatacttctacacgcaggcgataaccacagccgaggctaaggcagaggctaagttcgttcttgacaggataaagggatattctctgcaaatgcctgtttattacgatatcgagtctgttgactatgacactggcagacttgacagcgcagggctttccaaggctcaaaagaccgctctttgcacagctttttgcgacactatcataaagtctggctacagcgcaggtgtttatgcaaactacacatggctaaactactacattgacggagcagggcttggcaagaaatatcctatatggctggctcactacacaagcaacaccaattatgaccaacgcatggatatgtggcaatattcaggaagcggtactgtttcaggcatttcagcctacactgacgtgaacgtatggtattcgggcaagcttccactttatgtgtccgaccttatctcagtggcaaacacctccacctccaacaaatttgcctggaacggcgctcctgacgcaacaggatatgaggtatatcagggaacaagccctagcgaccctaacaagaaaaaaataggggatacaaaggatacattttttacaaactccaacaagtccacaggcaccatgtacaaatacatggtgagagcctacagtgacgcttcaggcaagcgtgtttacggggattactctgatgttttcaccacctgcacgcttcctgcgaacatctcaaagatatccgcttctgcaaggggaacttctgttaccattagctgggacaaagtttcaaaggcgaccgactacatcgtggagcattatgtgaacggtgcatggaagcaggtcggcacaacttcaagcctttcatacaaggtgaatggtatcacacagaacggtgttaataagttcagggtaaaagcaagaagaaattacagtggcgtatactacaatggtggttacacatatgtaaacgctgaggtcactgacataccaagtacagtaacaggcataagaagcacttcaaacacttctacatcaaacaccataacatggaacgcttccaaaaaagcggaaggctatgagatctatcagtggataggtactaacgacagctacaagctcataggcacgaccacgtccacaaagttcacaaactcaaagaaaagctcaggcacgatgtacagatacaaggtaagggcattcaacactgttgacggacagcgtatcgagggtgcatattcctctgagcttaccacctgcactcttcctgcaaacgtatcattctccctttgctccactgacgttgattccataacactcaactggaacaaggtatcaaaggctacaggctatcaggtagagatgtacacaaacggaacatggaaaactctctccaccctttcgggaacgagctacactgcaagcgatctttcacagaaaacagcttatcgtttcagagtgagagccataagaaattataactacataaactactacggtgactacactgaaaaggacatcaccattcgtcctgcaaacacaccaaaggggctttcctcatcagtgaacacatcaagttccaacactatcacatgggaaagcgtgaatggagtatctggctacagcgtttatcagtggataggcactaccgacagctacaaaaagcttggggacactgcttatccatactacacaaactcaggcaagtcatcaggcactatgtacacatacagagtaaaggcatattatgtaagcgacaatgttatgcaatacagcaagcctgcacaacttgtcacctgcacacttcctgcaaacgtcactgtcaaaacagcaaagcgttcgggaagcaaaatctcacttgcatggaacaaggtatcaaaagccacaggatatgagatatatgttaagtcaggaagcagttggaagaagctcaccacaacatcaggcaaaagctacactgcaaaaaatctgtcaggcactaaaacattcagaataagggcatacagaaaatacaatggtgtgaactattatggtgcttatactgaaaagacggttaaatagtcactcgccgtgacgggcattttacgccacacattgtgatatgatacaaatttgcaccgctgaataaaaatgaggggcgaccttaggtagtcccttttttgcacaattttcaatatccgcacaacattattgtaggggctggcgccctcgacaacccgtcccctcgacgtttcgtctgcaatctcatttgtattatccgcacaatgttgctctacacaaattctggataatccaaaccatatcgccccgagtgggacgtcgtatttctgcaaagcagaaattgcgccgctcccctacatagtttgtgcgttaaatcacaatactttgcttccatttgctgtaagcttgaactttgctcccagaacacctgccgcacctctgcacataagcatacgctgcaggaaaatgtcaaaatagtcatacatggtgcagatactttcgtctatctgcaaattaagggatatgacctttttatcagcatttatctttaagctcgcttctgttaccgcatagttcaccctgtcatggatatcaaaagaggacttatccttatttgacacacgatttcttcgcacgtctgttttatcacctattatcactgcggctgacaccgggtctgttgcgccccctgttgattcgtcatggcttccaatgcaggaaactatcgtcaccctatcttccaatggcatatcagtgtctttgagaatatcgtttgcaagtattgcaccatactctgcatggtgtgtacgattgacagcgttgccgatatcgtgcatataccctgctatctttgcaagctctatggtatgctcatcatagccgaactctttaagtattgcggcggctctgtctgccacaagagtggtatgcacctctgaatggtctgtaaaacccagagatgtaagatttatccctgccctttttataaatgcttttatttccttgttttttcttatctctttgtatgtcattgatttctcctgttggtttatgattatatttatctacgcaaggctttttacgtccacataatgtattgtagtggcgaacagtgttcgcccgcatttgctcgcctgcatgaatttgcgattatacaaaccatgtcgctctccgaacgggacgtcatatttctgcaaagcagaaattgcgccgctcccctacagtcactcgccgtgacgggcattttacgccatacattgcagcatgagatacacttgcaccgatctttaaaatgtgtaattatagcctgcaattatcatatcactatccaagcttatatacaatacattccgcatttattttacaatattttgacactatacaggcacaaaatagccgtcaatatgctctttgtcaagcccctcgccaatgacgataaacaccgcctgacctcgctctataggcttaacagtgatgttcttgtgggtggcgttaagctcaagccacttgccctcagcgttttgcataaagccttttacacggaatatccttccgcacttgctgtcgctcataagcctgctcacagcatcttccatagcattgtcaggaagcttcatattcataaaatacaaagaggtataagctttatcttggtcgaaccacagcttttcgtgggaatccggctcatagccactgttggctatcctttccatatcctcatctgtaagctccgaccagtctttcattattatctcaggcttagtcattctgtggcaatggaactttttctgcacggcttcaaggtgttttagagtatcctcaagctcctgctttgtggcttcctgacatctgctcatgagaactatgcctgcttccgaaagctgagaagcaagaagataatcagaagcttccgacaagttggtatcaaggcaggcgtctgcaatagttataacgcttcctatctcataccaattatcaagaggttcttctctgagcacgtcaaagaactcgtcagcttcataaatgcctgacggctccacaatgaccctgtcaagaccacgcatacccatagcaataagcttagtcttaaaacgccgtctgtggcaatccttatcagccgccgagaccatttcaaggtcgcaattctcgtccaaaagctcctgcaaaagaagcatatccacattcactgcaccgaaatcattctccaacacgccaattttacagcccttatccaaaagataacgggcatatttttttataaaagtggtcttccctgctccgagaaaccccgtcacaaggtctaccttggttttctttttctctgtgttcatagttaatgcctcctaatggtcatattataccatatcggcaaggcttttgcaatgagagaaataaaaaaacacgccttacactaagtaaaacgtgttttgcacggggactccccctacattgtaaagttgacaacaaagcttggcaacaaaaaacgcaccctgcaaactcgcaaagtgcgtaaatacgctggtgcgccagaagggactcgaacccccgacctactggttcgtagccagtcactctatccaaaaataaaatcacaaattttctttcagttaaataaaatatcatgaaaattgctgctaagacttctctggcagcttttttgatgatatttatacatatcatcaagcatagacagggtagctccctgtgcggcaggacgttctcccctgccgctttttctgtgcttaatacggagaacttaaacattttcagaaagggtgtttttaatggagaacacaaaaacaaagatcgtatccgtggcaaatcagaaaggcggagttgccaaaacaacatcggcattcaatattgccgctattcttgcacagcgagagaaaagagtccttatgatagaccttgaccctcagagcagtttgtcggtatcgtgcatgaagtacgaatatgaccctgacgatatcactatcactgagcttatgtcatctatcataaataagaaaaccgttgatttcaagacggctgtacaccacaacgagccgaacaacattgactatattcctgcgactataacactttcaggaattgaagttgacctgtgtagaacacgctgctgtgaaatggtgctgaagcgtgtcattagtaattacatcggctgctatgactacatcatcatagattgccctccgtcactgagcaacttgctctacaatgcgctttccgccgcagatatggtcttgatacctgtgcttgctcaggaaatggcattgagcggaataccgcttcttcttgacagcattgacgatatccatgagtatgctaaccctgaccttgaaatactcggagtattcgcaacatggacagagaaaaacaacacaatgtcagctgaagtaattgagtcaataaaagccgcattcaatgataaataccttggcagcataagcaagtcaaaagcagctcaggacagcagccgtgagggcatcgccctttgcaactataaaatcagcagcacaaataaatacaagaatatgctcgcagacgagtatcgtgttatagctgacaaaatagagtgtgtcacggtgacacactaaggaggtttcaatatgatagatataaaacgctccgcaaatcgtccaagagctaacttctcaaataactttgaggagcttctcatggataagcaaaaggtggtttcactgcctatgtcaaaaattgagcctttcagctttaatggtgatccacagccatttgcaatagatgaaaatgagatatctgcacttgccgactctatttcaaagtgtggacttatcacaccgataatagttcgcagcattagcagcaacagctatcagatactcagcggtcataaaagatacgctgcttgcaaaaagcttatgcaccttgacattgacgccgttgttatcgaagtcactgatgataacgtggctttcgatatagtttgccaggctaacattcagcgtaaagagccacgtccaagtgagctttctaaaatgttcaatacatacctaagtctgaggaagaacgtttcagcagacctgacagtaaatgagataagcaatatgttcggtatatccagaaaaaccatttaccgctatgcaaatatctcaaatcttgataatgggttagcagagctgatagacagcaaatctattcagataaagttcattgagccgcttgcaaagctcagtcctgagcaacagaaagccatagcagactattacaattatgacgaacggctcagttcaaaagagctgacattggtcatagagcaaatgacagacagcggaagcagtgatatctatgatatcataaaagctataaggaatctgtctgaaaagaaaaaagagccatacaagaacagcttatacaatgagatgtatatcaaaaagtcgtcatgtatgcagaacatgaccgaaagtgagcttgacaagataatgtataggcttctggaagaataccttgacaacatcacaagtacaaaaaaagttaccacaaatgaaaaataatatgatataatcatagcacaggaggaaaagtaatgaacatgacgttcaaaatagacatagaccgcagaaaagttgaagctatccgctgctatatgcctgacggaaacattgaagatctgctcaatgaggagataaccaaagctgctgaaaatgtggtgaacaggctgtacagcaagactgttccgaaaaaggttcaggaatatctcagaaaatcagcggagataaaaactgatagcaagaaaaaggcggagcaagtcaatgagtagcggtgtcataaaaacatttggcagcaatcatcaaaccgctttatatatggctaaagacaaacggctgtatgagatagtatcaatagacaatgattgcgctgtgatggcggcatttaatgatacgtttgcggtggctgcgaagccgtttcttgatgaagtaaacaatgtaatagactattcgagcattgaatactttgaccgtttatcacaggcgaaaagctacagtgatagacttcataaatgctttgacagctccaaagcagaagaaaacatcaaagaacaatgtgtcacggtgacacactcagataacatcactcaaaagcataaaagtttgtaattgaaagaggaggaccattatgaacgaaaacaggaattttaacgaagattttgaaatcgagcaggcaggaccagaagatgttggctgcgatctttttgagtatgagcttactccagagggtacatacgtcccgaagatagcatacacaagtgaccccgaagaagaaaagctgcttaagaagcctatccgcagatggggacgtgcatggatgaaatggatggaagcagaatacccagcaaacgttgacattctcgtgtgcgaatgccgttggcagatcattccgagagaaatagatatcgaagctgaggagaggtttgacgagcttgacgagatctacagaaaagatcacccacgtcctacagagttcaatgctatacgcaagtgggaaaaggaaaggcttatgactctcgaacatcaggtaatggaggagatcgtttataagctccgtgaataggctcaataaggaacacatggcacgttgaaaacgcaacagaaaacaggtaaaggacacttgaagtttcaggtgtccttttttgttgacaaaagtcactttaaatgataaaatgggagaatgaggaatgattggttgtattatattcataataatattcttagttggaattttatacacagtgaaaaataagaacaaaaagaatgagttaatggtatcgttatatgatatactctgcttattgacggtgtatataatgtcaacagaatcgacacgtttactttttccacgattgatagttatttggctaatggcaatatatattataattcgtgaaaaatattacagtccattgtcgcaaaaatggaaagtaatttttgtatgtgcaacaatcattcttctaataattctatgttggaagtggacacgtgagtttatttaaattcttgtttaattgcaggctaaagtttcgacgttttttataccaaaacagatacttgattgaacgaatgtatagcacagcatggtttttgatgttttttaacattatattaactttaattattcggaatggattttctgaagcaatgctagtaataatatcaatatgtttttttctgattgattttataaggtcactaaataaaatgacgacatcattacgttcatttttattagatagtgtctttttagagcttatatcggtagccgtactttttgatgtctttaacaaaattgcacatttaggaaataattcatatgatttcatcatacaatatgtattgatagtattagcaataaccatttcatggtcaattgtcagttgcatggctaacaacaaagttgctacattagcaaatattatattatctactgcgattggattgatgatatacattaaggacgctatttttgatgttctacctgatagcctgtttcaaaaatatgattcttccgattttttgatatcgattggctacacaccaaaaggaatagtgcaggcagcattaaattacgcattcttaccattcctaataagcaatataattgccgctcttatttgtgaaataaaaggatattggattgataaatacaatgacggcaaagatattacgatggagatgataaaaagcaatataaatgaggaaaaagaacatagtacgaatgtatctgtagaaaattcagagaaattggaacaaaatcaagctaatattgaaatgcaggttaaaataatcgacaatcttttagcaaaaggttttaagctatcagaagctttagagcttgcagaacttaacgaggaagcatataacaagttcaaagctgcaaagtaattttgtccgtggacaaaaatcgaatacaaacgtaaggacacttgagtttcaggtgtccttttttgttaagaaaggtaaaaaagaaaaatgattttttatgatgacgaacacgaggaactgtttaataagttgtgcaaaaaaatgccctatcttgacggctatcacttgtcacttgcgtatctcctcacgatggacgctgttttgcgttatcatattggcgcactgtatgacgttaaaaaagatgtgattattttcgagggcttgagcaagccttttcagactcatacgagcttgaaaacaacacgccttgcctttaacctgtggaacggcactgtttatgactcagatccacctgaaacttatatcgacaaaaatggagaaaaagaatatgtaccaagcaaatactatgcgcccgacagaattttccactgcacgtatgcaccgtactactttgaagcaatcaagatgaggttcgagatttttatgtaagtaatgaaatgaaggtaatgatatgaaagctaagaactattgtcctgaatttgaagaatacaaaaccatacgtcagtgggcgctcttaggacagttgccgaaaaaagacgctaaaggcgttgagctttgggcaaataggaattgtcaaacctcatatgtgtactatagccctgatgaggtagagcctgcaacagaaaaagagttgcaggatttttttcagcctgagagggacagaaaaaataagctggcaagacttaaccgcaagtggcgtaaagaagccgaggaaaagaaacgccaagaggagcagaaaaagatttttgacgaagcggttgaagctgccttattgccttatagaaaattgatatggagattaaccgagaaaacaaaagagctttatccgaaaaaagagtatccacaggcaattgttatagacaccgaaaccacaggacttgacccttttcatgatgagctattgcaggtgtctatcattgatgaggagggaaacgttcttttcgacagctacttcaaaccaatcagacacacagattggtgggaagcagaaagcgttaatggcatttcacctgaaatggtagcggacgcaccatatataaacgagaaagccgctgaactatatgcaatattatcgcaggcacattggataatcggctataacgttgattttgatttgagatttctcatgggaagcgatatcataacagatgaggagtacaatgcatttcgtactgaagatgtgatgatacaatttgctgaaatttacggtgaatacagtgtgtatcatgaggattataaatggcagaaactcacaacagcagcggcgtactatgattatgattggaacgtgaaaggaattgaagcacataatagccttgcggattgttttgcaacattgtttgtttatcataaaatactcagtggagaatagcagtgttatgttacaatagatagttgacaaaacaaattgaaaaacaacttccaaaatgatataatgttaagtaccaccaatttaatcttcataaattccacttgaaaaagcctgcaataaaaaaagcggcataaatttaaaatgttttccacattttcaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgcctttttgtatgcttatttctttctgaagaccacaagcttgctgatgacatagttaagtatcagcacaacaacgtttgccactatttttgttacccaatagttgaagctgagaagtgagtagccgagccacatcatgaacatttctacgagaagagtgaatatcctgccgccgtaaaatgaagctgcttcggagattatcgcctttttgccctctgcttcagactcgaaaacccatatcctgttggttatgtatgcgaaagtaactgcacatatccatgatatgacggtgcttgtggtggaaacaccgcccttgcctatgcctgcctgctccaaaagcacttttgagatgcctgcggtcacaaagctgactgcggtggtgagtacgccgaaaaacagatacaaaagcatttccttgtttttgacgtaaaagggtctgaaccagccgaatatcttccagtccattattttgtcgaaaatgtctttatctttctttgccatttctgttatctccttttgtgcatatgaatattatgaacacaaagaatattataactcttttacatcgttttttcaacaatactgttgcaattggttaaaaaatatgttatgataactatatgtagtcagtttttatgactgcctttagtgctatttttataactagggcagcaaatttatattctgacctgaaaggataattttattttatgaaagttgttatcatcgctgtgcttcttatgctgtctgctatttgttctgcaacggagacagcgttttcttcatgcaacaggataaggcttaaaaaacttgcagacgacggaaacaagtctgcaaagaaggcaatgaacatatgcgataattttgataaggcactcaccgctatacttgtgggaaacaatgttgtgaacatttcttcatcttcacttgcaacggtgctttttacggagaagttcggaaagggaagcgtgggtcttgctactgtagtcatgacggtgcttgtgcttatttttggtgagatcttgcctaagagccttgcaaaggaaaattccgagaggttttctattcttatggcggctccgctttccgcattcatgttcatcatcacgcctataacggctatctttatgggcataaaaagcggtgttacaaagcttgtgggcaacaagaacagcgagccgtctgttactgaggaagaacttaaatatatcatagacgagattcaggacgagggtgtacttgaagagcaggagtcggagcttgtgcgttcggcacttgattttgacgagataaccataagcgagatacttgttccgagagtaaatatcgagggtgttgagcttcatgaggatatggagagcataaaaaaacgctttgtgcagacaaagttttcaaggcttcccgtgtatgacaaggacttagaccacattgtgggacttatccaccagtctgacttttttgaaatgtatctcaagggcaagacggacataagccttataatgaacaagccactttacataaccgaaaaccgcaagatctctgagatcctgaagcagatgcagcgcaaaaaggtgcatatggcggtggtgcttgaccaatatggcggcacggagggcatttgtacccttgaggatatcatagaggagcttgtgggcgagatctatgatgaaagcgacgaggaggatacctcccttgtgaaaataagcgacggtgtttacgaagcgtcggcggagctttcggtatcggattttcttgagaggacaggactgccggaggacactatcgaaaccgaaagaacatctctcggtggctggataatggatatgcttgacagacttcctgagcagaatgaagttataagctgtccgccttttgagatgacagtgaaaatggaggacgagcagaaaatagacaggatacgcttcaagatatccgaagaggagcttgaaagcaagaaggcggaggaagaaaatgcctaagcagataaagaaagagcagataaaaaagtcagagcttttatacagaaaatggtctgttgcagggcttgcggcagcggctgtgttcatggggtgtatggctgggcttatgagcatgatagtgaaaaccgagggagcaaaagtgccaacgatagtgctttttgcggcgttcattatctacacggcagtgtcggtggtatgtgcggtacttggagtgaaaagctatgtaaaggacgactgcggagtgtgtctttttcagggtatagtgcatatttacagcgttatagcctgcgtaatgaatgtgagaatggcatttataatactgttctcagcgttaggctcgcaatcgggggtagatacccttataggaagccaatcgcagaacgaatttatacaaagtcagtatgcaagctggatatgcctagccattgctactctgttctcagtggtacttggtattttggcggtagtatggcttgtgaaaaataaaaagaactgataaatcggctttgcgtaggggcgaccttgggtcgcccattatttcgtatgtttcacagcatacaggttttagaaaatcatatagtaaggaaaaagaaaaataatgtttttgcttatacttgtagttgtatgctacacaatatgttcccttagtgacaagtacgctgtttcaacggcaaaattcaacggcgatgagcttggattcttaatggcggcggcaacggctgttttcatggcttgttgtctgcctttcctcgacaggactattacgcttagctggcaatcctttgcggcgataggtctgctgtgcttgtcgaagatccttgaatttaagctttcggctattatccttgatgaaatatcagcctttgagcttaaggcttggcttggtatcacccttttcatgtcctatgcaacggatattttccttggtgaaaagccgagcattttcaagtttctttttatcgtgcttactgttgcaggacttgtttttatcgcaaaatcaggcagaacggacagcggcaatataaattaccgcaggatagttgttcctctggtgttctatcttttggcaagatatggctatggtatagttgtaagagcgtcggagaattacatatcctcgaccatggcgctgttctttgcgcttatacttatggctatcatacttctgccaagggcgaagcctttggagatattcaagaaaaatcaaaagggtgcatgggtggttgtgcttacaaagattccgaatgtggcaggtctgcttgcggagaacgctgttattgctgtgagccttgcgagtgcgtcatttatccagcctatgatactgtgttcgctgtttgttatagcgctcataagaaaagagcctatcacaaagctgagatttatcggcagcgttatttgtatggtgggcataataggatttcaggtttgttaaaaataaaacgtcgggcgtttcaattcgtccgacgttttttgttatctttcagtattgtacattgcggcaaaccagtaatcttcttcaagatagcttgtgtctttcttgccccatgtaatttttattttcacaagacagccgtcaatatcctcttttggaagctctagctttttggactccttggcaagcacctttccgtcatagctgtagacagtgtaaagcacgtcaccgagcctgtcccctgtgacttctacggacataggggttttaagggtaacattgccgtccttatctacatttgcctttatattaaatgacggcacagaggagagcagatcttcaaagctcttttcagcggaaagactctcgctcttgccgttgcagtatcgtgtcttttcagtgccgggaagctcatatttgcttccgtcacaggtcagcacaactgaacctttctccacctttggggttatatttatcacaagggcgcaagccaaaaagataacggcggtaagcagacctacaagtattttccttttcattattatcaccaatgctattatagcaccttttggaataataatcaagggcagtgtttgaaaatgagatcaagcaaatgagttgcaaatttacaataaaacatataaaaaactattgacaaaatcaaaaatataggttataataacctcatagtaaaagagagtagctggcggagagatccgtttatgtttgcgtcaatacgttccgatgagggaccgctgcatatctaaacggcgagacttttattgattaaattgccacaggcgcagtttacccaataaacgtcttgccgattttttatgcgtttattttactgagcctatgagaaaaggaggcttggaagggtatatcggcaatgtttacaggaaaaaataaaaaaggtggtattttatgaagcagtatcaaaaaaaaattgaccagctttacactgagttttcatcaggtgaaaatggtctttcaaccgagcaggcagtgaaaaactgcgaaaagttcggacgaaatgttatcacagagggcaagaaaaagtccattcccgtgatttttttagagcagtataaggactttcttgtgcttatactcattattgctgcgatagtttcagctttcatgaaagatgttgagagctgtgcagtaattctcgttgttatcacaatgaacgctattttgggtacagttcagaccgtcaaggctgaaaagtcactgacgaaccttaaaaagctttctgcaccaacggctaaggcgcttcgtaacggcgaaaaggtcattatcccctctgaggagatcgcagtgggcgacattcttcttatcgaagcaggcgaccagatatgtgcagacggcaggctgatagaatgtgcgtctgttcaggtgaacgagtcggcactcacaggcgagagcgttaatatcgacaaggatatgagcgatatagagggcgaaaagcctcttgctgagcgtgctaacatggtttattcaggttcttttgtcacatacggcagaggaaaaatgcttgtcactgaggttggtatggacactgaggtgggcaagatagcttcgcttatccaaaacgcatcagagagaaaaacgcctcttcagaacacgcttgacgagtttggcaagaagctttccattgctatacttattgtctgtgcagtagtgttcggacttagtatgcttcgtggcggcgagcttatggattcgttcatgttcgctatcgcacttgctgttgcggctattcctgaggctctcagctctatcgttactattgtgctttctttcggcacacagaaaatgtcaaaggaaaacgctatcataagaaagcttcaggcagttgagggcttgggcagcgtttctgtaatatgctctgacaagactggtactcttactcagaacaagatgacagttagaaaaataatggtagacggcaggataatcgacactgacgctgttgatcttgacgatgaaaaggtcaagactatgacaagagccatgatcctttgcaacgattcaagctgtaaggacggcgttgagataggcgaccctacagaaacggctcttatcaacttcggcacaaagcttggtatagacactgacaaggtgagagaagatctccctagaatttctgagataccatttgattcagacagaaagcttatgtcaactctgcacgttatcgacggcgagaaggtgctatatgtaaagggtgcggctgacgttcttataaacaggataacttcaagcgacgaagaaaaggctgttataacccagcgtgtggcagagctttcggaaaaaggtctgcgtatacttgcatttgcagagaaaaaattcgacaaagataccgtatgtccagaggacgaggacggattggagtttgtcggtcttattgctatgatggatcctccgagagaggaatcaaaggcggctgttgcggaatgccgcaaggcaggcataaagccagtcatgataacaggcgaccatatcgttacggcttcggctattgcccgtgagataggtattcttgacgacaactcaaaggctgttgagggtcacgagcttgacgcttattcagacgaagagcttgttgactttgtaaaggacaaggctgtttacgctcgtgttacacctgagcataaaataaggatcgtaaaggcttggcaggcaaacggctgtatagtttccatgacaggcgacggagtgaacgacgcacctgcgttaaagcaggctgatgtgggcgttgcaatgggcatcacaggaactgaggtttcaaaggacgctgcctcaatggtgcttgcagacgataactttgcaactatagtaaaggccataagaaacggcagaaacatttacgagaacattaaaaaggctatactcttcctgctttcgggcaactttgcggcaattcttgtggtgcttttcaactcactgcttggacttcctgttccgtttgcggcaatacatttgctgtttattaatctgcttacagactcgcttcctgctatcggtttgggtcttgaacctcactccgaagaggtcatgaaacgcaagccaagaaacgcaaacgaatctatcctcacacgtcctttcctgggcgagatagcattgtatggcgtagttatagcgatagcagtagctttggctttccttatgggaaacaagacaagcgcagctcttggtatgacgatggcattcgcagtgctttgctctgcaagattgttccacggattctcctgcaagaaaaaaggtcctgttatcttctcaaaggactttttcaacaacaagttcggtcttatggcgttcggtcttggaatggtatttttaaactccgttctgctcgttccaccactcaagggacttttcaagatagcagacatgacaggtatgcagtttgcatggatatacattctaagctttggctctatgctcgttatccagcttataaaggcgatattctttacaaagtctgagaagtaaggtcaagaacatgacacatggtcaataaatgggacgtcgaggacgccgtccccctacaatttgtataaaaaaaccgctcttcgtgatgtcacggggagcggttttgttttacatatcttcgcaaggcagccaaatgccgtcctctttatgaagtatcctctggttttcagatcctctgaatttcagtgagatgtttttcttttcgagaacaaattcgccgtcaacgaggtagtcgataaggctcagcatttcgtctgtgtactgtgttctgtatggggactttgagcctgcaagcaggtcagtttcaagggtacagcctgtgtagcaccacacgtccttgtcgggaagttctgttttcacacggcggaggagttttgtaagctcaggctggttttcaggctccataggttcgccgcctaagagcgtaagtccttttatatagccctttgagagggcgttaattatctcgtctgcggtggtatctgtgaaaggcttgccgtagtcaaagttccaagtgtcaggctgaaaacagcctttgcagtggtgtctgcaacctgatacgaacagcgtgaccctcactcctgatccattggcgatatcggttttctttatctcacaataattcattttccgctcctttcatacatacaacgcagggcaatacgcttttgtattgccccgatagttatatgctgtttgctgttttatgtcaataataatgttcattattttcggattttgcagttttgagtttttgagttttccttgctataatgttcatttttttgacgagttttgatttttgaacttttgagttttaacggctataatgttcaaaaattttcgattttgctagaaaaaatttttgggttttgggtgaaattgtaattttacaaatgtgtttaattacaattcataatgagatatattacgctcaaaacgagtaattactcgggaataattacaattcataatgagatattaatatcttagacattatttttgtaaggtaataatacatttcataatgagatattagtattttgagcataaaaaacattaaaaaattacaatttataatgagatataatagatgtatactgtatctcattatcttctacagaatattataacacttttaaatgagaaagtctatatattttgcgatattaatattaatgcagcctattaaaacttcatatttatatcgcaaagcttcttgtagcgttcttcacttagctttcctatgttgtagttccttctttgcagtaccacccaaacgccaagtttttcaccctcaaaaatagttcgttttgttatatctgaacttccgttattttgttgtatatatcttttatattgttcgtatcttctttcccattctgcagctaatggatcaagtgttattcctaatgatacaagagcgtcttcttgtgatcgagtcagtttacccgccttatatttgtctctctgcgattgcaaccaattgcctagaaagacacctttatagtgatcacgctttggtatattggcagtgccacattcctctttgtattcacagagtaaggcataccctttttcccaagaatcgtttgctttttttacgatcaatgaattacaggcgttgcacctctgaccgtcaaggaatgccgacggcttgtattcttgtattccaccgcatttgttatgctttattgcaatcttagtcctttgatcaacgaattcacttaaaactgtgtagtcatccccgactagatcatatactctttcggtgtatagctcagttgtcatatttttagggcggcatactcgacaactcggatattttatgaatttatggaatctgcaactgaatacatgtccacaagccttgcttcgcatagttatttttgaagactcactatcatagctaataaattcatagtcttcaaatttttcaagcttttgccttacatcccattcatttaacagactttcacatatacacctaacatggtcgaatatgaatttgcgtggttttatctgtattgtttcaccacagattttatgatgtatctttgattttatatttaatgatctaaatggctctagtggctcataattccctttaccagcaaagtctatcagctttttgtacctttcatctattgatttattagcgtcgcaataagtacagccccagccctctgtgagtgatgtaggtgttgcatagaagtttttgccgcactcagcacagtggtatttttgtataataggcggagcattttcaaaccgatgtatgatttcctgcacatttggaaataggtacattaaaagtgggagcattgatctagcacttgtactctgagtactgataatacttacaagcaagaagtttttaagatctgcatcaaacaaagttacaagttttgagtcattaaatgcagagataaaatcttcatacccatttgttgctttatgtccaagttcttttaacttgttgtatatcatatgttttagatcagctatattgcagtttgtatttgaattaaaaagagcttgagcatagtcggtgtattcattttctatagctatgtctttgatctctagctctgtataatgggataagtcatattcacattcgtgacccttgatgccagtatacttatacaatggggccttgtgtttgtgacaggtacatacgcctgaaagttgatgagccctgtgtatatatggttctccaaatatttcaatgtcattttctatgcattgtgggcatatgtgtatttcccttatcatcgtatttaccggagcatttagcggatcaggctttctaaacatattgtttacatatcgtgtttgttgtcctacagagaaaaacatagcctcaaaaggaaatattgacatagataagaacatttctttgagatccttttgaatgaaaaaactctcgttaagacataatagtccatatcgaatgtcatattccagagagccaattttggagttgaatttattaagatatgagtctgcaaaagttgttatcggcaaaccatttttctttgccagacgatgtatccaggaatacattaattcatcaggataagggtttatgtatacaggaataacaggcatttatttgtcctctttatctatgccaagaaagttctgcatttgaattacacttggagtgttctttttacacagatctgatcttgtgcgttgctgttttgtaagctgttcgattaccaatttgcttatttctctttcggcctttccaactgatgattttttccttattacctttttgaaagcgtcttctatttgtgtcggagtgtattcatcatagatagcagtgatatttgccacaacgttttttatttgtaccttttcctcgctgctgttattatttaatattttctcggcttctttgagctgtttggcttcatcttctattttatcaagctcaagctttgcattgtcatttatctcttgcataagttcattgttaaagtccgaatcaagattttccaatacatcacgaagtcctgcgaaatgtttgttagttacagcatatatatacttgctgtttatttcaggctttttctttttgtttaaataatcaatgttcatatatatgtaaatgccgataagctggtctacgatcccctttgtaacgtcatacaaagcgtctgttatctcctctgaaactgtaacaggtttatcgaaccattggtatcggaaaagttcgtttacaagaaagtaaaagaattttttatccatacaatacatatttccattaatgacattgccgactcttcgagctgttctgagtgttttaaacattttggcttttgcgtcttctgtacgcacaatagctgttgcgaccttagttctgtttgagagtgtaagcagagaatcgaaagagttttctcgtgtgtgcgaaaaatctattagctgtatttcgtcgaaaatgatgattccaatagcgaacttttctacatattcacggatacgctctgcttttgcacctaatgtccttattttcattatctcagcggaatatatgggtttgatatttcccaaagctttatcgatagcgtcacctataccgtcatacaaggcagaaaaattgctgtttgggatacagttgacaacaagatatgttatctgaggaaaatactctccgttttctgttgtgtgcataatgacttgcggatagtatgatacaagcatttgtattgcggaacttttgccacagcctgaatatccgataagagaaaagcctgcgtctgtggaagcacttgaatcgcctaccaaaatatttgaggcggcgtattcctggttttccacggaataagataccttatcattgtcagaatgaagaatgtgacgtgatctgtatgacgttatcaaggcattgtagaaagaaagctcaagctctgcatgaaatggaagcggaaagcgtatgctcctcagagatcttatctgaagtatcttatcaatggttgacatactctttatcttatcgtaatcaaaatcggccatagtttggctatatgacgatatgatgtttcttcctgttctcggatatggtagagcttctatgtatggattgccagtgtctattgctagtttggcttcaacatatcgtgcaggaactatccgctgttctttcagatcgtaatcatcatactgtgacacgacttcttcacatgttacataattatattttgccattcgttatctccccaagtttgacatcagttgttgtcataaaagtcctgcaaagcttcttcaaagcttgcataatcccgatactcggtcacaccgttttctttttgttcatctgatgaaatgtttttggacgtttcatctttgttttcaagtcttgcgcttatcttgccctcataagatactttttgcttgtcgatctcacgggagcttcgtatatcctttgttcgggagtgaacgtttttctttgctgacttaacgatactctcgttgtttgcatacacggcagtgtctattttttcgttgtctatcctgcccttagcctgcattttcttttttgcactataatattcttcatattgtttcattgtaagtcccttgtagtcgctgttgcctgtaatgaggacgtttagtggtatctttaccagcttggaatttctgatgtagtatatggcacccacatcacgcatatccattctcacttcaaatggcatacgccttgtgcctgcggcatacatctctgacatcagccgtttatcgttaggtgcaaagtaccacaagcctttgtagcttatgcctcgttttgatatcttggctttgataggcgtcattaggctgaaaaggtattgttcaagaacaggtatcggctgcggcattccatatttctttgagccgtattcccataatatcgcaggaacgggagctatgttcttttctatcatttcttttgtaagagggtatgtttcaaggtgctgctgattatgtgctaacacaaagtttatcaccattcgggtgtaatcgtgtatggtgagagaagcttctttgtgatgaagagaatcatatcttttctcgataagtccgtggttttcaaggtgtacattttgcttggcgtgcatttgatgaaaggcttgctcaacaacgcccttgagagagcctgacgcaccgctgactatttgtttttcaattccgagttcgttgcatatcctgtcaaactcatagcttttaaattcgcttccacggtcaactcttattcttttggggataacacctgacggccatagtcttttgtcattaaattcgataccgtattttttacaatattcctgcttatcgtcagctagattcaaaaacagatttgttatgccgagaatagagttattgtcaaatgcaactgacaccgcaagtattatcctagaatatacgtctatcataaaatacacgatagggcggcctattgcctggtcagggtcaagctcagataccagagaaacatcagcctcgcaagcgtcgatctctaccatatccgcaggtccatagacgtcttttaaggaatcgcttatgagaagtcttttgttgttccgctgttcagctgcagaggtttttatcagatctttttcttcctttgtcagatgtttttgggcgtaatagtaaaactgtttgtaggtaggtctttgacattcaggcaaaagtaatcttgtggctactccatcaattatttctgcttgggtaaagtgtagaatattcattcttgaaaaagcattttttaatgttttctctctgcctgctttgtattcattaagggcttcctcaaaatatatgacatattcattaggcttgactacattatcaagattatatgtggatttagctcctggtcgtgctttgtaagtatatgtttttacttcatttgatttaaacgatttggcgttaataagtgaataattcttcattccactttgaaaataagtggtacacattctccaaaagctcgatataggatagttgtatttggctagtattttctgcaattctatttttgaggatttacccattaatcctagataagaaggtccatatgcgatcttgacatcgttcataatatgtactttcagtatatatctgtttcttacgctttctgatagttggtcaatgtcataaacgagggcttggtctttctttatttctattttattagataataccaaatcagctataatggtatatttgatttgttgtaactccagtttggttgtttccatttcacacagtattaaatgatcgtcaattaatgatattattcgatagctgttttgattatctttatcatacaatatatcgcctatagccaaaacataatcattcatctcagtattcaccccatattctatcaagatcgtcatttgttagaattttgtgttccatatcgcagcggatctttttcgtggcgatattatgccttatgttactgtatctatcaaagacacggctttcgtcataatactctgtgacaagccttatatttgatgccaatatcgtgttaacgtcctctttgaaaagcatatcaaactcaatattgttatgttcccagtagagcttttctatacagagaatttccaaggtacgtttgcttagatcacggtcaggtttcacagaatatgcgtgcagtttattatttttctttgtgacaagaaaatcagttgtcataatatgatcagaattgcctgggtgtttaaaaccatatttatcggcgatcctgcttgtgatatttcggtcaagagggtattgctcccgaatatctatattattatcgtcccagcggagaatgtaaaaccataaagcttccgcctgtgacagacaatgaacgccacgtcctgttttccaatccttgatgacggaagttgtccccaagctattgaactcattggtcatcacatatgacttgtactttgcaccctcaccggatccttgtccccttgctagtttcgttgctctggatatacgtttgctcatagcttttccctcaatgtgtggttacacttatttgacttatttttatatcttagttagtttttatgatgttatacatcttttttagcacacgtttgttcttttattatagcattgcaatatgaattgaatgttaataaatctttgaacgtgatagaattatagattatttctgccttattaatgttacaaaaatggcataacttacgttgttgtaagttatgccattgtataatcaatgaaaatataggatattaatgtcagagatatctcattataattgtaattttgttttgtgtacaagctgttaatatctcattatgaattgtcatatctcattatgaattgtaattttacaaaatgattttacaaaaatcacaaatgcaaaactctctcctttatctcttgagtcctgccctgattccagaactgcgtgccgatgtagccgcaggtgcgccttgcaacgttcagagtgttctgatctctgttgccgcagttcggacactcccatacaagcttgccgtcatcttctactatctttatctcaccatcaaaaccgcacttctgacagtagtcgctctttgtgttaagctctgcatacatgatgttgtcgtaaatatgctgcataacagcaagaacagcctctatgttgttctgcatattcggcacttccacatagctgatagctcctcctggtgaaagagcctggaactgtgactcaaaggtgagcttgtcaaatgcgtcgatgttctcggtaacatggatatgatagctgtttgtgatgtagtttctgtctgttacaccttcgataacaccgaaacgcttctgcaaacatcttgcaaatttgtatgttgtggactccaatggcgtgccgtaaaggctgaaatctatgtttgtttctgctctccactttgcgcaggcgtcattaaggtgctgcataacttcaagtgcaaaaggcgttgctgaagggtctgtgtgtgacttgcccgtcatgtatcttacacattcgcaaagacctgcatagccaagtgatatggtggaatatccgccgaacaggagcttgtcgatagtttcgccctttttaagccttgccaatgcaccgttctgccaaaggataggcgcaacgtctgacggagtgcctttaagtctttcgtgacggagcataagcgcacgtctgcaaagttcaagtctttcatcaaatatcaaccagaacttatccatatccttatatgacgagcaggcaacgtccacaaggtttattgtaacaacgccctgattgaatctgccgtaatatttaggcttgccgttttcgtcaagatatgttgtaaggaagcttctgcagcccatgcaagggtagcactgaccatttccgttcttgtctaccttaagctccttcattttcttttcgcttatatagtcaggcaccattctctttgcggtacactttgcagcaagctttgtaagctcccaatattttgagccttctcttatgttgtcctcttcaaggacatatattagcttaggaaacgcaggtgttatatagacgcccttttcgttctttacgccttggatacgctgtctgagcatttcctctatgatagccgcaaggtcatctcttgtctgaccctcaggcacctcgtcaaggtacatgaaaacagtaacgaaaggtgcttgaccatttgttgtcataagagtgatgacctgatactgtatcatctgaacgccctgaactatctcagcctttactctcatttcggctaccttatttatagtatcctcgtcggcagggatattaagctctgcgaactccttttttacctcacggcggtatttatcacgggatatctgaacgaacggagcaaggtgggaaagtgtgatactctgtccgccatactgtgaagaagctatctgagcgatagattgtgtagcgatattgcaggctgtagagaagctgtgtggcttttctatcatgacctcgcttatgacggtgccgttctggagcatatcctcaagatttacaagacagcagttgtgcatatgctgagcgaaataatcggcgtcgtggaaatgtatcagacctttttcgtgagcttcaactatatcgtcaggaagcaaaaatcttcttgtgatatccttgctcacttcacctgccatataatccctctgaactgaattgacagtagggttcttattggaattttcctgcttgacttcctcgttctcaaagttaagaagagaaagtatctgcttgtcagtagtattagcctgtctgacgatagaacgctcatagcggtaggtgatataatgctttgccactgtatatttgccgtggcgcatgatatcggcttctacccagtcctgaatagtttcaacgtccatagccctattcatttcagagcatttgtcctctatattctgtgctatctctcctatttctccctcagagagcctatccttttcctccacagtgatattagctttcgcaacggcattttctatcttttccttatcgaacgtattctcagcgccgcttctttttattatcttcacctatactcttcctttcattctatcctgctcaaccactatatattgtggttgacttcttttattacaacataatattgaacatttactattataccacaatcagaatataagtcaagggcatagaatgataaataatctacaaaaattccggttaaaaacagagcagtttgccgaaaaagtattacaaatgattacaaacacttgattgacaaaaagtgtgaaaaacaatggcatttaaagggtggataaaggtgtgaagctacaagaaacgatgtgaacattctgtaaaataagtggagaaattcaattaacttgttgacaagggtgcttgcatatgatataatattagagttgaatgcgccagtagctcagctggatagagtgactggctacgaaccagtaggtcgggggttcgagtcccttctggcgcaccaatcatttttgatactcacaaaggaaaatccacaggatataaaaatgtggactttcctcagcaagtatctttaagtatccttgctgagcatatatgaaagcttgtagtaacaagctaggatatgttttgtgacatttgtttcgtttcgctcttagaccttgtcaaggcagctgcacattgtggagcttaagcgaatcatctgatgttaattcatagtggcgtcggcacataggcttgcagttagcttaactgttactggctggctcgtgttcatgttctgaaatgttaagaatgcctgatcggcgtgattgaacagtaacgaacgtcatggctctaagcgacttaaagacaactcaatgtcttgttgtgcttgtgtttcacatcagttgacctcatctcaatcttatttgaggacttacgatattcgattttcaagctgcatttttgacgagttgaatcagcagctaaaagcaaaaagagctttccagatgtttgacatcgtgaaaagcccttgacaatctatttccaacgtgctataatagagcacgaggatagcattctctgaaagctccacagttgcggtaacatctgtgctgctgggcttataatctccgccaagagtttataagccttagagggtgcaattttttatgccctctaaatttcctctgtatattaattataccaccattttgtcaatttgtcaatacttttgcggaaattaatggcgaaaaatatatattttatatataaatgcaaaatgacccctagtgtgtcaccgtgacacactttcttggtcttgacattttagaaacttttttcgaaaaaatatttttcaaaaatggagttgtttcttgtggttatccttgaggttcctgaatttcaatatgatattgtcaaatccagaggtgctgtctgggacgataaaatcaaaaagtggtgtgctgatcgaaaacatttaaatgcattatgcgaatggataccgtactataaggaatcttactactatggaaaagaagttcagggtataaatactattgaattacaagagtttgataagttctttgataataatatagatattattaatcaatatttgtatctatgtattgcgaacatcaagtgtcctcattgctgggaagaaacgcctgttgtgtttaaaatatcttgttatgaatattatatagacgatggttctaatgatttttttccttttagaaacttttctatcctgcccttaaaagacataatggttatgaataaatcaaatccggtgatttcatatctgtatgaatatcttcatgacaaattcgggtatgatatgcccgtatttataactgagtcctatgatgataaaggcaatttaacgtataatgacaaggattatttgtgctacaacacttgtcgtaactgccaccgccgcttaaatattgaagatgaaaagctgtctttatggtttagtgatgtcttatttgatttttcctttgatgttttaaaaattgaattaaagtatgatttgatttattcgtattacgcaactcctgcaattatagatttaaaagaatattattatgagattcccgatgaatataagaattcaacagacccccttcatagtaattctccgttttgtactgaggcttataaaacgtgggaaaatgaaggtttttacaaaacggagttttttgctaaatggaaacaaaaattaaaaaatgcagaagtgataagatttacattttaattcatatagcgatttcgtatgttgatatactgtgcaagtgtttgattgcaaataaaaactccctatgtgtcacgatgacacatagggagtttttatacaaattctattttaagttttttgcctaaagcggcggcaagtctttgaagcgtttttattgacggattggcattccctgtttcaatgttgcttatatcgccttgtgcaatgccagtaagctttgaaagctcactttgtgttatgccgctctttttacgagcgtctatcagtgtttgaattattgtgaactcaggttcaagtgcgtcatattccgctttgagcttaggatcttttaactgttcatcaagaaaatcattaaagtttgtcatagtattattcccctttctgagtgcgttttaagtaatttgagcgatatgtctttgctagttcgatttcctccttaggtgttttctgcgttttctttacaaatccatttgtaagtatggcttttctgccaactacaaagaaatacattacccttgatatgtttgaccccacttttgctcttagctccagtattccatcaccgatcggtttggaatatggctctcttaattcatatccattatgctgtagcatctcaatagtcctaagcattttggctctcatttttatgtcaaggcttaataaaaattctttggctggctcagtgccgtcttctttatcataaaatattatttcaaattcctgcatttgtattcctttcaatataggctttatcctatatttattatatatcattttattttttttgtcaagcttttttgtgtcacggtgacacattcatatctttcatgtaatcttcaatagtgttagcaacgttaagcttctcttgaaatgttaagtgagtgtagatatcgctcgtcactgccaaactgctgtgtccaagccatgcagatacggctttcatgggaacgccatgctgaacgagcagggaagcgcaagtgtggcgaagatcgtgaaagcggcatctgagttgcatttcgttcattagtctgatgtaacggacagaaagttcatcaggctgtataagaatgcccttgctatcaacgcatatgtattgtaaatattgccgtgaatagctgctcctattagctgcataagacaagcactgcttgtgtttgagccatttcaagtagctgtatacactgtcaggcagcggaagtgtgcggcggcttgaccttgttttaggcacgtcagaaaatataagcgtagttttatggtttttgacgcatttgaccacagtatgttgaatgcacatagtgcgctgctcaaaattgatatccgaccaacgcagccccagaacttcactgcgcctaagccccattgttcctgctataaacacaggtgtgtaaattgcagtgtgttttattttgctgagaacaagatcaaattgctctgtgttgagaaagtttccacagaacttgttacaggagggaagttctgcaagaagtgcggcattttggtctgtcaatccgttctttacggcaaatttcagtgccatcttgatgtttgaatgatgtttcctgatggttgagcctgataagcctgattgaagctttgtgaaataatattcttcaagcactgctggcgtgagctgagaaagcattgtacccttgctgcgaaaatacggcacaaggtggtgattgacctgggtgcagtaagcttcatatgtgttggcttttacagacatttttttgttgtgcagccacgtttcaagcagatcggcgaacggagtgtcactagcttttttagccgacaacttgtctttaagctgttggttttctcctgcaagctgtatcacaagtttttcaagttttgttttttcgtcaattagttcttcgatagtcataatgatcccctttttttgatataataaattaattatattacaaaaacaggcattttgacagcttgaattgatatctgtctgaaagaaaaaagcgaatttcacataaaaaaacaaatactcatcaataactttgataataactaagtatataaaccaaaatcaattatttgatttcagacagataatcaagaatgggtcagttatagacagttcattttacccactacccctttttaagaaaaaaatctccgaaagccgcatttttttcttaaaacctattgacaaatccgattttttgttatacaatgaacttgtgtttttgatggttgtgttcattgtatagcaatgaatgccctgcctcctgctcgagcggcgggaggctttttttattctgctgtgaggaacatatatgcagacagtatatgtgttgtctgtaaaatcacctacacgagttctgattttcttcttacgaatgaatttgccttttacaagcttttctatcgtcctgagaacgtcctgacggctcatgccaagaagcttagatagatcattatagctttggaaaaaactcttgtgcgagctgtcagccagcttacagcacactgcataaactctgaattcatttccattcaatctgctcataagctttttatcgatggtaaaatatttagaagctgtagatacggcttcaatagtgtatgtatatgtgccaagctttccaggagcatttgtctggcgcttctgtgacttgataaatccactcttgagcagtgagcttgccgcacgcttaacggtggatactgaaaagccgcatagtgacacaagagttgtctgcttgactgtgatctcatagccaagcagatttctttttgtattcttgtggataagactatagaatacacaggcaagcttcaagtctgatgcctgtgtaaaacgtgtaacaaagctgttaggtattcgcatttttcaattcctcattattaatgtattgttccagtgccgcccattcatcgacaacaaaattgctgcgtatatcaggacgtttctgtattttctttatgtagccccttgcagcggcatagtttttcttttcaataaggctgctaagctcatctcctgcaagtccattgaccttatagagcagtgcagatatatctacatatgggagttcgctttgagaagcagggaagtcatcggggagataaagctcgtctgtgctttcatcaaagccgtcctcgtcatcctgaaagtcattgtcagaataagcctgggcaaatatttttcgtgcttcattatcacgaaattcttttagctgttggatatgctgctgatactctatgacctgacgctgcgcctgacttgcctgtttttcaagatccaatgcagtcttatacacaagctcagaaactgctccgcctgcagcttttattttctcaatatcattaagctgcatatagtatttgttcatagcactttctgcattatttttcagcttatcaagtctatactgattgcctataacgcccaaactgtcccaaagctcatcatatgggtaaagcacagcagagaggtctatgttatggtttcttataggcagattttcgacaggtattcttggcggcttattctcgataaggtgataaggcgtgatattagttcgtattggctcacaacgcattttcttaactatggcagtgccgaaaggaagcttagacaactgtgttgtgtcgagcagagccttgcggtcaacgtgttcgccttggtgatcgataaagccatataggctgccgctgaatgtaagatagtttatggtctcgtttcctatcatttcggaaaacgccttgttagtgtttccgttaagagagagtatgtatatctgaatattgcaagcgccctttatgccgtcctcttctttatcatactttttgagctgaccatagtcctgcagaaagagattgaacagaatgttagctcctggagaagcattcattttgctgctgaggtcaggaagctttgtcatttgaccaaactcatcgtagatatactctatttttcgtggcaatttgccgccctggtattttcttgcctgctttgcaaggtacataaaggattggtctgcaaacattgaagctattacatagcgtgatttttcttcatatggcacaagcatatatattatgcaaggctgatcttcattgataaggtcagcaaagtttatttcatttttagatgtcagcttttgaacacccatatccgtcatgaagatctcaaggtctgcggagagaacagtgtatattgaagaacgtgtatcgccctgggagaactttgacgttgaataggatgttcttgcaagacagcccacaggcagcgcattgaacagctcatcgagagcattgaccattttcttattgccgctttcgtcctcgatcactgtattatatacgccaaattcagtgaagaatgttgttatgctgtacatattaacgtttgacatattacctttttcatagcctttatcaagaaaatagtatatcagggcgcttaaaagtgaccttgcagagtctgtccatattgcttcactttgtacatcgtctgtaagacagtgggcaaacgagctgacaagcttagaggtttgtgaaagatcgttgcttccgctccgttttgcagcgagatattcgtcaatgataagttgtagaggattccaacaatcagatcggtccgtatcgataagattaagagtgactatcttatatccgttatttgcaaaatcctcatatgtcagttcaagcaactcgcctttcatatcgtttatgataagcgagggcttattttttgagttagccataagccgcatacttggcagcacatagcattcgcctttacctgaacgaggagcgcctactatcatagtgttgtatgtgccagtttcaacatagtacataccattgctctcaccaatgagcataccagcttgttccgctgactttatattatccatagggactgcctgaaagtgttcaagaagctcattatcttccataaatttattatcacccttgatgtccttgctgtcattcttcatacgccacagagtatggagctttactgttatacacaagcctactaccattgccaggataatttcaaaaatgaacatcataaatcctgacggaacaatgatgttccacggcataaagtgagtgcttgtgtattcaccagagcgtccgttaaggcttaccctgcgcatacttttaaagatgtaaataaaaatgctgttaaagatcacatacagtatcgatgtagctattgcaaattgttttattctgacatttcggcggtctttgtctttttcaataggtgttttattcaccgcatttaaaatacgcatagcaagatcatagatccaaccaaatacaaaaagtatttttgcgatgataagattttttatgcgcttaagtttttcaagatccatattagttcccctttatatgctatgatattgttcttttgctttcgccatttcctgctcgatctcaaattctctcataagacgtgcggtttttgcttcttcagatttaagggtgttgcgcagcatacttgatgatttatgaagaagtgtcctctgcgcctgcatacagcctgcaagtctgaactcaaatggtatatccgcttttttaccgcttattatctttttagcaatgtcattgcctgagcgtgctgactttctcagccattgatatgctgctttcttttgaccatcacgaagcagcattaaaccataagcgagctgtccactgttgttgccatttaaagcgcactgacggaagcacttttcagccatttcgtttttattttcagacagatacacttttccaagaatatactgtgcatttggatcgttgtattcaaacgcagaacgcttaaggtattctttagcttttgtattattgaatgagctataatatttgcccagagtgtatatcgcaggctcaaagtccttatcggcggctgatgaaaggtagcgtattccttttgaaacttctgttgattttctgctatcaagaagaattttccctgcagcatacattccgtaaacattatccttgtctgctgctttgatgaaatactgcaatgcttttcttttgtcctgaaatgaaagatacaatttaccaaggcggtatgctgctgttcccataacatcatctttatgctcagcagcgtgcataaggtgcttttctgccagagcattgtcattgaattgctcctgatagagttttccgagagtgtatgccgcatagtaattatcttttgctgcggaacgttctaagtatgataccgccttgtcgtatctctcttgtgaaagatacagcttgccaagactatattcacacaatcctgttttatcctgtgcgttttcagcaccctttatcagatttttttcagccttttgaagatcttttttgctgtcgctctgatagagcttaccgagcatatattgtgctttatagttattggagtccgccgagagcagcagatatttttcagcacattcaaggtctatatccgttcctttgccattcagatacatcatacctatcttgtagctgatattatcgtcatggtttttagtgaatactttctctaaacctgttaaagcttcagcgtaaaaattatgcgcactcgttaggtctttttctactccttgacccagttcataagcttgtcctacggcataacttgcgaagggcattccgcctttgctgcttagtgagcgcatataatagtcaaatgctttggcatagtctgtttcaacaccagagccgtatttgtatatgtttccgagagcaaaataagcatatttattttcagacagcttataatgctctatggctgagttatagttctgggtaactccaagcccatattcgtacattttacctatacgatagttgagataggactttgtccaattatcacgtttatcatcactcatgcttactatggacagcagcttgtgaaaatcctcaaaggctttgctgtaatattgctgacttaatgtatcgccgtcattggattttagcatttggctgtcataaagcttgcctatgtcatatgttgcgagaatatttccgcttttgctttctattgagagtgtttcaaaagctttttcggggtctttctttatgactgctgatttgttctgttcatttccgtacatatagtcgagggcaagcttatagttcttgctccaatctatgcgtagacattccactgtctgatcgcttttatcattttcagacagatacgcttcaggctcttgcggaaaaatatccgtgctgtagtcaggagcatttggttcatacaactcatcataatttcttgaagataggtacatttccaaatcatcagggatatcagagttttctaaagagtcataaggcatagcatcctcaaaatcatcttttttattttcagacagatacacttttgatttctgcgaggaaataccgttgttgtagtcagaatcatttttctcagaaaagccttcgctttctttttcagacagatacgttttcgtttttggaaagtaagaagtattatcaagatctatatgggaatgcagatcctcaggtggttcataattgacattctttgtgttgtagtattcacggcagatagaaagaaatgagtttcctactctggagtaaaaacctgacggatcgtgaagctgatgttctttatactcagcccaccttgaattttgtccgtatctgtttcggaacattgcttgtgtgctgtcgagcttatgaagatatgtgtcaaacattatttgcaaagtttgattttctgatatgacagatctgatacaactgtctatctcgttttttgtcacatcattttgttttgcataccaccactgcttgccactgttttttaggtcatcaggaagcttgtcgataagtgcgtttattttttgaatactgcctgcaaattcggacttgatatgaggtgcaagcacgtttctttgaaattcagtaaggttagcagcggcggcacttttgtcaatgaagtgcgtcatttcagttttcaaagcgttgaaagctttctgctcgatatcgtcttgacctttgtttttgtatgtaatgcgcctatcttcaagtcggtgatattcaagaagctgataatggatatgtacattacctgtattgacgtgaatgctgccgacccagtagcagttacttgcatccagcttttctgatttgtctatcattttgttaatgccttttcgtgcggcttcaataagtgcctggcggttgagctgattgccgactatgaaattattctgccgcagatatgcgttatcaaatgagataacacctgcatattttggacatccctcagaacggctgacagcttcttgttgacgtatcttgtctatatcggcaggagtcagactgtcttgtgtacttgtgaaagcacctaatgagcgttcagcttttatgttttgagcctgacttttctcgtttggcacaaattctgaatatacatactccatttcgttggcgtgtttgttcggctcaaaagcttcagggcggagcatatagtccagaaaatcgaatatcttgttgccaccgtcaccgcttattcgccacttgtatacgaatttgcatttgtgaaatattcctggtgtcattattagtcactctgttcgtcttgcagggagtctgcacccttatcaactgagcgctgatgtacgatgctcttgtagttgtcatttgatcgtgacatgacgtcatgcggttcgctgtcactcagacgcttgtcggctgagtggaattcctgcacttcgtagaagtgcaggagcgtattaattccgtcacgttcctgatatatcatgctgttattttcttttgcaatcgtcagcagcttttcaatgttatcttgaatgtttttcaaacattcatcgtttggtgtttgtttgatgttattgtaggcactgtctatcagaaacgcaagacaattgctgtatgttttaattccgttcagctccattatctttaaaaacctttgataatgtagttctgaaaaagacagtagcttattgataggtttgcttttcattttttcatccaacctttccgtgtagtttgattttattttgtgatatctaagttagaggtgtgggtcaagagcataaaggcacgatatcgtgcctgctggaaacctcggtagaaccgaggtttcaggtggggtactgtgatatcatcaggtctttttctatatacgatttatatacgattttctgtatatatatgtaatttatatattttatatatattgcaaatcaaaatttatatatgatttatatacgaaaacttcctctatttacctctttatatacgaattatataattttcatgctgtaataatctgtatatatttctgttgtttaaacaaaacaggcttatttatgaactttctttgtccgaaatttcaagcatcctgagaatttcttcatttgtaattgagttttcttcagaatttgttatcgtttctgtaagaagattttcgattttttctgttgtatttatcattttttgcgctgcaatatacacattatttatagtggaatttgcaccctctgaaaggcggtcaagctcctgatttactaacgcacgaacgataggcggaagaatatttacaacaaaatcgtcattgcttttcacaaaatctgatattagttttgaaagtaatgcgttccgtgataagtcctcagcttttgctatattgtctattttatctatcatattctcagggatattgcgtatgattatatccattttttattattcccctcgtaaattctgttgtaataatcatcttcatttccaaattctttagctatcgctttgctgtttgttttgcaaacagcaggcagtattttctgaatggtaaaaaggaaaaagccctgctcaggtgtatccttattcagctcgaacaatatcggttttctgccctcacgtttaatacagacagctgtataacttttatctgcaaaacgtatttcttctatttcaccatacgcaaaagtgtgtgtactttttttgtctttatagtatgtgatctccagttcattttctgtagcttttatgtgtaaaaaatgtttaggataccgcacaaaaattttgcctgttatcattgcgatacacacaaaaagtgctgtcagaaaataaaaaatcagttctgcttttgcaaaaaatgcagataaaaaatacatcgccaatgcacaaaaagatgatatcatcacggcatatttaagctttgttagctgcttttttaatacctgaaattcttcatctaatgaaccgttatcttctcgtaccgggtattcaaaaagaatattctccaacgttttcacctcacttgttctgtgacgaaatggttatatcactgctgcatatcttcactgatttgtccgtaaaggtcctcagttctccctttacaactactacacagcctttgtgcaaatgattttttgcaaaggagatcgtgcttgcctcgttggcatatacagtgaacacatcattaaaaccttgctctcctttttttacttttctcggtacggctataagaaattctattgcataggcattgagaatttttacttctgaaaccaaaaatcctatgattcttattttgtttgacgagttgttaaatagcatttttattacctcttttctattcctcgacggtcaccatacagcttgcctgcaagcccttatcttctgttactgcggatatgatagctttgccttttgcaactgctgtgacccttccattgctgtcaactgttgctatttccggacggttgctttcccattttacgtttttatttacggcgttatcgggcttgacttctgcacgaagctgagtgtgctcacctaccttgatctgaacgtcattgtactcaaattctgttgcgagttttatggaatatacccttgcctgtgttgtggtggtttcagcttgtgcaggctcattatgtgttgctgctgtggtttgcggtggtgcatatgcaggctcgttgtaatcccttgtttcggcaggcttcgtgttcatttctgctgttgcaggctgtcgtttctccgtggtagtcctgctcgtttgagatgcttcggcagccttttcactcagatcatgtgtggttggtgctgtagcttgtgttgtcactgctacagcttgttggctcgtgattttagatgtttcagagttgtataaaccgcttgttgtgtttgcatttgagctttcctcagagtaccccggaactattttcacggcgtgggtctgcatatcttttctgtctatagttactctaagtgtgatagttttccctttttcggtgtgcgccggtatcttctcaccaaactcgtcatatgcgtcatcatattttgtgtcaggcatagaagttttaataaccacacgcattattttgaaattcgacggcggattttttactgtgatttttcttgaataatcgtcatacttattgcctgctgtgaacttatgatctgtaaggtcgtcgtcaaaatttacagccgtaacctcaggatatgtagctccagtgtcagaccctgaaaggcggcactttatgacaaattcgcatacattgtcgtaatacgctgcgtctgtcaccttgatattatagccgttaagtgacattgttttgttatagccgttgcttttgcttttgtatgtaagtgaggctatccaactgttggatgtgagaaacaaaacagccagaacagcagtaacaatagtgaatatcttatatatcttactgctcgcttttggacttactactttcattttgtcgcctccgttccagctgcctgaagaagttcttttataagattatcaaccatttgaatgatcacagtgtcgatatattggcttatgtgctgttcgatttttaggtaagaatatgtttctgcaagaaagcattttctgaaataatcagcgtccatttttctcagcataagaccgtattcctgcttagtgtgctcattgtaatagagcgaaaagcagttgtgtatgatctcaatcctgtcctgagcattgcccatatacaatagctgtcttgctccgactattcttctgcaatggagcttatctctgtctgagtccaacgacaaaagcatttgtcccggttcaaatgctgtgctttctctgagctctgcatatgaaaaacgtggaaaggcttgatgaagaatttcaatgctttccggtgattgtttgagtatcattttgtactggacaagtgagaaaataaccttgatcgagccagctgccgcaagatttccgtctggaataaagtcaagtatcgactgtgttgcgaaccataaacctgcaaaatattttcgtgtacggcggcatagtttttctataaattccgttacctgagggtattttacggaaatgaaacggtgtgcttcatcgataaggcacacaacgtttcgcatatcccatggattgataacgttttgattatatcctatgtttttgcatatggtagcccacattatagtgagtatgttgaacaactgtgcgttataaacattgtcagccatttcactgatgctcttaacatcgaagatgataagatcgttgctttttacatcaatgttcgttactccgtcaaacataccagcgtatgcacccttgccacaaagctgctttatgtatacttgtatattgcagtatgcgtcatattttcttttaggcagtgaatccgtttgtgacagcttttcagtgactttgttgttcacatcggtaaagcagggaaacttatcaggctcaaaaagtgttatatctgtttcggggaaaatgcccttgtcagatagacattctgtcacaagatccatgaagatttccatagtatacatatctatttcaggtatatacatagacataaatgtgcgtattcgtgacatctctgtggcaaaattctctcttgcctcgtcctcaggtgagatttcatcatcaacttttgcatcgactaccttgcatatttgaaggggatttatttttgagctgctgttgatttttattgtctgtccgccgtaaactttagccataggctgatattcactttcgatatcaagtaccattactttattgcccaaaagcagctgatcctcaagcattgatttgaaagtaactgattttccgccgcccttcagaccaaacgcaagcagatcgaatgagttacgggtctttgtccttttaaacgtgtttagaatattcaaaccgcctgtttccgtgaatccaaagaaaagtcctgtatcatcgatatgtgactgataatagaaaggaaactgccttgacagtgtatcaaaaacaggaaacggtgtctgaatagtgttgcttttatcatcgataacagaaagaaactcatgctgtgtggtatttgtcggtatatacgcagacagaccactgagctgcagctcatggattagctcttttgaacgcttgctcaaggagctaagtgaggcgtctttcagaatgtacctgagcgtaacataatatatctgctcattgccgttttttatgttctgataaatgatctcaagcttttgatactcggtatttgtatctatcttatcggcagcatcttgaataattcctcctcgtgactctaactcacgcagggatgcacttatctcatctatgactttatccttttcagatatgcttatatcccatactatggtatcatcagattgtattaccatttgagccagcttgaggtcatcgatttccgctgcataatcataaacaactatcgtctgtgcatatacatcatttactttgtagtaattaggtcgaaaagttatcttctcaggtaaaataatctcattcaggctgcctttttcagatagctgctgattttctgtattcagacagataagcttgttaagcgtgacgattatttcatcatcggaacaccacgatacgtctatatctcgcatatggctgataaaacgttgtgcaccgttatagattttcttctcgtcatcggagtatatgaaaagatacgccattctgtcaaaatggctgctctcaaagctgtcaaacagctcgtactgttcgttgagcagatattcggaatatctgtttatgctttgctgacttttgtattttataaaagctttttggttagcaagatatggcgtttttgatgtgaaaacatacttgtgacctgtgcctatggataatgttgctttcgcaaaattattgaaaacagtgttgcggtcatagtcattaaggtcaaatatatccattcccgataccgcaagcacgcccattttgagcggcttgccttttactttcagctcgactattccgttatgtatgctttcaaatgacagacgtgacattatgcttgacggatcatctttcagctttttggtctttttttctctcgcaaagcctttggaagtttcgattttacttttcaatgtcgatgacttctttttcattattttgttctccttccttgtgcttatgcagcgttttatttgtcataagatagctgagccactcaagccaagcctctgcaaagcatttgcaggggtcagaggggcttttgccgctcataataataaacactgcgccacagaatatgataaaaggaatgccaagcttagagctgaccaacattcccgataactgcgaggctaccaaaagagtaactataaagccaactattttggtaaggtttatgtgtctaaatatacgctgctccgttttagtttttttcggtactactcccatagcttagttttctccttccttattgaagccgctgccgctgttattattcggcttactgctgttgctgctgtttgtcggttttggagcgtcagaactactgccaccgtttcctgcactggtggtattgttgcttgtaggattttgagcattaaaaccgctgccgttcttgcttgtggcattgttgctattttcgcctgatgatgtcggaacgttaaagccgctgccacgggcaggctgagatgtgccgttattatttctgttattgctgctgttttcattgttgttggctcttgtatcagttccatttgtgccgtctttccctgctgcaccttgcgcacctctgtcacctttagctccattcatgccgttagtgccatttaagccgtcctttccgtcagcaccctttgaagcgctgcctgcgccgcctgatgaaaagccctctcctacagactcttttacgttattggcaatgttgtcttttgcatttgagaatgtatcttttattgagcctggatttgttactgcataagctgcctttgcgcctgcattagtatgaccgaaagctccaccgacagcgcctgttacagttcctgctgctgcgccgcctatagcttttcctatcttgccaggggtagtatcaccgccgtgtataccaccatatacgccgcctgcaaagccttttactgctcctgctgcgctgcttgcggtatgctttgcaacacttcctgccccatgtacaacgctgcttcctgcacgagcaagtcccattgtggcataactgcccatttgcattgattggttgatagccatcattgtggctgcacctgacttaacgcctgcatcaatgccgaacagctttgtcaacacctctggaccgtctatcacaaactttgcgcctgctattataactatgagcattaccgcaaaattgctgccgtattccgaaccttttatgccccatataacggctatgtatattcttaaaagaattacaactatcataagaattatgtttgaaagcagcatattctggatagcttttttagctctgcctgagccgttaaggtctgttgctatgataaagggtgtaatgagctgtgcaaacattatttcaaatagcgtagttgctatttttattccgctgaaaataaggcagatagccactgcaagcataagcacaaaggttgaccagaagtcgatatgataataatataaacagtcaaccgtgtagccgctggttatatttctgcgtatgatctgctctaccgaattaagatcatcataatcttcctcgtcaaaaagaggaaaagattgatattctgcatttactggttctgcatctttggcggtatttgtatttgccgctatgttaagctcccttataacatcatccttgataatgtcaagtgcttcctcaacagtatgtgcgtttgctcctacctcctgcgtttttccagccgcagctactgcagggtgattggctatgaggtcacggatatatgtgttgaagttgcttacattagttattcggctgccgtcagggtaatggagatcgcctaaggtcacgccataagggcaggcgtcgccgatagaggctgataaaaatttatcatagtctttttcagacagaacactgccatatatcgaacctgatgtgctgtatactgaacagtatacctgcatatttgcaccataatctgcactgagtataagctctccatttgcattctttagaacattatattcattttcaagtcctaaaagggacatcatattctctgtggttagactattgtactttttctgcttaggatatacgtcatgtatatctgtaagataacgggtagtccaaggcttgctatcgtcaggctcaattccacctgttatctgaatgtcctttacatttcctgaactgcccacagtatcgaggtaagtcatcatcttcttattatcaacgctgttttcaacgtcatatattcccgacgccagaagatccttgcccaatgttccgacagtgactgtgccgtctttgtcgaccgttgtctgttcagattgatcattgatctttatgttctgcgctgttgttatacccttgctgcgaagtgagttgcaagaagatatgaacgccggaaatgctacaagcagtatagttgagaccaaaatactcatcaaaaaatcagacactttgatcttatttctgaatatcacgagagcacacgctccaaaaacaagtgcaaggctcatgatagacagaataattgtttgcatttgacttaagctgaattcgtccgacaggtagtcgaagaaattgagtttgagtaatgttttgacagccttatcaaagtaatctatcacatcacaaagaaaactcagtatgttaaattctatatttatcaacagatcacgaaaatggttctttattgttaccattttcaaaatctctgaggaacaccctgtatatcccagttctgctgcacaagcctgtatactgccgcagccgctcataacaatggcggtgatgaatataagctgataccatacctttttgcttttcatgtacttcaaaataatactcctttctgtctatctgtgtatgcccgtaagaacgctagggataacgcttttacggacacacacaaatatgtgtccgtgcagatcaagctacatatattgagtcaaggaaagcgtcaccgaaaaccagcagggcagcagccacgccaatagcgataagccagcccttgactgaggatatgccgtttttgccgcttgcaccgaggcatataacaacgccgacaagacacagtccaagcagtgctttggctgcaatggaaagcccatttttgtttttggtgatccaggtggcgaccgaagcccatacacctgaggttgcgtctgtttcaacatcggcaaaggctgcaatggctgatgacagacaagctgtcataattccgaatatacgagcactaagctttatgctcttttctttgattttttctttcagtttcataattcattcctccgtttttgttttatctgtttgttttgaatgtgctgacaccacagccttgagtgtatcgttccaatccttgccataaggcggtatgctcacttttacagtgaaatttgcagaatagtcagacattagcttttctgttgcttgacgtcctctttcatcattatcaagacaaaagactatctgtttgatccgaggatcatcagatagtctttgtttaagtgctatatcagagcagcctgatagtgatactctgtttattccaagccaacaatcagaacgatacatttcagacattccaactgctacacactgttttttcattgaaagctgcattaaagctccgtgagataaaaggtctattggtgcttcaaacacataaagctttgtagggtcataaccatacgcatttggtttagcagggatataaaagctgtactctttcatacttccctcaatgttctgaggatagtatttgttgtatgtgtttgtgatctttgcttctgcaaacttcattgagccaaacttatcgtagccgcagaaaatagctcgctttttaacatcgaggtatatgagcttattgctgacacaataatttattatgtcagctggaagctttctcgttatgttaagataagcgtaaagctctcgccatttgccctgcatgggcggcggagctttaaattctgcctttttagtttttttctgataatgctgttcgctgagtactgcttttctcatttcaggagaagctcgtatactggtgttgcctataagacgtgatacggcttctttaaaatcgtatccatcgaccttgcaaagccaatcaatagcaccttttccgtaaagatctcttgaataccagtgccaggtatagcggtctggattgatcttaagactgtcatgctctactcctatataccaaccgcctgatgatttaaagttgaaaccctcgtggctttcgagaaatgtgaccatatctgttcgccgtgcggcttcaagctcctctttagagtacatgacaaagcttttgcctgattcgtatcttctgtctatcatataccctcacctcctctcgcccgtatactggcgttgcctattagacgagaaacagcttctttaaaatcgtatccgtcaaccttgcagagccagtcgatagcaccttttccgtaaagatctcttgaataccagtgccaggtatagcggtctggattgatcttaagactgtcatgctctatccctacataccaaccgcctgacgatttaaagttgaaaccctcgtggctttcgagaaatgtgaccatatctgttcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctacataccaaccgcctgacgatttaaagttgaaaccctcgtggctttcgagaaatgtgaccatatctgttcgctgtgcggcttcaagctcctctttagagtacatgacaaagcttttgcctgattcgtatcttctgtctatcatatatcctcacctcctctcaatgttttataatttaagcgcctttggcttaagcttttccagtaaggaattattcttgcttgtgtcagttttgccgccattaaacacatagctgcggaattgatcgctttctttttcagacagattatagatctttgtatctgatgaagcgatgagcttgccaccctttgatactacatcacaccattctgatttttcattagtgccgatcaatgcctgatatttattgttgtgaaacctaaattctatagcactttcaggagtgtggtttttattctgcgaatttccactgagctgtgcattgacatattcaagacgttttgtcttttcggctaattcttgaccatgctcaaatggtttgagcatattttgctgagcttctgaaagatccttgtttgctttttcaagctgttcttcaagagaacacagcttctgatttatctgtattcctgcaagattttcaattcttctgacatttcccacgccattatctgtggcaatgtcacatgaataggtgagttctccgtggagaacagcgatacaaggtttattatcaagctcaaaaaatgtatttgctgacggatttcgttctattgtgactttaaagccatgatacgttccaagctctataggctcacctgtggcagtacattttgccattgccacggcaatttgttctcctgcattttctctcttatcgtatctgacgccgcctattgtcatttcaaactccttgttcaacgcctgatttttttgatatttagacatatcgttcctagcttttgtgagaagttcagagtattgtgttatctgtttcggcaaaattttctctgccaactcctgcattttgtaaattgattttttgtgttctgcttcaagggttttcagcattgcaacatcattgtcaagctgtattttctcttttatcataggattaccgcttgctatagcctgcatttcggagtatgtaagtaccatttcgtcaacatcttctgaaactcttgcagggctttttgaggtcaagatctgatttatgaatttcgccttgtttgttataatgcccatcatgtatgcgtcaaaggtttcctctgtaagatagtgatatattccgacttgcgaaaatctgttgccttgccgtattccacgtccgtcctgctgagtgaggtcagagggcttccatggtatgtcaaggtgatgaattgcgcagatcctatcctgaatatttgcgccagttccaagctttgaagtgcttgcgatgataaaacgtttttcgcctttgcgcaggcttttgaacatttcgtccctagccttgtctgtctttgcgtcgcctgcaaagcagatctctttttctggtattccacgctccataagtgcctgttttatagctttatacacagagaagtgtgtttcgtcctcgttgatagcgatatcacagaatactatttgaacgcctttttctgtcatagtgtttttgtagttcttttcgaggttatcgataagcttcatcactttgctgtcaggtgcaggctgagcgtttttgaaaatacatctgctgtcaagtccaagtaaccgtgcttcgtgggttatcttcagcatattgtcctgtcgtgggtcaactgtgccactatgtattgtctcagaacgtacagcaagctctttcatatatgctttttggcgttcgtcaggctttgatgtcaccactatcggctttcctgtttcaagctttggcacaggaagtttcagcatatccgctgtttgaatatcagcgaattccttatacatctgcataagctcaggtatgtttacgaatttgctgaaacgatttttcatttgaaagccgtttcctgcaggctttatctctaattgtgatacgacttcgccaaatgtgcttgcccaatcgtcaaagttctgcaatcctgctttttcgagaagatctggtctgagataacgctgcataacgtaaaattccaccatggaattgcttataggtgtacctgtggcaaaaagtatattgttgcagccgtacttgttgttgagatactgagttttcatcagcatatcctctgatttttgtgctgctgttgtttgcacgcctgccacatttgacatttttgtagaaacaaagcagtttttatagttatgtgcttcatcacatacaagatagtcaaagccgagcttttcaaaacacaatgatgagtcttttggagaagaaagcagcttttctagcctttcctctatgtttttcttctgacgttcaagggcttttactgatgatttatcttttcttcctgcttcggatattgcactcatgatatcgtgaagttctttttgcatgaactgctctttatactcgtctgacataggtattctttcaaactgtgtaaatgacattatcacggcgtcgtagtcaccagtaacacatcttgcaataaaacgctttctattggctttggtaaagtcctctggctttgccacaagcagttttgcatttggataaagccgcagccactcacttgccatttgcagcgtaaggtgctttggtacaactacgcaggctttgtttataagaccaagacgtttcttttccattacagttgcgaccatttcaaaactttttcctgcaccaacttcatgtgcaaagagtgtgtttccgccaagttttgcacgcattatggcgtttgattgatgtttccgcagcgttattgatgtgttcatgcctggaaaggtttgatgtgagccgtcatactctctgccccttatggaattgaacagatagttatactttgcaacgtatttttcacgcctgcccatatcttcccacagccaatttctaaacgcttctttcatcaaacgagctttttctttcgcaagctgtgtttctttagtgtttatctcgtaccataccttatcgccctcctctcgtctgtcacgaactaaaatatcacgctgattaagaagattttcaaatatctgatagctgttcattcttgatgttccgaatgtttcagtggcagcaactgagcggtcggatgttttaccctctattttgtattctccaagctttgttcttgtgacagggtagtaataggagtttgcgtgtgcatactcgtttaaaaaattgttgtaatctgcgacatcgatccagttagcgccgatccttacggatatctcgctggcttcaaggtcttttggcacaactttcatcagagcttctacgtttttgttgtagctgctgtcgatatgttccgcatgatctctggctattctcagcttatcacggatattgcctgacagatattcagatgactccgtatagcctgaatatggttcattgtctttaactttggcaggatctctgaatagttcatcaccaaggtcagcaataaccttttcaggcgtagtgtctgtgagctgtgacatatagagaatatcgacctttcccaatctgtccattgacacttgaagtgcttctagtgctgtatcaacttttgaaactggaatatctggaagtatcgttctctttgtgaatattgcagccttttcaactgtcttatttttcacgttgacaacttcaagtgctgctaaagtgttgtagtcatcatcattagaaaagcagcgtgaattggcgctgtcagtaatatttccgaactttgttctgaaattgtcatatgtgctgttgagcttcttctgaagctctgcaagctgttcatcagagcagccgtcagcctgggcattgataagctccatagttgcttgccttagagtatgaagccctttcatgcgttcaagcgatttgcctgtttctgtgaccttgaccattatttcattttcacggaaataaagatctccgtcaacaatggtatgagtgaagttcctgacagttggatcagcagggagtatctcagctgtcccattgtcaagctcagtttccacagtatcaataacgccgtctatttttgaaatggcatttatgagctgctgtgcaaggggagcgtcactgtttgcatagcaggtcgttaccttgctgtctgcaccatattttcctcgcatacgttcgtcccatgccatagtaccaagtaccatatcgggattgtctacaaaatattgattgcaaggaatgccgttggctatttctgaaatgtgtacccagtttggaataacagaggtcattgttgttctttttttcagaaagataatatctgttgtaacgctgtctgcgtctttaaacgttccagagggaagtcttactgcgcctaaaaggtcacagcgttcggcaagatactttcttgctttatcatttttcttatccattgtgaattttgaagtcacaatggcaacaattcctccaggctttaccttatctactgcttttgcggcgaaatagtcatgaattttgaagtggaatttgtcataggctttgtctgcaatgccataatctccaaacggtatattacctatgaccacgtcaaagctgttattcttgaatgttgttttttcaaacccttttatctggatattatcctctggatagagctgcttggctattcgtcctgaaatgctgtcaagctcaactccgtaaagttttgaatctgccctcatttcatcaggcatttttgcaaaaaagtttccaacgcccatgctaggctctaggatgtttccaccctcaaattgaaatctttccaaagcaagatatacgctgtctatgacttctggcggtgtatagaagcttgtaagtgtagatgatcgtgctgcggtatattcatctgcggtcagaagttctcttaaacgagtctgccttgctccccaactgtcagcagaaacattctcattatctgcaacaaaagcctgagcagttccgccccaacctgagtatctagccattatcttctgttcttcaggtgtcgcaagccgcttttcactctctaatttcagtaaagtttcaatcgcagctatatttgcgtcacatcgagcagcagctccgcccacaacaacattgtcagggtcaaagtggtatgtgcttgccttgacatttttctttggcttttctaccttttcggttttgacatctttatcaggtatagtgacggtttcagaagcagggggtgtttcaaagagtgaaatctgttcatcagatgtaggagatataggaacgctttcagaaacaggcggtgttgtctttttttcttcagacagaacattattagcaattgtaggcgtttcatatggtataggtttttcgacctcgccatttttgattgccagcattttcttttcataatcatcaatctgttctctggtgaagtaggcgttttcaggcattttctcatacagctcattgatcttagctatctgtttttcaactgtttctgcccacaagtgcttttctgcacctgttttcagatagtaatcacaatcaagcttaagcctgcccaaaagcttgtctatttcaggctgtgtttcatttgtaggtgtaggcacttcattgaccaggtctgccatatgtgcggcttttgcagcttcaagctcaggtatgatcgagctgtaaattgagtatcttttcagaaaatcaataacgccgccgtatccgtcacctgcgtcctggcgttcagtgatcgtttgtccgtcaggcatattgatagtaaacttgaccttatcatagcccataaactgtgagaattcgtcatcagcgtctgcttcataccatgcttttgctgaaccgtacttctctattgcagcctttgctcctgccaccatttcactgtcagcctgttccatgagcgtgtcaaattctgcaacactgtaggtcttgccgtcctcaaagtagttgctttcgctccattcacaggttatcgtaggctcggataaagtagtgaatgatttaacatcatttgaacttatatcggcactattttcctgttgcttacccttgacaatattgcgactttggtgtataataatattagagtcaagattgtttatcgcctcaggcaattggagcctttgacacgagaacagtgcttggcttttttctttgtcccaaaacagaatattatttgattttgcagcacgttcaacatagtttgcaaacccattttcttttccataaatacttgtgataaagtttgatgatacattttccatttcataaatgccttgcccatttggtttaacacttacgattatcggtgcattatcattatcaacgttatttaaacaaattactatacttttatcagcacttttgtttggagaaagtgagtccattattatggcagggctttctaaaagatgtgggatattacatatctgttccagtgttaagccgtgccaatgtgcattgttcggggatttttcatgtagagcgtcttttaaatgcctttgcgtatacaacataggaagccgatcacagccgatatccacaagaatttgtggtgtatcacaaacctttagatttgagtattttgggaatacgccatttaaaacatcatttatctgttcagcaaatgttttttcactcttgacaactccagaggagtctgttatactgcttgtagagctattaggaacagcagggcgtagctggttttcagccaaacctataattcttgatggttctatttttttgtcctgttgagtaacatctgctgagattgtgtcggcagagttgtcatggacttcaaccgcttgaacgttctgctttgaatgctctattacagctttatcaagatatatctgaacatcatgtggatctatctgtccgtcaactgcctgatgaaacatctcaaagaatgtttttatctcgtctaccgttagccgttcatcgacctcgttaagaacagtaatggaaattccctcagaaaagccctgctgcagcatggctttttgttcatcactatattcatggtgagagaacatatctgacagtttcagccgaccattgagctcatttacatatgtatagtaatcattgagtatgccctttggatcgagtgtttgctcaatgacactctgagcatagtaatcagataataaagatgatatatgccgcagttcgtcgggcgaatatcggacgcttacccaatgccgtatgttatgttcaccattttgtgcagctgccaccacagcctgttttaatgcaagtatctgttcttgcgaaaacttaagctttataaggtcttggagtatatcgtcaaccctatcagacgtgctttcttgctttgcggttttggcattgtcaagagcttcgtttttgcggtcaatggcgataacttctttttcaatttcaaacagagtgtctttggcagcgtgctgaacagctctgctgaaaagaatcatatctcttgcatttttgataaggtcaagagcgcttacatcaacatcggtatgcagatctattttacctgaaagattacatctttgagaaacaacgaactgcaccacagaatccagtgaatggcggtatacctcagcctgttttatgtcaagtcccatttgagatattgcattttgtactgactcagcaataggcgcagaattaatactgtttgctgtcattgcttcgatacattctttgaccgatcctgcgtttatattgtatcggttattaagcgtattgagtagctcaggcgtattgcggtcagtaagtgtccacatctcaggcaactctttgccgcctgtctgagtgacgtcatataaatatctgcaagtgtgatttttgccaaaaacagcaacgccgtgagagccacgtcttacatatcgccctagacgtccccattttttatactcagcgatctttgttgcattcctatcctgctggaataccaacacagcgtctgaatacggctgcttatacatttttgcggaaaatttgagatactcaatgtaatcctgcttattgtttctgagatgctcattgatttcaaaccatgcttgctttacaacttcatacttatcgtgcttatccatttaagttcccctcttttatttttcaagaatatttaagagccgttccaaaagctcattattctttcctgcgtctgtcatatccatgatgttgagagcatatcttactccttcaacaaagcccagatcgtgtgcgtcatcaattacattcgcttgtagttcacattcttcctcttgcagctgaattaatcgctctcgccgccctttgtaggttttcacccaatgggtctgagcattgtctgtttcgtaatcatcttgaaatcctatcatgatttcttccaagatatcaaacttagatttctttggcgtttcagtaatcattgtggttactcctctcggttatataaaaagagcgtatgaatttcttcacacgctcaggtttgcgattttaagttgtgtgtcactgtgacacacttatgcataacaaaaaactaatagtctgaaattaataaattcatgattttgtttcatagatacctctgtctgcattttagaaagcggtatcactatcagataagtcaagctctctgcaactgttatcatcaaatataattcttccgtcagcgtcatactcaacgaaactgcttttttcctcatagtaccctatcaatatcatggctgtttgtagccctgtaaaagtcactgagcttgtgtatatctcatgaattatctctttaagtgcttgctcctgcgtcataccaaaacgttttgcaatgcactcaagcttctctttgtatgataagccgtcatttataatttctttttgcattttaaaacctccacgtcaactaaaatggcacatcttgactaggatcgcactcgctaaatctgcaatcacaattatgtattaaatctaaggcgtcttttaagctaaagcccaaagaacttgcctcactgttgtatacttcttcaactatcgttttaagtgcttgctcctgcgtcataccaaaacgttttgcaatgcactcaagctcctcattgtatgacaaaccgtctttaattatttcaatttctttttgcattttctcactcctgttcttttaaccttatctccacatatcttcttacatactccgaatttctgttcggatagtcatcactctccatcaaaaagtgatagccgccctttttcagctgttcggaaaacttctcgacctcatcgggtaaaccctgtattcttagttttatcattcttatcagctcctcattcatgtgttctgtggctttttgttcttttatcacttttatttcctttttagcactttttcttagtttaaacaagccgacaaaattgtacaattcaaatacaacgaataagatatcgagtatcttcatgatttcaccttgaaacgctttccttttttcttaataatttcgattggttttcgccaaatatatagaggatcaccagtgtatattgaccacaacaaagaccaagatcctattacaagtacatagcatataatcaaaaaaagagtgttcacattactctacctctccaacgcctgccccgttgcaggcgctttcttctaattaaactgcttgcgctttgtaaataaatatgctatactatttaaaagtctgaatttttagcgagttaaatttttgccaatagcctttgtagttttttttatcatgatttttaaaaatttctcaaaacgtgccgtatctgcggctgtggctttgtagcatttaggaacatcacgatatagtttaaatgttcgtccttttcctttttgacctagttccataattatttcctttctgtatggaggttatatagatgttatttgattatgtttcatcttcagaatatgatattgatataaatgcaatactggaattttataacagttttaatttaataaagccaattgatgaattagtagccaattggattgaagttatgcgatacgcatataaaaataacagatgttatttttcgtatgacaaaaacaaaccatgtgaatattatcaacaaataataaaaatacctagcattgcacaattttatattcattttaatgttgacaaggctgttgatgttgctcaaaattatgattttcaaagattaaatgcacgaaggcttgtatataacaatgttgaatatgaagtgcaaaatgatattaaaaagtatcatttctcttgcgaaactcctattattgttattgattttccatgcagattacaatcagagaaaatggtcattgatggtaatcataggatgacttcaaaagtaataaaaaaccaggatgtaaattatgttaaacttagtattcctgatactgtgtcactgataacacaaacttttgaaaaagcatggtatctttttgcagtagagttaaatgcggctatacaactaaaaacatataatcaaagaaaaaactttcttgaacatcaatctatatgcaaagacttcttaatgtatatgaaaaacagtgattaatcctccccagcgcctgccccgttgcaggcgcttctttctgtatagataaattgatcccctttttactgtcttttttcagacaacatcaattacctttcttctttctgctgaacataaaaaatgcagctcctgcgagaatgatagccacgctgcacagtgctgttctaccgtctgtgtcattgtccgttacgcctgtgttcggcgtatcaggagctttctcatttaccatatctgtgtcaacagtctgtgcatatgccactgtcacctgtttggagtcagccaccaaatagccgtatggcactgtagagccgtcctctgtgatagtgtatgtaccaactggaacgccctcaaacttcgcaagtccgtccttgtcggtgatcgcaggaatgtttatctctcgacctgtatcggaaatgcccgaaagaataaatctgatgccctcaacgttagtcatatcagcagttttcttatgaacctgtatcgttcctgtctgctcctcgttgagtatatcagtatcaacagtttcggcatatgttactgtgacctctttttcagcagcgaccaaatagccgtatggaacggtcttttcgtcctcgatgaccttgtatgtacctattggcacgttctcaaactttgctatgccgtctttgtctgtttcagccggaatgtttatttcacgtcctgtgtctgatgtgcccttcagatagaaggttatacctgaaatattcagatcaccctctgttctcttgtgtaccttgatagtacctgtctgctcgttgttgattatttctgcgtcaacagtttctgagtagataacagtgacctttttttcatcggcaacaagatagccgtaaggaacagtttcttcgtcctcgataaccatgtatgtgcctaccggtacgttctcaaagaccgctacgccgtctttatcggtagttgcaggaatgtttatctctctgccactgtcagatgtacctctcagatagaaagtgataccctcaatattcttctgtccctctgtagtcttgtgaactgtgatagagcctgttttttcgatattctcaaaagcgacttctgctgtttcgttgtattcaactgttacttcctgctcatcagcagtgaggtaagccgcaggaactgttgatccgtcctctgtgatgacatacttgccgataacaagcttatcgaacattgctacgccattttcattcgttgtcgcttcaaacttcaagtccttgttagtgtctgaaatgcctgttgcaaagaacttaatgccctcgatattgagatttcctgttgttgtctttgtgaccttgatagagccacttttcttcttgtttgtcatttcagccttgacgatatcatcgttttctgttatttcgaacggataaggagtatcgtcaatttcatagatatcaggtgctgaaatctcacgatagaaatatttgcctatagcaagctgaaactttgcaatgccgttctcgtctgtagttcctgtgatgacctgttctttattttcattaagaatttcaaaagaacaatcagggataagctcacctgttgatatgtcagtctttgttatctcaaaaggaatagtgttttgctcgttttcaaaatctacaacgaactccgcctgctgttcaacaagcttgatagtctgtgttggcttatcagaaatcgaatagccttttggcgcttcaatttctgtcactgtgtagctgtagcccttgtagatagcctttgttgtttcagctatgccgtctgtgcctgtggttatggtgtcaataactgttccctttggatagatacagtaaccattgccgacgtagatatcctcggctgctgccacttcaaactttgcgccctcaaggtcagctcttgtttcagcgtcacgcttgtgaattgttatcttgcccttgtcaggagcagaagtcttgttgacgaactccgttttagccgtcttgtcagcggtaacagtgatagctttcttcgatgatatcatgtagccgtctgctgtggatatttctctccattcataatcgccttctggcagacctgttacatcaatatcacccttgccgtttggcgtaaggtctgtagcctgtgaagcgaggtcagtgaagctgtagcttccgtcctttccagttgcctttacaaacttatagccgtcaccgaccttgcaagcaagctgaaacttaacggctttgtacatatccgctgtgcctgtttgcttgttgccaaagtaatctgtgaagctcttgtcaaggtgagctgaacctgtgcttattttaagcttgatatatgcctgaacagggtctttgcctgatatatatccaactttcgcctgagagcctgaatcatttttgcccttgtaaaacagaggaacacattcctctatcttgccactgttctttgctcttgcctttgtcagagtgacagcttttgttcctgccttgatgttttcattggcggaaaccttgatgttgcttccgtcctttttgaatgtaactccgtcaacttttgaaaaatcgaactgtgagatactgctgtcagccttgatcgtaccctcatatttctttgttgatgtgttatacttcaattcgtatgtaggggctgttcttacggcagttgttgcaccagcaggaattttatagtggctaagtatatcacctttcatctttttgtagcaatccacaaggtttttatggtctgctgatgaaggagcatatatgcggttcaaaatcgtattttcgtccgaagagagattttctgatgaactgtcaaagaaaccgccagatactgtccatatcatagcttgagaagctactctctcagtatctgcgttgtagccgtacttagttttgcctttgtatgagtaaatcgttgcggctttaagattttgtctttggtctttattactatacatttttattattgtgtctgagtcaaatgttgatgaactcattacagtattgttatcatgctcagtaccaagctgaacacaatagcaattgttaccgctttcgtcattccagaaatagaactcctgcgcccacttgtaacggaatgcgtcattggtatttccgcctgtcaatgggtcataggcatttttaagccctgaaccctcaaagttatagctccaatcaagaaccttgctctgcgtatgctttgtgtcagccgcaaaggcaaccagtccatttgaaaagattgaagctgtaaggagaagcactgtgaataaagagcctatcctttttacgatacttttcttcatttttatctcgccctttcaatttatttctctatgtcaaatccttgcggatattatttttttgcataaaaaaagacgattgaaatttttatcaatcgtcttaaacgctttattcagtttttatgctctcagcaaatatgtgttccaacaggagtgaccataataatctgttcctgcttgaatgattattatagactgagttaagttgtgctcgtcataaaaatcatattcaccctttatgtcacttttcattctttctagcacttcattatattcatcataactgtaaaggttatcactcgaaacccatgaagcagtgtcgaggttaatatctgcggtgtctgctaaaaattcatctactgatgaataaccaaattcggcatatatcttctcgactcttggtcttgccaattcattgctgtatgcctgcaattctttctgaagtctgtctatatcactctgagtaagggttacctttggcttagccttcgtagttgtagtcggctttggcttcgttttctttgccgttgttgtggtctgccttttagtcgttgtctgacgctcagtctgtctttctgtctgacgttccgtctgctgtggctgatagctgttgttattgttattgctgttgttgttgcctgagccgttgtttgaagtgctgtggctgtagctctgattattattcgctgtgccgccattactagctgggctgttcgattttgtggttgagccgcccttggtagtggttgaagatttaccactgcttgtgcttgcggacgttgttgatgatgttgtggtagccgaaagggaagttgtttcctcactctgagaggtcagtgtggcttccgttgtggtagttgccgaagcttctgtgcttgaagccgttgtggttgcctttggaggggctgatgatgtggtgtctgtgttgccacaggcggttatgcttatcattgtcgcactgatgagcagggcggctatggctttcattgtgttcttcatatggttttcctccttttttagacttgacatatatcttaaagtgatgtatacttatatatagaaaaggtaaaccgcatagacggctatcctcagtttttgattatgtaaaaagtaaccgcaacttttggtcgagggcggttatttttttatgctttttatcagctcgttgagagcgacaatcagcacgatagtcaagacaaagaaagctaagtccattctatcacctcccgaatatcctattttgcctgagcctttcggctgacaatattcagaccattctgtgtgggaggacaccgcctaccgttttagtttaccttttccaaactagattatatcacaattgatttgtgatgtcaaatattgctgcttaattttgagcgtttatcgcattgatgatatccttgatgagctctgttttatttccattgcttaggtcatagtatttataatcgcctaatgacggcatgatgttatttacatctacatcgtctattttaactatgtaccagccttttttcttgtttgttagcgctgacattattgttttaagttccaactgtccgtaatttgatgacagtgtcgcattactaagaaagagaatggcaaaatcactttcttctatacctgcaaggattgattccagcaggtgagaacctacgcttatgtcttttttgtctatccaaagatcaatgccgctgtattcaagggcttctgttatttcatagaccaattctttgttagcgtggcagtatgatataaatacttttttcctcctaatatgagtattaaagttgtatcccttcttggagagatctgattttgaacagaagaaataagcgtcactgaacatttgcgttatatctgctttgctgcaactaggtggaatattcgccatattgaattttctgttgcaaaattccatgaacagttcgtgaagccccagtgaaggttcttttctcaaatcatatttcttgataatgttttcaatgagctgtccctcattttgtttcgcttcaattgaaaggtaagaaacaaggttatatggaatattacatacaaataaaatgatacagccattggaagatacgatttggtttatttcattcactgcgtcaatgtaggcttctcgattttcgtagggtattaaaatggtagcatagtatttcattttcgttcctttatatattatgatctgtttgctgtcaacgtcagcaaacgccttgacgttaagttcgatttgaaatagagctgcataccatttataaaattttaacggctcatcagatattgctgagaatggtatcgatatgagtgaactatttttcttgtcatatctgttatacagctcttttaactgagatgtattgagtaacatcgcacacactccattctaccatattattcatcatgtgtcaattatctgctattctccactgagtattttatgttcagttgtcaatgataggtgacacatcttctcaaaaaataatgttaagtaactaattgcagcttttcatttggatgcagcaaaacctaaaaatatctgtgaaaattgataatgagtcattgtaaacatcctccgataatttgtagttatcacttattaaactttttcaccataaatatatcaccaaattcctaaaatgtcaatttaatctgacaaaattcgtgaatttccacaaattgttgtaatttgtcaaatgttaaaaactctgatataatagatgtaatttaaaatcaataaaaagaatagttcttggctaatttgtttaatttgacgaaaatgccaaatctacttatacaaaaataaaggagttttccattatgtttgaatacaaattgcacattgatgaatttcttaattattgccgttaccacaaaaaacttagtgataaaacgatccgagcgtataaaatcgacttgtcgcagtacggagttttctcgaacgagctttcaaagcaggccttgtgggactacatagaatatctcaacaaaaagtacaagcctaaaacagccaagcgtaagcttgcaacgcttaaagcgtttattcactttctgcttttgcaggatcttatcgactttaatccgtttgacaaactggaaacaacgataaaagagcctttgctgctgccgaaaaccattccccttggagttatagctaaactaatatctttttcgtatcagcagattgtgtttgctaaaagcgattatcagattcgcagtgcagttcgtaatacagcaattctcgaattgcttttcgctacaggagctagagtggcggagatttgtactttgcgttcagataatgttgatttgttaggaaactcggttaaattctatggtaaaggctcaaaagaacgtattatacctattgaaaattttgcggtactcagtattcttagaaaatatcattcgttatttgaaaaagagattctagattcgggatattttttcgtcaacaagctaggcagaagaatgaccgaacagtctgttcgcaatatgataaatttctattgcaaacagtgcggagtagatatgcatataacgccccatatgttccgacattcttttgctactcttcttctcgaagaagatgttgatatccgatacatacagcgaatgttgggacatagttcaataactacaactcagatttatacacatgttacgtctgcaaaacaaaaagagatacttaaaataaagcatccaagaaacaaactgaatattggttaggaggagatactatagctttatcgcaaataatcgtaacaagccgctatctgaaaagcggtacacagaaaagtaaaaacaagcgcagaaattacacaaagtacatcgcaacccgtgaaacagttgaagtacgtgaacagaataagtttgctgagaataaggaagtgacggaaaatcaaaaacagcttttaaacgatttgcttttggactttcccgaagctaaaagataccttgagtatgaggactacactgcgaaccctactgtagaaaacgcttcggaactaatcagtacgatcattgagcgtaacgctgacgtcatcggaaaccgtcagaattttgtcggctacatggctattcggccaggagttcagaaaagaggctctcatggtcttttcaatgaaaaagatgaaccgataattcttgacagggtagctaacgaaatagcaaatcacaaaggcaatgtctggtcacacgtaatttcacttcgtcgtgaagatgcaattagacttggttacgataattcggaagcgtggcggcagcttgttatgcgtcacatttcagatattgcaaaaaatcagaaaatctcgctgtgcaatttaaaatggtacgctgcattccatgacacgactcatcacccgcatattcatctgcttgtttattccgaaaatacaaaggaaggattcttaacaaacgagggaattaataagattcgttcagcttttgcaaacgatatatttcacgatgatttgcagtcaatatatcaggagcagacattaagccgtgacgaattgaaagctgtatcaaaaacggagtttgaaagtgttgtcagaaaaattcagcaaagcgattttgaaaatccgcagcttgaaaatcttatccgcaaactatattctcagttacagaatgttaaaggcaaaaaagtatatggatatcttcctcaggaggtcaaagaaacagtcaacagcattttttcggaacttgcaaatgacgataatatccgtcagctttatgaaaaatggtgcagtttggagagcttgaaatacaagacctatacgcaaaaagaaaaagaactgccgccattggttgataacaaagtttttcagcctgtgcggaatatgataatcagaactgtgcttgacatgaattatcctgtcattgatgtagaaattgaagaacccgaaccaacagaacaatttgcgaatgatgacttttatgttgatattcttctgaagtttgatgaatctgagcaatccgaaaatgataaagtaacattttcggataacgacgagccgaccgccgaagatttcatttggagcaatgaaaatgaggtaacagtcgatattgaagattatgaacctcaaagcaaatactacctcaaatggagtacagcatacaaagaagcttgtaagattatttacaacaagcaatcaaagcttgaagattttcagaaagcggagcagcttttgcttaacgaatcaaggtcaggcaatgttcttgctattcaagatctgggcaaactctattctactgataaactcggcgaaaaagatgaaaaaaagtctttttcattctacgaagaagcatttcagggttttatggagatcgagccggattctgattttatgtttccttatgagccgaaatttgatgggcagattatgaaacccgtgaatatgcgttcttacgtttggtatcgcataggcaaaatgcattgctatgggttgggaacagaacaggattacgctcaatcatttgaatggttcttgaaatcagctcatgaaggcaacaaattcgcacaatacagtctcgccaatttatattactacggcaacggtgtggaaaaagacttgtctcaggcgttttggtggtatcgcaaatcatctgaacagggtcagccttatgcttcttatgctgtcgctcagatgtacagcaagggcgaatatgttgctgaaaataaagaaaccgcacagagatattacaaagcggcattgtcaggatttcttgaactcgaaagcaaggatcaggctgatgataacttatattacaaattgggcgctatgtataaaaacggtcttggaactgagattgatattcctaaagccatcgaatattttgaaaaatccactgaaaatatgtggtcaacttatcagctcggcaggctttatcttttcggtgcagaggaacttgaaaaagataaggaaaaggctgtggagtggctcacaaagtccgcaaatgacggaaatgagtatgctcagaatatgcttgacaatatggcacagtttgaaaacactatacttgcaaatacgatcttcgctctgttcgctaatctctgcaagtgtattgaagatgactatacacagaagtataagtcggtcagacatacagtcgacagcagactgaggagaatgataaggcaaaagaaacagtcgtttggaattaaggacgagcagtctcagagttatgagcaatcataattactgccaaacatttatagaatatactgtaacaggtggttgcaaatatgtatttgatattaaaaaagactttaatatgctggaaaacggagttcacaattgtttatggtaaaatagaaatgcagaaaaagggctccaaaaatacacaacaggggcgctccttctatgcgcaaaccgagcccccacacgttaatcttgtgctgaccgggctatgcactttttcgagcccattttatgcactttttgcttgacaaacacagtggacagtttttaagaatattttactctgctcttgcatggcgtttgaacttaatgattagttaattttaaataaaagtcgtataatcagtcaaatatgataatatagttgacaaaatgtaaattattaatgaattctaaaatttacttgacaaatatttcaagacgaagtataataaaaaagtgtaaatatagtcaaaaaggcatcttattatgtgaaataaatgtttttcttgtttgacttaattatgataagaggagtgaaacgctatgacaccggaagaagcttctcagttgtataatatagaacaaagaaattattatgattactgtggttatattcagtcgtagtatatagaagagttcaaggtggaacagcgccaaagttaactgatacatctacacctggacgaagttatgaattgccagcaccgtggtctgaatggatagaggaagctgctactaatgtaaagattataaaatagcattaaatggagtgtgtgtaatggataataaaatgcgtatagtggcggaagaatttgaaaatacaactactggagagaaagtaaccggtgtaacggttatgattgatggaaagttaagacaggtctttgatattatgattgcaaaaagtggttataacaagagttatttggaaatgttgcaggaggtacttgttttaggaatagatgagtatatcaagaaattgaaatagtatattcaattacttatcgttggtattttaaacctgcggttcgaaatttggaaacgcaatccaagcaacagcaaaagtcagcggaacgatctctaatggcatggacggatttgatatgctgtcgatgggactgggaatgatagatcccgataatccgttaacggcattgaacaataagctgcatcagagtgatatttataatggtttccagatgggcgtgagtatgctttcatccttcagtggtgcagcatcacagaatatggcttgttttattgctggaactatggttcttacagctacaggacttgttgcaatagaaaagctttccgcaggagatgtggtaatctcaacaaatcctgatacccttgaaacggcaggaaagactgttcttgagacttatgtgcgcaaagtagacaagctggtacatctcacgataaacggcgaagaaattgtgactacagataatcacccgttttatgtacaaggcaggggttttatcaatgcaggaaatctgctcgttggtgataagcttatcagtgtgaatggtgaagacttagtaattgtgaaattcttcattgaagaaactgctgaatctgtttccgtgtataattttcaggttgaagattatcatacttattttgttggtgagtctgcggtttgggtgcataattcggaatgtaaagtgagtacttcaagaagagatcatatattagagggtgaagggcctaatgatcctgggcatggccccaataggggatttggcaatagtgcttttcctgacacttggacagacgattacgctataaaagccgttgaagatgtagccaatagtccaaattcaacatggagacaatcaacaggacctggtggaggacgtaacgctcctgttacaataggaggtcctgatgcaaatgctccattaaccacaagaaatggacgaccagttaggtttattgttgaaggtagaaatcatggattagatgttagagttattgttgaacctggcggtgaaggaatagttacgggatttcctattaatcgataaagtgttaggagaattagtgatgaaaaaagaagcatatgataaatttatgaaaaaaatatcgagtgaattcaaaaatgttgatacagttaaagaatttcttttagatgcagcggaattagctatgtatggagaaaaacgagtggcacttgaaaattttcttgaaaatctactggaaaatgagatacatatttcatccgaattgatagatttggcagaagaggcatttagtgataacccaacagactatgataatagattaatttttgaaatgaaacaatttaaattaaattaatgtgtaatataaaagttgtatgcaaatacgaatacgcttgaaaccgcaccgaaaacggttcttgaaacgtatgtccgtcaggtagaaaagcttgttcacctcacaattaatggtgaagaaattgtaacaactgataatcacccgttttatgtacaaggcaggggttttatcaatgcaggaagtcttctcgttggcgataaacttataagcgtaaatggcgaggacttgtttgttgagaaacatcgggttgaagaatttgacgagcctgttgacgtgtataattttcaggttgaagattatcatacttattttgttggtgattgtgcggtttgggtgaataatgcaagctctgattataatctaattgaaccggataaatacacagaactttctgagtcagagatgcgaataatattatctgatcgtggcctggatgatactgctgtgcaagatatgattgattcttttgatggaccaatatatagtcgtgaaggaaaccttggagaagtttttacgataactgaggcatctgctggtgatgcatcaggaatttttgttacaagaggttctgctggagctacactggcagaaagaattaataatcttgcattaccgcctaataatactgcacttgttgagagccaaatgcaacttactcgatcacaaattttacttgagggaaaagtagctgcacaacctgaatgggcacttattgctgatgatggcatatcaagaacaggcggcggatggcaagtagttactgatggtggaaaatatacaggtgcaattgataggtgaattagtatgaaagaaaaactaactattctttataattatcttaagaacaatgatcatatgcaggatgctaataggattgctaaaattctcgatgaatacgataaaaatggtgacttatcagaattatctataaaaaaaataaaagcaatgtgcaatcctagatatctcggaaatctttatataaaagaatttcccgatccatataaatggtggaatttcttggctgaaataaaaaaatcaattgaatgaaactacgttgatgataagaagctattttatggattttgagaatggtattgtaaaaatagacgaggaagcatttagtcctaaatattcttttgaaatgttccgtcattcctctttttataagaattaagcttgttcaccttataacaaatggtgaagaaattatcacaactgataatcacccgttttatgttcaaggcaggggctttatcaatgcaggaaatcttctcgttggtgataaacttataagcgtaaatggcgaagatttgtttgttgagaagcactacatagaggaaacagatgtacccgttgatgtttataacttccaagttgaagatcatcatacttactttgttggtgagtgttgtgcttgggtgcataataaaaattgtcccccacacatgaatgaagatggcacattaaaaccaaatcaagagtataaagctggagaaaacggctacacatacaaaaccgatgcaaatggtaatataagttctgctcatgcggacgaattgaaattcaaaacccatgacggaagattgaaccataattcaaacacagccggtaaattacctggtgatgacgcaggccatttgtttgcagaccaatttggtggttctccggatttggataacctggtttcgcagagaagtgatttaaatagagctgtaaaaaatacagataattatcgcagtatggaaagggagtggtcaaatgcattaaaaaatggacaaaacgttactgatgtagatattaagttatcatataaaaacggttcatctcgtccttcttcttttaacgtatcctacaaaattgacggtgaactgtttagacgaatatttaaacaatagaaataatttaaaggagaattgatatgttacaaggatttgaagatgcttttacagatgcgcaggcaagaacgatatcgctagctttagagttattagaaaataacaagaaagaagctgatatgatatatatttatatttatcaaagtgatacgcagattttttttaacgcattttttgctaaagataagaaaatctaccttttaaacgattggttcgatgacgatcaaatcaatgatttttttgactgcggtgtggaagatgttgacaatattgttgaagtatgtgatacttacgatggtaaatgcccatatgagtttaaattaagttacaatgttaagactaagtcttttgatgcgaaatacaactatgatgatattgcaatggagaatgatgttgacttagtagatatttataaagaatggcagaaagaatgtgagtccgaaatctcttgtaattgagactgttagcatttgatgtttcatacaaaatagatggcaaatttattaatccccattaaaaaataggaggttaaccatgttaaaaggatttgaagacgcatttgttgatgcacaagctaatgttatttcgctttgccttgaattacttaagaattctgaaaagagtgcagacgttatatatgtatacatattacaaaatgataacgaagagtatattgacgcattttttgagaaagatggcaagttgttcacaaccaatgattggtgttcagatgctcaaattaaggaattctttcattgtggaatagaagatatagaaagcattgttgagctttgtgatacctatgatgcaaagtgtccacacgaattcaaattagtatacaatgttaactctaagtcatttgactcaaattacaattatgaaaatgtaactgatgtttatgataaggatgtaattgagttagtcgaagaatggtttaatgaatgcaaaaaaaatataagtcattgataaattttaaaagataaaattatggttgaagtcaatgagcaattagctgaagttatatccaactcacaaatagcctttttaaacggcacgttgcaggaagcattcagcctatactcaacacttatatgttcaaagcagaggatttatcgaagcaggaaatcttcttgttggtgataagcttatcagtgtgaatggtgaagacttagtaattgtgaaattcttcattgaagaaactgctgaatctgtttccgtgtataattttcaggttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgaagacttagtaattgtgaaattcttcattgaagaaactgctgaatctgtttccgtgtataattttcaggttgaggattatcatacttactttgttggtgagtgtgcggtttgggtacataatgcggagtgcatcgtacgcaagaatggtgagattgagattacagattgggaaggttatccaaaaggtggaccaaagccagatggaaaacttaaacttcttgaaggagaagaatatacaaaagcaagaaaatctgctaatagtgaaaatgctcagattcatagacaaaatcctgaattaaaaggaaaacaaattcatgaagtacatcctgttaaatttagtggtagcccaacgaaccattctaataaaattgcgcttacgcagtctgaacatgcaaaatacaccaagttttggaagcgaatacaagctcaagcaaaaaatcaaatgaaatgaggaaagaagaatgaatatagcggaaaaatatatgacggatatggaattgaatgaaccaagcaatccattagaaataaataaaactgaagataaattaaaaattaaatttccggaacagtataaaaagtttttgctatctcataacggggctgagggttctataggcgaaaattcgtatctcgttatatggtcaattgaagatattatctctttaaatgaggaatatggtgtttttgagtttacaccagaaattttatattttggttcagatggtggggatatggcatatgcatttgataggagaaattcagcagtaaaaattgttgaaattccttttgaatcgatttctgtcaatgatgccgttacattatctgatgattttgatgattttataaaattgatatataacagataaaaacaattatcaaaatttatatccaactcacaaatagcctttttaaacggcaagttgcaggaagcattcagcatatactcaacacttatacgttcaaggcaggggttttatcaatgcaggaaatctgctcgttggtgataaacttatcagcgtaaatggcgaagatttgtttgttgagaaacatcgggttgaagaatttgacgagcctgttgacgtttataattttcaggttgaagattatcatacttattttgttggtgaatctgcggtttgggtgcataataataacaaagcttgtcctgttcctgaaccaagaaaatcggaaaaacacaaaacagcagatggcgaacctttaacatataaatcaaattcaaaacatacgcctggtcaagatggtaattgttcagatgctggtattgagccaagaaattcatttgaattatttgaggattcgattgcttcaactgaaaaaactggtcatagatatgcatatgaaaaagaaacagatacgattcacagatttttctcaaatgcagaggaaacagaatgacactggtgtggttcagaaaatcaaggaaaaaattctttgaatataacaaagatacccaaagatattaaaaaaacatttacaaaagagtatggtgttaaatggaaaggaagataatatgttaattggcgatccttataaatttgcagttttatttgatagagtaaaaaaatggaatccatctttaacagataataatggtttttttgcactatgtattgatggaaaattatttcctgatgaaattgaaaatgcagtaatacctgtaggtgttagagatgtcaaagtagctttatctggaattccagttgatgaaaaaatatttgacatggattcaaaagatgcaattttgattttgtatgatcttgtatatccagagtttgatgatgagaaaagtgatgaagaaaacagggataatgattttagatatttgctttctacaaatgaattagttgatgataattatcttgtttttgctgtaggaaaagaaaggaaaattagaatacttggtacaaaagcagagtatgattttgaagagaaaagagatgttttatgtaattcaaaagtaactgaaataatcctcgaaaaagattatgttaataatgttattgctcaacttgaagagataaagtggaattaagatttgaatattggtacatttaataatcagcgaatcttgcactatatgcccgacaagtatacaagattgtacatctgacaattaacggtaaataaattatcacaaccgaaaatcacccgttttatgtacaaggcagaggctttatcaatgcaggaaatcttctcgttggtgataaacttatcagcgtaaatggcgaagatttgtttgttgagaaacatcggattgaagaacttcacgagcctgctactgtttacaattttcaggttgaagattatcatacttattttgttggtgattgtgctgtttgggtgcataacaagaattgcacacctgaaaataagcaatcccttaaggaacaccttgaaggtacagctgacaatactggagcaaagccaaacggtacgataaatggctgccatgaagaaagtcactttttaagtgaacttgatattgctggtggtgatctaacagataatatccaaaatgtaagtggtatagacggtgtaacttatgttgaatatacagcaaatacaaaaacgggaaaagccactaagacgatatatgattcaaatgtaatcagcactgatgattttattgatcgcggcttggacgcgtatgctaatgttcctgaatctgtaagtggaggacctgttactgcacttgataattctggaaaagcatggaatttttatattagagataataagcttattaccatgtatccatcggtttaaatagaaggagctttttatgaatttacttgtaaataatgaggcaaatgaatgtgttgaattacttattaatacgttagctgcgtgtcactttaaaaagtttattgaatgtgttaataagaaagaaaactggacagccgagctttgttggtgtttttttgaaaaatcaaatgataataaagagtattatcaatttgaaacttttgagggtgatacttatagaatgtcttataatgattttttggatattgtaaaacttgcaattatcagattttatcttggtactaacgatgttaaaatcaaggaatcattaaaagaatatatcaagaatacagtatttgattctattcttgataatattgatccatcattagcatcaggcgttcctcttgtttatgggcagtgatgtggtgagaaaattgtaaaaacggataatcatccgtacaaggcaggggttttatcaatgctggcaatctccttgttggcgataaaccaaaaaattgaatacgattgcaagggaaaaataaagagtatcacatataagaatcaaaattataaaatctcaaggtgacgtatgaataagcttctggcattactgcaaatactgataaaagaaacagatgaaaatcataagctgactacaaatcagcttattgaaaaactgtcggagcagggcgtatatgctcatcgaaacacgatcccctctgatatagaaaagctcagaaacgcaggctacgatattatctgcgataaaagtacgcagaataaatattttatgggcagcaggggcatggagctttcggagataaaaatgctgtgcgacgcagtaaacgcagctcagtttatttcggaagaaaaatccttccagctgatagacaagctgttttctcctctgagcgactatcaaaaggaagaaataagaaatctcattcagcagccgagcgaaaacaaggcggacagtaaaagcatatattatgccgatatcatcaacactgcgatcacgcagcgacgtaagatccgttttcagtattacgaatataatgaaaaaagagaaaaaattctcaagcataacggttatacatatacggtcagcccctatgccgccgtgtggaacgacgacaggtattaccttgtggggtattgtgaaaaacacagagatataacggttttcaggatagacagattagcgaatatatctctgacagaccatccttccaaaccgtgtccgaaagattttgtgctgaaggactttattgcacatacctttaaaatgttctgcggtgagtcttcagacgtgatactgaaatgtaaaaataagcacatgaaagccattatagataagtttggagacaatattgatacaatcggaaccgatcgtcaatttttctgcgtaaaggtaaaagtagagctgagtcctacattttatgcgtggctgtttcagtatcagggcgaaatttgtatacaatctccacaaaatgcaatagatcagtttgtgcaaatgggagaaactatcattgaggtgcattcataattgtgcacctcattttttgctattgacaatcgaatttacgttcgatataatagatacaagacgttcgcagaaaagagaacaaggattgaaaggattgaagatttatgacttttggcgaatacctgaaacaaaaacgtcttgataaggaaataacgctgaggggctttgcgaagctggttgacatatctcccgtatatctgtgcgacctggaaaaaggcagaaaagcggctccgagtatggaagtcatgcaaaaaatggtgagtaagctggcgctgaataaagaggaatccgaaaggttttacgaccttgccgctctggagcagacggcaaaaaatccgataccgaaagatctgaatgcttttctgaaagacaaccgtgtgatcgtttccgctctcagaactgcaaaggatctggacgctacggacgaagaatggcaggattttattgataagcttagaaaaagcagggagggaaaaccatgaacgaaatgttctacagacaaagcgctcttgactgcattgcaaacggacttttgaaaaattaccgaaacggcatgtatctttacggtgctccccgatccataccaatagaggaaatcatcgaggttgaatacaaactgacgatagaatatgtaaaactgagaaaatcgggaaacgtcctcggtcagactgtatttgaaaactgctttgtccctgtgtatgacaaagaaaatgagcagtacactattatcgaggttcagcccggaacgatactcatcgatgaagctttgcttgaagaagaaaatatgggcagatacaggtacactcttgcccatgagctttcacattggatactgcaccataagatttttgataattcgcaggaatccgccgccaagacaacgacagaaagcaattctaaaaccgaatggcaggcagacgctcttgctgcttcgatacttatgccgaaaatgcagataaaaaaggcgtttttctcgatgcacggatcaaacgttaacgctaaaattttaaaaatggcagagctgtttcaggtgtccaggcaagcaatgaagatctgccttgcttcacacaatatgatataaccgaatttcggttatatttttactcataatgttctctaaaaaacgaacagaaaggacagaagaatgttagttgattcacagatccgtcaagtcggaaaaagaccatccatgccgccgctgagatgtccgttgtgcggaggaaaacttgcggataagcaaaacacatggtgcaaaaacaggatcgtagccacaacagccgaacaaggtgattatctcacgaagtgtcacaaatgcggtaaactgataggtctgaccgcagagaattgaaagtgagaaatataaataaaataagtatatcaaattactcgtacagagcatcatccacccatctgtgaatatgggatttgggctgtatatgcgtatgcagtcttagtaagaaattacgaatgaggtagaagcctgacaggtagcttttaaagctatgtcaggatttctgcctcattttttgaactcctattctgctttaaaagcggaatgggattttttttatgcctatttttaaggcatggcaatgccaaattgcaaaatacccttaagccttcgttttgattcaaacaagaaaaatcaaaacggaggaattacgatgaaaacaaaatattttgaatttagcagaaacggcggaagtgagaagtattccgaatttactgaggaagagtatctcaatgcaaaggaagaagaaaaccgttggtttatcagcttcggcgacagcgttctggaatgcgaggaaagccagtattcggatcacttttccaagaaggatcacggagaatatacgcaaaaggataggaactggaagaaggttattccggtttcgctggaacagtatacatacggcggaaattacgagcagaagattctcaatgacagtacagttgttccgcttgaggagcgcatcttagagcagttaggcttggaacatgacttggtaaagctcaaaaaggtcatgaaaaaactcaagccatacgaacgtgaaattatttatcagcttttttggatgaataaaagtcagaatgatcttgccatgaaatatagtgttaccagacaaacaatgcacgaaaaagtacatcgtattttggtgaaagtgctgaaattatttgaaaacgaaaaataaatcccttacaaatctcaatttcgttgccagtaagtagtgaaggggaaaatcgatgaaactaattcggagaattttctcgacagaatcttgacaaccgaatatcaactctgcaagtacgttaatcacacggtcggtatgaaatctcggcagccaaatgtgatgtccgccatgaccttgaaaaagcgagcgataaagacaagtcacagacctttggacagcagccaaagtcggcgatgaaacgtgtgaggataatgatacttcccaatgagggctaaaagagcgggtgaaacgcccatgatgcggttacgctgaccgcagcttgcagagttccgccgtgacggtcgttgagaacaaatatcacggaaaatcgtctgaaactaacgaatcagacgaaggcaaaacgaagttatacggcggtttgcgttatagcagaccgccatttacatattaaattcacaagaacaggaggctgatagtatgaatgatatatcagaagaaaaagaaacgccgaagctatttgactttcagctaaaatcaagtagattcggcattgatgttagaatcccgtgcataaagctttcagataatcacccatgcaaaggctgtgtgtggtatgacaggaatacagacgtactgttctgtccgtttcatagctgtgtaagatacagaaaaggctttgacgttccaaagaaaaaggtgaatgaaaatgctgattaaacgtggagatatattttacgctgatttgaatcccgttgtcggctcagagcaaggcggtattcgtcctgtgctggtggtacagaataatgtgggaaacaggcacagcccaacgatcgtggttcttccgctttcgacggcaaaaaagcattatcttcccactcatattcatatccgaggttcaaaaacattgcccaaggattcaatcgtgcttgcggaacagatacggacgatagacagataccgattgaaaagttacgtgggttcagttgattttgaacttatggaaaaagtagaaaaagcgatgaaaataagtataggagttgattttgatgactaaatttggacaagcagaatacagcgattttatggcgagagtatttgcggacaagcttgatgaaattcttgaagcagccgaaaaacagaatttcagcagcaaaaatacggaagatgtatacggtcagttcccgtcttcaagggacgcagcgtgaggaggtattgatatgttaggatttgtaatcggactacttgtaggcggtcttgcaggcgtaatcataatgtgtctctgtactgcggcaaagcaggaaaatgaaaatatgtcaaattcggacaagtaattttgtccggtttggtgataccattctgaaaagatttatggtatccttgttggttgaaaggagagtgagaaaatgccgacagtaacggtgatacagccgacaatagcagaagaaaaagcagtcaagatacgttgtgccgcatattgccgagtgtcaagcgattccgaagatcagctcaattcctttatggctcagacaaggtattacagtcatttttttgaggattcggaaacagaggaactgatcgacatatatgccgacgaaggtatcacaggaacccgtgaggacaagcgtgacgagtttcagagacttatgaaggactgccgaaagggtaaaattgacagaatttacaccaagtcaataagccgctttgcccgaaatacaagggattgtctgaaaaacgtcagagaactgaaatcgctgggaattacgatatattttgagaaagagaatatcgatactgccaatatgaccgatgaaatgatgataacaattatgggaggtttggcgcaggaggaatcaacttcgatctcaaaaaatataaaatggagttatcagaaaagatttgaaaaaggaacaataaatgttttttctgcgccctttggttataagttaagtagtggctcgttaattattgacgaaatacaagctcagatagtaaaagagatttttgagatgtttctgaatggtattggttatcagcgaatttcagaaatttgtcaaaataagtattcatcatataaggataattttagttattacggcattcgatatattttgtccaatgaaaagtatatcggtgattcaaaatatcaaaaaacatttaccacgaatacacttccgtatagaaaactccctaataaaggtgagttaattcaatattatattcaagccacacacaaatcgataatatcaaaagaaatgtttgaaaaagcacaagctctaatagaatgtagaaagcataagaacatattgtcagaatcaccgttcagcggaaaaattatatgcgccaactgcggaacaaaatataagcgtaaatgtagtggtgataaaatatactgggtttgccgcaggcatgataatttagcgcaactatgcacaaataaacgaattgaggaaaagtttattaggcagagttttataatacttcacaacaaactgttattcaattacaagcaaattcttgtacctctccaaacgtcgttacaggatttaaagctgaaaagattcagcggaaacaccaatgttatggatattcacaaagaaatcgcaaaacttaaggaacagacacatgtactcgcaaggctgaaaacaaaaggatttctggacgaggctaagtatattgagcagactgcgggacttacagctaaaatcaataaactgcaatccgagctgaaaaagcttacacgttccgacgatgaggatgaaacgcttgatcagattgaaatgttgattgatttttttgaaaagcgagataatccgataaccgagtttgaagaatcggcatttgaaagtatcgttgagaagatcgtggttatagatcagtatgagctggagtttcacttgatctgcggattgaaattcaaagaaaacatataacagaaaatgccttgcagtaaaattgcagggcatatttttgttggttttggtactggatttccacagaattttgtagtattgttgtacacggaggtgaaattagatggcaagaaacagagtaatcccgttcggctactgcatgaaaaacggcgaaataacgaccgaaccaaaagaagtttatgcagttgcagagattttcagagaatatctgaatggcagcagtttacttcaaattgcaaagcttatggagtccgagaacattcgatataccgaggattctgaccattggaacaagaacatggtcaagcggataatcgaaaatgagaaacatctcggaactgacaaatatccacagataattgatgaggatattttcaatcaggcaaatgaaaagcggataagaaaggctaatacgcttaatctggtatgcgatgatttacaggaaatcagaaaggttacatactgccttgaatgcggagaaaagcttttcagaaaaaccaacggcaagggacgtgaatattggaactgcggaaatcccgattgctttaaatatgaatatcgactgaccgaccaaatgataataggagcggtattgaccgttctgaacacagctattgcaaatcccagcctattagagtacggcggcgaaataagcgtgtattcccctactgtcgatgttatccgtcagcagaatgagataaaccggatgacagattctgctcaaatagattttgacagagtgaaagctgagattttcaggcttgccgagctgaaatacgattgctgtacttacaatgacagtccgcagaaaacagcggaaatcaaggctctgcttgaaaatcacgaacaattaaatacgctcgatattggcttatttaagtcctgcgtaaacaggattttgataagccatttttgtaccatagaggttgaattaatcaacggcacacgcatccaaaacatatcagaaaggaatgagaattgtgtcaaccgcatcgaatgtaacgataattcctgcgaaagttcagacggaaataaaccgtgataaatatcaccaattgagagtagcggcatactgcagtgtaagtacagagcaagaggaacagcaaaacagctatcaggttcagatcgcatattacacagacttgataaatcgcaaaaaagaatggactcttgccggaatttttgccgacgaaggtatcagcggtacacagacaaaaaagcgtaccgaatttaatcacatgatccgtatgtgcagaaacaagaaaatcgaccttgtaattaccaagtcgatatcaagatttgccagaaatactgtggattgtttggaatatgtgcgacagttgaaagacctcgggatcggagtgattttcgagaaagagaacatcaatacgatgacaatgacttctgaatttatgatagctctgtacggaagttttgctcaggcagaatcggagtcaataagcaaaaatgtaagctggggaaaagaaaaagcttaccgtgagggcaaggtacagtttcagtataaatatcttctcggttacaaaaaaggtgcagacggcaagcctgaaatagttcctgaagaagcggaaacagttaagctgatttttaatatgtaccttgacggatacacgcttttaaatatcgcagatacgcttatggctcagggcagaaggacggctacaggcaaaaatatttggagtaaaggcgaggttcagcgtattctgaaaaatgaaaaatatgtcggcgacgcacttctgcaaaaaagttttacggtggactgcataactcacaaagtggtgaaaaataacggtgaacatcctatgtatcttgtgacagaccatcatacgccgatagttgaccgtgacacgttcaaccgagtacagcaggagcttgcaaggcgaacttccaagcgtaaaatcagcgataaaaccaaaactgagcaaggcaaatacagcggaaaatatgctttatccgagctgctgatatgcggtcactgcggaactccatacagacgcagggtgtggtcaagaaacggcaaaaagcaggtggtctggcggtgcataagccgtctggaacacggtaaaaagtactgccccgattcacctacgatcaaggaagaacagctccataaggcgataattagggcgataaacaattactattcctgccgaaatgatattgcaaggattttaaaagcgaatattggttcggtgcttgaatgtcaaggtcaggaggaaattttagctgcaggaaaaagacttagggaaatcgaccaagcaagaaatgatttagtcaatttgatagcctccggcggctgcgacgaggacaagcttgacagtgaatttgaaaagctttatgcggaagaacagcagttgagcgaacgtcttgaaaatctgaaattgcagaacaaaacttcagaaggaacacaggcgaaacttgatgaaattatggatatgatagagcatgaaaagtttgagttggaaacctttgataatgtgctgatacgcaaattaatcgagtgcataaaagtactgagtaagaccgaaatattggtgattttcaagggcggatacgaagttagaacggaaattgaataacgattaaatttacggcttgcggagaaatctgcaggctgtttttgttgggaggcggttatttggcaggcaattttgatgggataaagacaagaaattttggcattgagatagaaatgacaggcttaactcgctgtcaggcggcaaaagcgctttcaggtgttctgggaggagaggttgtccatgagggtggcacttatgataaatatacggttaaagatattaaaagcagggattggtctattgtgtacgacggaagtatcaactgttacaatgcaaacggcgaccgagcttccaaatcctacagtgtggaaatgaattctcctgttcttgaatatggggatattccgcttttgcaggaggttgtacgagctcttagaaaagcgggcggagtaacaggtccgagatattgtgcaggcacgcatatacacatttcggcagacgattacactccgcagcagatacgcaatcttgtaaatatttttgcaagtaaggaggactttctgtgggacgctttgcaggtttcttctgctcgtgaatcctactgtcacaagatggataagcagttcatcgaggaaattaaccgaaaaaagcctaaagatatggaagaaataaagagactttggtatcacggcagaatgagcgaacagtttcagcattactcaaatagccgatatgttatctgcaatctgcactcattctttcagcatggtcattacgagataatggcatacaacggaagtcttcatgcaggagaggtaagaagtcagatagttcttgcgcttgccataagcaatgcggcaatgactaagaaatactgttctccgcacgtttcgcaaagcgataatatgcggtacagctttcgtgtatggcttttgaatcttggacttatcggagatgagttcaagaattgcagaacgcatttgctaaaacatttggatggcgatattgcatggcggcacccggaggacggaatcgctgcaagggcaaagctgaaagaaaaacgtgaagcagaacggcaagccgcccgtgagcagcgtgtcgagcctgtaagcgaggttcaggagttaaacgaaaatgtatccgatgaaaattcagagccgtcagaaagcgaatgcggcgattttgaagagtacgaggaagatgaagaattgggcatggaaatgtcaatgtgatcggaggtagagaatgagtaaaaagcagttatatattgcatacggaagtaacattaatctggagcaaatggcatatcggtgtccccattcaaaggttttgggaaccgctgaaatcaaggattatgagttggagttcaggggcgttgcaacaatcgttccgagtaaaggggcaagcgttcctgttctgatatgggagcttgacaacagagatttacccactcttaacaaatacgaaggctaccccagtttctacaggcaggaaaaaatggcctttgaaatggacggaaaaacctacgaaggtatggcatatctgatgaatcgtgggacaatttctccaccgagtcagcagtattacaacacgattttgcagggatacagagaaaacggtttggacgagaaatatcttcaaacagctcttgaaaattctcagcagcttgagtattacgtgaatgatgaattcgatgaggattttgatgatgattacgaccttgacgatgatatgcagatgagattttaaggagagtggttgaatgaaatacaatggtttttatgtgaaaatatctcccgatactgatctgcatcgggaggataaggacggtaatgatgttcgctgtaacgggtttacagttgaagtctttgcagataagtccgaaaagcttgagattgatgttttttcggcggcggtggattttgaactgttgaaagacagtcttgaagaagcggagcagtttgctaaggattatgtggattgtgaggaaaaagaatatcgcagaatgatcgatgagttcaatgaacattgaccggtagaaataatttttaatcggaatggtcataatttatctcgttttagatatgcatccatttggtatcagcaagacaagttaaagagcttgcaaatcctttatctacgagggtttgcgagttttttgttttacaataaaaacagcttccgaacagccactgacaactgctcggaagctaatgcttttacctatcatatatcgcttatccctgcactatctttcttcttgcacatgatcctataccccactctcccgtaaataaaactcagaacccagcctgccggcatcgacagccatacttccgatacgcctatgaccgataccagagcgtaggtgaaaataattcggaacgtgagatttattatgcttccggataaaaacagcttcaaacacccaagcccccttaacattccgttaaagcttgaatttattcccattattatataacaaaacgcaaggtctgtcatgtagcccatgcctgtttctatggcggaagctgaggagcttgacaagtccataaaaaagcccaagaatcgccgcctgagaagcattatcactgcaaattctatcaccgctatgcctgcacataacagcacgctcgccttgtagccctctctgatacgctcttttttgcctgccccaagattttgtgctgtgtaggtggataccgcatttccgcaagctatgaacggcattatcgcaaaggagtctatctttgaagccgccgtgtaccctgcaagcacgtccgagccaaagggattgacggcagactgcactattaacattcccaccgacaccactgactgctgtatcaccgatactgccgcataggacgacatctcttttaacaccgcccccgaaaagaagctgaactctgccctttcatggtcttttctgtataccttgtcagtaagaagcagaaacgatatcactgccgatactccctgagcaatgaaagtcgcccatgccgcacctgatacgcccatggaaaatccccctacaaacataaggtcaagccctatgttcagcaaagaggacatcacaagcagatgaaaaggcgtctttgagttgccaagggcactaaataccgacgcttgcacgttgtaaagaaacataaacggcatacctaaggaatatatccgcagatagtttgcagcgtcatttatgatattctgcggcgttttcagaagtcttaaaagcggcatactaagcaccaccccaagaaccgctatcaacgctgcgaccataagtgaaaatatcagcacagtggaaatgcccgtcttgacctttgacttgttcccggcaccgcagtatttcgctataagcaccgatgttcctatgcccgtaccagttgcaacggctatcatgaccattgtcactgcaaaggaaactcccaccgccgcaagagcttcgtcaccatttatcttgcccactattatggtgtccatggtgttgtaaagctgctgaaaaaggtttgcaaatataagaggctgtgcaaatcggaatattattttcttagggtcgccctctgtcattattacattttctggcttattcttcaaattcttcaccgcctgtgaatgtgggtatgtatctttgctggtttacgtcaaaaagccctttttccgtcagccccacctctgggatagtctgacacagcgacactgtaagcaccaccgtcatacgctgtatgtttccccctgtgagggcaagggcttctctgaaagctttctgtgcctttatctcgcctgtgatgttttcaccgcttagtatgcctgccactggaagggagtaaagccctgccaccttgccgtcaatagccatagccgcaccgccgccgttggcttcaacagctttcacagcgcaaagcatatccgcggggtcaacgcccgatacaacgacattattgctctcctgaacaaagcttgcggcaacagctccccttttaatgccaagaccttttataaagccacttcctatctcaccactcctgccgaaacgctccacaacgaatatgggcagaatatcggcttttgtatcaccgcatacaatgccgttgctgacctcaagcctgccttttacaagccttgtgactatgccaccctcgggcatttcaattgcatttgcagtaacataacccctctcaaagcctgcttttatctcaaaagaatgtctgtcacgccctctgggcaatatcacagtgtttttaagctcaggatagcaagttatatcaaactcatgcctgcaaagaaactcgccgttttcagccacaagcctgccctggtgaaagacctttttcactgtcatattttcaaggctatccataagcagaaaattcgcctttcttgagggagccaccgagcctatgatatcgtcaacaccatagtgccttgcgacgttgagagttgccatttttatcgctgacacaggggaaataccgcatttcactgcaatgcgcagagcattatctatacagccgttttcctttatatcctccgcagacttgtcatcagtgcagaacattatatcgtccgtagggatatgattttttactatcccctcgcaaagagttcggcagttcggctctatagttccctctcttaccaacaccgccattccgcaggccagccgctgctcaaggtcgcttatgttttcgcactcatggtcgtcacaaagcccggcgcaagccgcctgctgaacgtcacgaaatcccattgacagacagtgaccgttcacctttacacctgccctttttgccgcaccgagaagctttattatctcctcattccccaccacagcaccgcttatctcacccacagttttcgccctgcactctttgataacattggtgatatcatcttgcgttttcagggtggaaagatattgcgaagaaagctgtaaaaagctttctatgggcatttccccaagcatttcgcatatagcttttatgcccttaagaccaagagtattcgacatctgcatagggtcaaagaatacacagcccgttccgtgtggcactgcgccctcgcagtatgcaaaaggcgtgagctttgaggactctacgtgcatatgagcgtcgataaaagaaggcgcaaaatacattcctctgcaatcaataaactctgttgctctaggctcaaagtcagggcaaactgcggcgataatgccgttttttatccccaccgagccgctgtctattatccgttctctgtaaacgtcaactatccttgcgttgtaaaaataaatatcaaaaggcagcttacccttagccgccagtataagttcctttagctgccgatcattcataagctgcctctttcagatacaaatattatcagtgtttatatagcgacttgttcagcgcaagattgcaaagcacattgattatacatcttgacgccgcaagtgaagttatctcgctcacatcaaacggaggagatacctccacaacgtccattccacagataccgggagctgtcacgagcttaagaagccttaaaagctctctcgggagcataccgccaaaatcaggtgtgccagtacctgggcagaaagcagcttccagaacgtctatatcaaggctcacatacactgccttacagcccttccatgcgatatcgagagcaagctctgccaccttgtcgataccatacttgtctatatcctccattgagatcgcagtacagccgctgtcacgggtgaattttgaccatgacttgcagcagtttccgcctatgcctatctgcacaagattttttgcgctgaggttaggcaggtgagtggaatgataccattctgtgccgtgcattttttcgtccatttggatagcgtcgcaatcgctgtggcggtcgatatggataacgccgatattgccgtcgatatactttgaaatgcccctgagcgtagggaaagtggtagagtggtcgcccccaagaacgataggcgttactccctgagagaatatatagcctatgccctttgttatctggtcgaaagtcttttcggcatttgcaggaagtgtgtaaatatctcctgcgtcgcaaagctttatattttcgtataggtcaacgccatagtcagggttgaaaggtgatatctgcgaagaagcgtgtcttatgccggcagggccaagtcttgtgcctgagcggtttgacgctccgctgtcatatgggatacccaccactgcaacgtcatattccgacaccttatggatatcctcgcagaaagggcttctgagaaaagtctcgtggcttgtgtatgtagggccgagatttgttcttgcaaaacagctcatgccctcgcttttaatgctgtccgcaggctctaatccaagctcaacggctctctttgccattgtaggaaatcttgtgttgccaaattcatcaaatcttgccgccgttttcatggcgtgcagttcatttctgtctatcatgatcatttctccctgctttcttttataagcggaaactgaagctccgcaatagtttcatcactgttgtccgtaagggttatgtctatacggtatatcatcaccccgacgcttccaagggtgtagccatgctcctgtgcaagacagcgcattttcattataagctcaccgaaatagctgtagcaattcctgtgaaaagcgcaaacgtattttcctcctgccactgttgtgaagctttccttgtcagcctgatctgccgagcagaacaccatagggcagacctcggaatccataccgtcagggtcaactgagttttttatggtcattgccaccttatcagtggcaagcacaggtgaagttccgcctatagcctcctcaagcttcataaactctataccagtgagatttgtcctgaacttgttgctctcccctttgagggcatatcgttcaggaagctcctttataacagggtcgtcaagcttgaagtctgtgttgttaagctctctgataaatttaagcttttctttcagcacacagcttatttcaagcttatccgctatctcctgctgtaaaagctcataacgctgtctgagaacacgctcggacttttcaaggtttctgtcgctgaaatagtcctctatttctttcagtgataagttcagcctgcgaagctcttttatagtgccaagcttttcacactgctgtgccgaataaaacctccgccctgtgagcttgtcaacatagtcaggtcttaaaagccctatcttatcgtaatatctaagccgttcggtaggtatgtttcgatactttgctatctcggttatgctcagaagcttttccccattcgggacaagctgtccgttttcgtctgtataaaacacagtgtatttcatatcatcagtcatatcttgtccaccattccaattattatggcagcttattcaagagcctgctcgtcctctgcccctgttcttatcttcacaacgtttgcaacgtcataaacaaatatctttccgtcgcctatcttgcccgtataaagcacctttctgatagtgtcgataagaagtccaagaggaacagtgcttataactatctccacctttatcttaggcagaagccttgattcaagctcagagcctctgtaaagctcagtgcttcctttttgtattccacagccgctcacctgcgtaactgtcatacctgttatatcaagcttatccaaagcatttttcagcatctcgaactttgcgacgttcataagaacgaccaccttgtgcatctttccgtccgccttgtagtcagaagcgttaagctctgaggcttcgtctatagccctcacctttgaaggctcgtcagcggcagcggtgatgaactgagcagtgttgagaagatccgcataactgcttgaaagtccatgctcgcacttgtcaagaccaactatctctgtgttctcgctaactctcagacccattgttttctttatcactgtgaacactatcaccataataagcgctgtccatgccgccactgaaagcacgcctgcaagctgtataagcagatccttcgggctgcctgaatatataagaccgcttttctttgcgaaaacgcccgtcataagcgttccccatgctccgcaaagaccgtgaacacttaccgcacccacaggatcgtcagcctttagctttgttataagctcaacaccaaacaccattacaaagcctgctgttatgccgataaagaatgctcctcctgccgaaactgtgtcacagcctgcggttgaagcaacaagtcctgcaagtgctccgttaagggtcattgtcacgtcaggtttgccgtagcgcacccatgtgatgaacattgcagctattgcgcaagccgccgcagatatgtttgtgttaaaaaagatatccccaagctttgccgccgcattgtcgccctgagcggtgagaagcgagccaccgttaaatccgaaccagcctatccacaaaatgaatatgcccaaagctccgatagtgagattatgtcccggtatggctctcgccttgccgtttttatcaaacttgcctatccttgctcccacaagcagcgcacctataagtgcggtagttccgccaacaacgtgaacggcagttccgcctgcgaaatcgtggaagcctatacttttgagccagcctgcactgttccatatccagtgacctgttataggataaactattccgctcataacagccgaatatgtaagataagccttgaactttgttctgcctgccattgctcctgaaactatagtcgtggcagttgaacaaaagacagttgcgaacataaggaacactcgcttaggcagatctcctgcggctgcaaactttcctgctgtgaacaggcttggcgttccgataaatcctcctatggagtcgccatacaaaaagctgaagccgataacccagaaaagaacagagcctatgcagtaatccataaggtttttcattattatgttgcctgcattttttgctctggtgaagcctgtttccagcattgcaaagcctgcctgcataaagaatatcaaagctgtgcagagaagaacccacacggtatccagagatgaatacattatcgcacttcctttttcatattatttcttattttgccacatgaacgtctgcataactgaagttataccagaacatcgggcttgggtcatatgtgaacttgtcgcttactgcgtaaacatcagatgatgtgtaaagtccaaggtaagggcactcatcagcaaatatcttatatgcgtcagtatagtaacccattttctcagcgtcgtctgttgtctgagccgctttatcaagaagtccgtctgcttctgtgcttgaccaaagtgtttcattcgttccgccctcgcaagcgttagagcctgcatataatgtctttaacattcccatagggtcaaggaagtctgacatcatgtatgtgccgactgcgttgtaatatctctcgccgttatcctttgtcttgtagccgaacatatagctgaagatatcgctgtcaggcacttccacaagattcattgtgatagcgccacttgcgtctaccattgacttgagaagctcagcctgcttctgcgtctgtgaagttgtatagaaatcaaactcaaagccgtcaggatactttgactttgcaagacattcctttaccttgtcataatcctgagtataaacatcgctttcggcgatagttgaatcccacttatccttatccatatacatcatggattcgctcattggaacaacagccgactgctttgcataatcgccgccgatagttgttgttatctgtgaacggtcgatacaatatgcaacagcctttcttgcccactcgtcatcaaacggctttgaagctgtgttgaatgcgatatagtttgaagttgttccctcgcatgagaggatattgaagttctgacagctctgatatacagacataacgctgtttgacataccctcgacaaagtctatctgtccgccctttgccgcaagtgctaatgcgctttcgtcctcgataacgtaatattctaccttgtcgatatcgagagtatcagggtcgccccaccagttttcgttcttttcaagaactatctcgcttcctgatgaccatgaagaaagcttgtaaggacctgtgccgacagtctttccgtcagcagtgccgtacttgtcgccttgctcctctgttacagacttctcgactatagtgcaggctgatgttgcaggaacatactgccatgatgagtcaggctgcttaagatgaactgtcagcgtccaagtatcgttgtcggcttcaaagctgtcaacgtttgcaaaaagatagctcatataatagttgtcttctgttactctgttaagagaataaagcacatcgtccattgtcatttcattgccgtccgagaactttactccctgtcttatcttgtatgtgtatgtagtatcgtcaacctgctcccaagattctgcaagggcaggttcaacttttgtgccgtcatgtgagaagttaagaagcgtgtcatagcagtcataacctgtgagagttgctgccacgatagtgaagtcggcagggtcaaatgatgacggctcctgagtatagcctactctgagaactgtctctgaatttcctcctgaagaacctgagcctgaaccggaacctgtgttgttgaagcagcctgtcatacagcttgaaactgttattgccaatgcagcagcggccgcgatcttgcgtgagaattttttcatgataactttcctttcttcaaaagatttattacatatccgcagcagtcttgctgcggtcaatgcctagcgggaaatgacaggcaacgtaatgcccgtttccaatgtctttgagctttggcgtgcggttgtcgcacaagccctctttgaaatatctgcacctgcctgcaaagcgacagccctcggggatatccactgcgttcggtatatctccctccagcaggatatgcttcttatcttcaagagggtgttcctttggctttgctgaaataagtgcctgagtgtaagggtgagcaacgctgttatatacctgctccaccgtacccatttccattaccgcccccagatataccaccgctatcctgtcgcaaacgtgacggacaacgttcagatcatgggatataaaaagtatcgtctgccctttatcctctttcaggtcgagcataagattcaatatctgcgcctgcacagaaacgtcaagtgccgaaacaggctcgtctgcaagaatgaaatcaggctccagcataagcgcccttgctattgcaagcctttggagctgaccgcccgaaaggtctttaggatatcttgtgagcaagtcctccggaagcgctatatactccataagctgttttaccctcgccttgtagacctcaggctttatcttatgcacctttgcagattcttcaaggctaaagcgtatagtctttttcgggtcaaaggaagcaagagggttttgaaagaccatttgcattcttgaacgcagctcctgctgttccttgcggctcacatgagttatgtttttgccgtcaaaatatatctcgcctgaatcaacgtcgataagcttcagaacgcatcttcctatggttgatttgcccgagccgctctcgcctattatgccgaatatctcgcctttgtagatatcaaagctaacatcatcaacggcgtggatatatctcgtctttgcctttgcaagcttgtaattgtcaaggcagaaatactttttcagatctctgacgcttataaaaggctgtctgtctttttcttcgctcattgtgatgtcacctcccgccatttgaagcaagctgtgctgtgcccctcagacacattttctgtaacaggcacacagctcctgcatttatcatcagcatacttacatctcggtgcaaaagcacagcccttgaacttttcatacagaagcggaggacttccgggtatgcttttcattcttttttctgtgtcgctctcccttggattgctttcaaggagcgcctttgtgtatgggtgagcagggtggtcaaaaatatccacaacgcttgctgtctcgacagcctttcctgcatacattacagttacgctgtcgcatatctcagccacaacgccaaggttgtgagtgatgaatattaccgacgttccgctttcctgctgtagcttttttataagctttagtatctgcgcctggatagtaacatcaagcgccgtggtaggttcgtctgcaataagaagcttcggctcgcatataagcgccattgctatcattattctctgtaacattcctccgctcatttcaaacggatactgctcgtatcttttctccgcaggtgttatgcctatcttttcaaacatctcgatgaccttttctcttgcttcacggcgatttaagtttttcttcgcccttagcatttctgctatctgctcgcctgctttcatgatagggtcaagggaagtcatagggtcttggaatatcattgcggctgtgctgcccctgaaatcacggagctgctttttgctcattgcaagaacgtctttctcgccgctgtcatctcttatgtagatatctcctgcatatctggtggtctcctcgttatggagccttatgaccgactttgatgttacgctttttccgcagccgctctcgcccacgataccatgtatctccccttgcttcacttcaaggtcaacgccctgaacggcgtatacgatacctctaactgtcataaagtctacagaaaggtcttttatttcaagaacgtttccttttttcatcttttacgcctccccgtttgccttaactgctgaaagcttctttatgccgtgtttcttttcgtatttcttgaatgacggaagctttcttgatgacgggtcgagatagttctgaacaccgtcgctgaaaaggtttatggatactgttacaagtattacgcatattgcaggtataaaaagcagtgccgagctattataaaggttgcccatgccgtcacggagaagcgttccccagtcggcattcggagcctgaacaccaagtcccagaaaactcagagtcgccattgatgtgatagctgtaccgatatcaagtgtgaactgcgatatcataggtgtgatgatgttcggcaggatatgcacgaaaattatccttgcgtctgaaaagcccattgatttgcaggcttcaacataccccgcctttttctctgtcattatcattgatcttgcggtctttgttgtaagagggatataagaaatacctatggcgatgatacctgtcatcatgccctttcccattaccgcaataaggataaaggaaagaagaagcggcggtattgcacttataacgtcccacaccctcattacgatactgtcaagaggacctctgtagtatccgcagataagcccaagaggaacacctatgactacctctatggcaactataagaaaggcattcagaatggaagttcttgcactgcatatgagccttgaaaaaagatctctgccaagtccgtcagttccgaaaatgtgtccctcagaaaaggctggagcatatatggcattcacgtctgtggcaagagggtcatacggtgcgataacgcttgcaaagagcgatacgaaaactatgaccgcaaggaatattcccgtcaccgccacaacaggcgtgaaaaacgttcctgctttatttttcttcttcattaaaaatcccaccttatttaagatcaactctcggatcaagaacggtataaagtatgtcgataacaaaactcattacaagataagctccaagcatgaaaagcacaagtatctgaactattggaaaattgttttcctctatcgccgatatgagcagaccgcctataccgggaagagaaaagacctgctcaactattactgtcgagcctatagagcctgctatcatatatcctgcaactgttataacaggaataacggcattgtgaaaagcgtgcttgtaggttatgttgctttgctttaatccctttgcagccgctgttgcgatataaggggattgaagctgatttatcatgttgcttcgtgtgatacgtccaagcatcgcaacgaacgtcagcgccattatcaggctcggtatcgttatacgctgtaagaactctccgaaatttgtatatgttccgataaacgaatatccaggaacgtactttgtcatgaaaataagtatcagtatgcttaccaaaaatgacggcgcacctgaaagcacaagcataagtcccgaaattgctgcgtctgagggtctgccttttctcagcgccgctgcaactcccattataacagctatcactgagcctatgacggaactcattatcacaagtccgaatgttattggaagccttgacattataagaccttttacgtcctgaccgtcaacatagtctgtaccgaagtcgcctgaaagaactccctttatccacctgagatactgtatatgcacagggtcgtcaaggtgatatttttctgtaagagcctgcctgagttcaggagtggattgattgttccctatcattactgtgagagggtctgcgtctgacattctcagaacaacgaacaccagaaaggataccaaaaacattatgactatcattgaaagcagccgtttgattataaatctgaaccttttcactttacattcctcctatatttacagctgcgctttgcaggattttcttgcttaactttcattttgctttttgaaaataatttacttcacgaaacttttctttcgatatacctatgatatatcctgtagcaactacaactgcaatactgaaaatcagtcattttatattttatgtataaactttttattaacgcaagctgttttttaaacttacagaaaatgttgtatgaataaagaaactttatatcctgcattttgttcatattcacaaatataagaaaagaggggcgctccaaagcagaagcaccccacaaatgaagatttggtaatcagtagaaagcttagtcctcgaacatctttcttgcagcgaagcatatcatctcggcagtgagatcagtgccgtattcgcttacgtcgatcataagatgtttgttgtcacggtcaccacgatttttgcctgtgacgtatttataatagttgtggcgctggcggtcaacacgttttatgagcttgtcagcctccggccatgaaaggtcataagtttcacacatatgctttatccttgcgtccaaaggcgcatagagaaaaacgttcatgtggtttggatattctctgagaacatagtctgcacatctgccgaagaatatggcggatacacgcttgtttgcaagatctctgatgatatccacctgcgcttttacagccttgtcggaataaaactgcgttgatgagccgtagccgaatgacttcagcaggcggtcagcgttcttgtcaagcatttcctcactgtcaagaaacgagtcacggcttatgcctgcacgctccgccgccatatctacaaggtccttgtcataaaactccacgccaagctctgccgccgcctttcttgcgacctctcttgcgttgcagccgaactcacggcttatggtaataataaactttttcatagtctatgctccttttttatttatgagattttctttcgtggcggctatcctccgctcctgtctggcttttatctggatcttcggcaaattccaaccgaatttcaccgacatgagccttagggaaaatgtcaccgcaaggctcaccatgcaggcaggcatgaacgacatcatgccatagcaaagcagaaaagccgctgcacctgtggcagaagcgcaggcataaatgttgcccacaaatatctcaggcttcttgttcacaaaaatatccctgagaactccgcccccaacgcctgttataactcccgaaaacacaagcaaaaaagtgttgtcagacacgccgctcctcattgccgctgttatacctgtaacagtgaaaatgccaagacctatagtatcgagcatgagcattgcagtatcataaagcttcaacgccttgccccccaggtcgccttttacagccaaggcagcaaacacaagcaccgatatcaaagccgccgcactcattgcaagggggtcacgaaacgccgccacagggtgacttccgatgacgatatcacgcattatcccaccgcccacagccgttgtcactcctattattataacgccgaaaaggtcaaaacgcctttttatcgctgtcagcacaccgcttgccgcaaacgctgcagtgccgataagttcaagtatcgtaacgataacatcaaaacgctcattcattcaacgtccctgcctgcatatttgtgtatcttccgcaccgccgtcgcctgacttatgccaagcttctgtgccacagccacagatgttctgtatttttcataggctctcatcacaagtccgctttcgtaaaattcaagcatatccttcagggaagcattctgtgcaaatacctcagacgaaccgcctgttatcctgtcaggcaagtcgaaaacgtccacctttttcttctcggtagtaagaacgatacgctcgatagtcctatgcacctcgtcgatattttctttccaatcatatcccaacaaacagcccatggcacgaggggtgaactcaacgctccgtgagtatttcttgtttgccgagccgagataatagtcgataaagcttttaagatcctccgcacgctcgccaagagaatacatctgcacctgataaggctcgaactcgcttataaactcctccgacagcttgtcagcacctttaagctcctccactgaatgttcagaaagccccacaggcacaatgcctgcttttgcgcatttttcaagaactgctctttgaagcctaggcgacagcctgtctatatgctttattatcacagcgtaaatgcccgaaagcggcgatatcatcgacctctctccaagaagctccttttctatgacttcttccccgacaggtgcgcagtcataggtgtaaagcgttccttttttgccgtatatagtggaagcaagatagcttttgccgcttcctgtgggaccatagatgtaacacggacagcctgcgtcacagaaaactcccgcaagccgccttgcgtctcttgaacggctgctttgggcgatataacgctgtccgccgtcacgtcctgtcataagctctatttcatcaagaagctttttgttctgatactgcaaaacattgtaacgctcccgcaggtcgtcaaagcctgttatctcccaagaggaatagcttattatcatctcaagctctccgtccttgaataccggtattcccgtgacgaaagtttcgtcattgtcaacgcctttttgcactgttgtgacacgcttgtggctttcaaaaaccatttgcgtcacgcaaggggaaaacatcttcatcatttcctctgagcctgcgaatttacctattatgtcagagccttttacgcttctgccgctgagataggagtttgaaacaaatctgaacactccgctgctgtcggcaatagtcactcctgggtggatactttcgagaatgtgccctagctgctcataatccatttgtctgcactcctttctgcggctttatagtttacacattaagtatctttgagaagaactgctttgcacggtcgctcttagggtgcttgaacacttcctcaggggtgccgtcctcgataacatagccgccgtccataaagcagactctgtttgccacctctgccgcaaagcccatttcgtgtgtgacaactatcatcgtcattcctgcctgagccaggtctttcataacgttcagaacttcgccaacgaactcagggtcaagggcggaagtcggctcgtcaaagagtatgacctcaggctccattgcaagggtcctcgcaatagccacacgctgctgctgaccacctgaaagctgagtaggataagcgtctgccttgccgtccattccaactctcgcaagaagctccatggctttcttctttgtttcttccttgttagcctttttaacctgaacaggacactccatgacgttttcaagcactgttttgtgcggccaaaggttaaactgctggaacaccattccaacgttctttcttatgacctttgcagccttttcgttaagctttttgttgtgcttgtcctcgtcgatgccctttagggaaactccgcctatatctatctcgcctgatgtcagctcctcgagatagttcaggcatctgagaaaagtgcttttgccggagccgctagggccgataacgcttaccacctcgcccttgtaaatatccatatctatttttctgaggaccttaagctccccgtaattctttgccagatcgtgaaccgatataacaggctttctgctttcagccattgtattttacactcctttttcgtcagatagcaacacggttgttgtgcttttctatacatcttgatgcgaactcgataacaaggttcagcgcccagtaaagaacgcctgcacagatataaactatcagagggctgaaagttataccgatagcctcttttgtcatcattgtcatttctgcaactgtgatgatagaaaggatagatgagtccttaacagtctgaacaaactgtcctgtcagtgacggaacgattattttcaaagtctgcggaaaaattattctcaccattgttttaaatcttgacattcccattgcatatgaagcttcaaactgtccctttggaatagcgctgacgccgctttcaaggataactgcggtataagccgctgtgtacattccaagaattataacgcctgttgagaacgctgaaacgttcagaccaagagcagggagtccgtaatatgcaagatatacctgcaccataaaaggggtgcatctgaatatctttataaacgcccttgcgataagctcaacagccttgttttttgaaaggcacatatagcctaccgccgagcctaacaccattgcaataaggatagacagcaccgatattgccgccgttgttccaaggccctgcaaaagcagcggaagcgctatttccgcaacgtgcataaattcgtccatattattgcgcctccttatcttctttcaagtcttttcttctgaagttttacaagctcttcaagtcctgtgcagataacaaaatacataactgcgatagcaatatagaaaggcaggtttatgtatgtctgcgttacaagacgctgagccgttcttgtaagctctacgattgccaacacagaaagcatcggcgacacctttataacgtttatgaactcgcttgtcagctgtggcaaagctaccttgaatacctgcggaaaaactatcctcattagtatctttggctcgctcatgcccaaggctctggccgcctccgtctgaccctttggcacagccgtaagcccgccacggattatttctgcgataaatccgccgctgttaaggctcagagcgattatgcctgacgccaggtttgaaaggtttagacccattactgcaagcgcctgatatataatgtatatctgcaccagcacaggcgtgccacggacaaagcttatataaactgcgactatctttttcagtatccttgaaggaagcgagtcgccgcccattctcatcaccgaaagcagcataccaacgcaaagcgctataagaatcgctgcaacggatacgaatactgtatagccaagacctttcagcagcaggtctttataatgccatactatgttgaaattctccattgatatataatgctccgccgtttgcgacggagcatttcctcctttcaaaggtgctttttactcggcagggatataatcgctctcaggcaggtcaacggcttcaccaaaccatttcttctggagctctgcaagagttccgtcctctttgaacttgtgtatctcagagttgatatagtcagaaagctctgtgtcttccttacgaacagcccatgatacccaagtgtctgtgccgaccatttcagccttgcctgaatcgtcggccactatctcataatcgtcaggattcttcattacaactgcggcgcagcttgcatagttctgagcaacaaggtctatcttgccgttcttaagctctgcaaaagcctcagggaatgagtcgtatttgagcagttcggcatagccgtccttgccctctgactttagcttctcgttgaatttctttgtatcgtcctcattgtagcaagaagtctgtgtgccgacctttttgcccgacatatcttcgatagacttgatgctgtcatcgccctttctctttacgaaaactgtagttccgttctggataggataagtcatcgtgtacttgcctgcacgttcagcagttacgccaagtgttgctccaacaacgtcatatttctttgcttcaagtcctgcaagtattccttggaacggcaggtcgatataatcaagctctacccccagatcgtcgcaaatcttagcaaacagatctgcgttgtagcctatgatcttatcgccgtccatgtattcaaaaggctcataagcggcttctgtcgcaactgtgagcttaccgttttccttgatctggtccagtgtgagcggtcctgtgttcttgctgcttccgcaggctgtaagacatcctgccgcaagtactgaagccactgccactgcacaaacttttcttaacattccaaatcttcttccgcttttcataactgattccaacctttcacttacttttctaaataattcggagcgctgacaagccggacaccctagtgccgccgtcaacgctccgttgcgtttgatattatatttattggaaggtgaattatttttctatctttattttctcttgccgatcttcttctgataagcaaggatagacatgaactcaaaaatgatatttgcgcccatataagctgttatctctgagtggtcatatggaggagcaacttctactacatcaaagcctgtaaagttcaggtctttcagcgctcttatatattgaagtgtttcaaaggaagtaaatccgcccacctcaggagtacctgtacctggtgcataagccgggtcaacaaagtcgatatcgaacgtaaggaacaccttattgtcgcccaccttttcctttatgaccttgagaagatcttcaggagaatatgtgtggagcttgtcccctgggataaccgtgaagccaaggtctgcggcgatcttgaaatcgtcaggatcgtaaagagaacctctcatgcctatctgaaccgacttctcaggatcaataagaccctcctccattgctcttctgaatggtgtgccgtgattgtatttctgaccgaaaaccgtatcgcacaggtcaaggtgtgaatcgaaatgcacaaggcttacctttccatgcttctttgcgatagctctaagttcgccaagggtgatagcgtggtcgccgccaatgcttatcggaactgcaccgcattcaagaacaccgtccaaggtctgctcgatagccgcatatgtttcgtggatataatcaggaattacaggaacgtcgccaaggtctgcgcccttgagtgaatccataatgttgacgcccattgcaacattgttaggctttatcattgccgagatgtttcttacaccgttaggaccaaatcttgcgcctgctctgaaagaagcggcggtatcgaacggtataccaacgatagcgaaatccaatccctctgctgaggtcgcgtgaggaagcctcatgaaattacccatattacaaaaacgaggagagcctgaggcgctcggtggctgacaattgttgttgatcatttgaggtcactttcctttcaaaatcactgagaaacatatccgcatgaccgttcaagtcatttctgaattgctctatgtgcagaattatatcaccattcctgcaagttgtcaagagctatttttcaatttttctgaaaattattcactttggaataagctttgttatcacttatacagcgtatttacgccatttcatacatatcaaagtcgaaactattcatttttgaatagtttctttgtgcaaatttacaaagggcaataatgcaatattcaaatgtcagactttcattttgttcacatctattttttattcaaagctgaataaaataagaatttttcattaacactattgccaaataaaaagctctgtgctatactgataatcaaagcaatgacgctcttataaccgatacggcaatgcctgtcggtttataagggcgttgttttttattattactaggtcaaactcagaaaacaattttgaaaggaagttttattatggcttgttttttagtaccagcaacagaagcgatcgttacaactattgtggcaaaggcagtaaagtctcacgaggcaaaggcagaggagcagacaaaggtcaaagctctttcggaggacaagcttcctctttctaaaaagataacaagactctcaggctttctgtggggcggctcaggtcttttggcatttgagcatctgtggcatggcgagatatctccgttcttcccattcctgacagcggctaacgacccttcggaaatggcagtagcattccacgaaatggcgactgtcggaacatcaatggctgttcttgtgacagcggtatgggctgtgctgactgtggtgtctgacaagatactgaaacgtaagccaaaagagactgcaaagctgggcggtgacgccgtatgacacttcttatcacactcataactgccgttatcatcactatagtatggtacacatcaccaaaagccagaaagcttaaagtagggctgatgtgctatatgtactggggcgcatctataatgtggctcgtggacgcactttttgaatacaaagagcagggcgcaggatatttcacccctgccgccgcagacatgataaacgacagctttttagggatctgcgttgttgcactcggcaccgtcgtatggctcggcactatgctcataagcgaccctgagggaatagtaagaaaagcccttacagagaaaaagcagtagatacactatactatataaataggaggaataataatgcgacttgttccaagagagcaggataagcttatgctccattatgcgggcatgcttgcccgtgaccgaaaggcacagggattaaagctcaactaccctgaagctgtggcatacataagcatggaagtaatggaaaaagcaagagcaggagcgtcagccgctgagcttatgcaatacggcacaaagcttcttaccgctgatgacgtcatggacggcgttcctgaaatgatacacgaaatacaaatagaatccacaatgcccgacggcacaaagcttgtgacagtacacaaccctatcaagggtgcaagcaagcttcacccaggggaatttatcgttgagaaaggcactgtcaagctcaacgagggagcagaaagcattgagcttacagtctcaaacacaggggacagacctatccagacaggctcccacttccacttttttgaggtaaacaaggctttggagtttgaccgcaaggcggcttatggtatgcggcttgatatccccgcaggcacagcggtaagatttgagccgggagagaaaaagaccatccgtcttatacctatcggcggtgaccgcataggctatggtctgaatggtcttgtaaacggaaaaatggacgatgaaaacatcaagcaggcagcctttgaaaaggctaaaaagcttggcttcaagggggtgtaggaaatgattgaaatatcgagaaaagcttactgcgatatgtatggtccgacagttggcgacagagtgcgcttgggcgacacttctcttattgcagaagtggaaaaagatttgacagttcatggtgatgaagcaaagttcggtggaggaaaatctctccgtgacggcatggggcaatcctgcaaagccactgacaaggagtgccttgacactgttatcacaaacgctcttatcatcgacagcacaggcatcataaaggctgacgttggcataaaggacggcaggatagcaggaataggcaaagcaggcaaccccgacatcatgaatggcgttgacaaaaacatgataataggcgcttccactgaagctatcgcaggcgagggacttatcctcaccgctggcggacttgacacgcacattcattttatctctccaactcaggtgagaacagccctttacagcggaatcaccaccatgataggcggtggtacaggtcctgctgacggcaccaatgccaccacctgtacacctggcgagttcaacatccacagaatgttggaagcctccgaagacctgccaatgaatttcggctatctctgcaagggaaattcaagcgacatcacaactcttgaggagcagataaaggcaggctgtataggcttgaagatacacgaggactggggctctacccctgacgttatcgaccacgcacttactgttgcggatatgtatgacgttcaggcggctatccacaccgacactcttaacgagggcggatttgttgaagataccgtcaatgctttcaagggcaggactatccacacttatcacacagagggtgcaggcggcggacacgctcctgacattatcagagcagcagcgttcccgaatgttctcccttcctcaacgaaccctacaatgccttacaccgcaaacactcttgacgaacatctggatatgctcatggtgtgtcatcaccttgacaaaaacgtaccggaggacattgcttttgcggattcaagaatacgtcctgaaactatcgccgcagaggacgttttgcacgatatgggaatattctcaatgatgagttccgactctcaggcaatgggacgtgtaggcgaagttatcacacgaacatggcagaccgctgacaaaatgaagaaacaacgtggcgcactcccagaggacagccagcgaaacgacaatttcagaataaaacgctacatttcaaaatacactataaaccctgctataacccacggcgtatcagaatatgtaggctcagtggaagttggcaaggtggcagaccttgttctttggaatcctgcatttttcggtgcaaagcctgacatgataataaagggcggatttattttcgcatcaaaaatgggcgacgcaaacgcttctatccctacccctcagcctgtgtgttacacagaaatgttcggtggtcacgggcttgccctttcaagcacctgtatcacgttcgtatcaaaatacgcctacgaggacggcataaaagagaagcttggtcttaaaaggcaggtgcttcctgttaagaactgccgaaacatctcaaaggctgatatggtatacaacaacgtctgcggtgatataagagtagaccctgagacctacactgtcacagttgacggcgaagttattacctgcgagccttttgacgagcttgcattggcacagcgttactttatgttctaaagcgaggaaacaaaaaatgatagcagaaaaaatattaggcaatctctctgaaagcaccccctctgtagaaatagacacagttgagcttgattggtttgaagccgagaaaaagcgtataaggaaaaccaccgcaggaggacgtgacataggcattgccattgacgaaaacctaaaggacggggatatcatctatcttggcgataaactttgcgtagcagtgaagctcacaagctgtccccttatcaagataaacgttcacactatgcaggaaatgggcaggctttgctttgagataggcaacaggcatttgtcacttaaaatatctgacgacaacgtgcttatcccacatgacgagcctacagaaaagcacctgaaaaacctcggctttgagtgcgagaacatcataggcagatttgacgattttatcgtctgcaaagctcacggacactcacacagccactcccacgagcatggggaacatcatcaccacgaacattcacactaaacggagctgataaaaaatgaccgataccgcaggacttatgcacattctgcaaatatgcgacagccttttcccagtgggtgcgttcacgctttcaaacgggcttgaaacctacgttcagcatgatatcatcacttcgccaaaagggcttgaagaatatctccattcttacatctcagtgctgccctacaatgagcttggtgcggcggcagcggcatacaatgctgacgaaaaggagctttgccgtcttgatgagatatactctgcggcgaaaacaccatttgagatacgaagcggctcagaaaaggtcacaaggcgttttttcaaaatatgcaacaatggtcaggaaagcttcacagggctttataaaagcctgacggagcagggcatatgcaagggtcatcagtgcatcgcctatgggctttatatgcgtgacaatggcatcgagctctcagaggggcttgcggtatacggctattccatatgctccgccatagtcacaaactgcgtgaagcttgtacctcttagtcagcttgcagggcagaaaattctcggagagagctttgagcttatatcctccgcttcagaaaaagcccttttcactgatataaacgatatcggcataagcggcgcaggctttgacctgcgtgcaatgcagcacgaacggctgtattcaagacagtatatgtcataagctatgatttatataatataataaggagtaccaaaaatgagctatgtaaaaataggcgtaggcggacctgtgggatcgggaaaaaccgcacttatcgaacgccttacaagagaaatgtcaaaagaatattccatatgcgttgtaacaaacgatatctacaccaaagaggacgcagaatttcttacaaaaaactcatgcctgcctgctgacaggatagttggcgttgaaacaggcggctgtcctcacactgccataagagaagactgctcaatgaacctggaagccgttgacgaaatggtgaaaaagcaccctgacacgcagatcgttttcattgaaagcggcggcgacaatctttccgccacattctcccctgaccttgcagacgcttctatctatgttatcgacgttgcacagggtgaaaagataccaagaaaaggtggccctggcgtgacacgttccgacctgcttgttatcaacaagacagaccttgcgccacttgttggagcttcccttgaagtaatggcttccgactcaaagcgcatgaggggcgacagaccgtttcttttcacaaatctcatgagccgtgagggcgtttctcaggtcatagactggataaaaaaatcagtgctttttgaggatctgaaatgaacggcagactaagcctgtcaacagcctttgacggacaaaaaaccgttactgaggacttatttttcgctccccctttcaaggtgtattcaccattttatgaccataaaggctgggcgaaatatatctcaatgtgcggctcagcaggagtattggcaggtgacgaaaacgagataaagctttttgtgggggaaaactgcaaggtcattttcacagatcagggctatcaaaagcttttcaacacaaacggcggcgtatcaaaacagagcataaagcttgttgtgcgcaaaaacgcaagactttgctatatgccccaccctataatgactttcacaggctgtgagcatatctctatgggcaaggtgaacatcacagaaagctctgagcttattttctctgagatatactgctgtggcagaactgcaatgggggaggagttcggcttgaagcgctttcgctcacgcaccgagatagcaattgacggcagagcggattttatcgacaacactcttatcgaccccgccgcactgcccatacggcaaaaaggctttttcgagggcttcacccacacgggatttatgtatatctacacccctgacaagacaatgctggaaagcatttaccaagccgactatacaggcgaccctgacagcgcacagctttgcgccactcacacggaacgtggcatagccataagagccttgggacgttcgggagaagagatttttgacgcttttcagagcattgcagaaaaaatccgcacataaaaacagcgtataaaatattgttaaactttttataaatgataaacaaaaccagtgaaagcctgctgtaggctttcactggttttttatttctcacgacaatattcttcatatgctttgtcaatacgaggcttcagggcgttatagtcatcatcaccggatatgaaaccatagcatggcacactcaggtctttgacggggcaagtttctccataatccttaaaatactgctcatcgtaatacttttccacaaagtcatacacatcaggttttataacgtcatcgcaaagcacgccgtccaatatatacataatatattccgcaccgctcattttgccctcacggacctgcacacagtatttctcgtcgctttcatcaataagctcgttaaaacccctgtcaataagccaccttaaaaacaatcctatatgatttgacgccaacagccatatttcttcctgctgttcctccgtgagcttgccctcaacattatttgttttcctatacagcttttcagtatcgtcccaatgccaatctgccttatctatagccatatgctctcccccttttgttatatacctttattgtatcacaaactatcttccatgtcaacattttccgaatgcctcacaagcacaccccctccccccttgtcaacccaaacaaaatatgctataatataagggattgtaacctacaaccatattaaaatacagataacgaaaggaatagctatggatacttccgcacttctttggtataagaccccagcagacgattggaacaaagcactgccccttggaaacggcaggataggcgcaatggtgttctctcagccacttgaagagaggattcagctcaatgaggactccgtctggtcgggcggcttccgtgaaagaaataataagtccgcactgcctaatctcgaaaaagtgagaaaactgctttttgaggagaaaataaacgaggctgaaaaaataatctatgacgctttctgcggcacgcctgtaaatcaaaggcactatatgccccttggcgacatgaacgttatacattataaagagagcgaatgtgacttcaagagcagaagccttgaccttaacaccgctgtctgcaccacagaatatgccataaacggcgttgactacacaagagaagtgtttatctcacagcccgatcaggtgcttgttatgcacataacggcttccgataaaaaagcgataagcgtccgtgtacgcattgacggcagagatgattattttgatgataactcgcccgttcatgacaacgatatcctcttttacggtggatgcggctcagaggacggcataaactttgccgcttatataaaggtactccacaagggcggaaaggtctacccatatggaagcttcataacctgtgaggactgcgacgaggtgactattctccttggcgcacagacaagctaccgctgtgaggattacaagggacaggctgtttttgacgttgaaagagccgaggaaaaaacctatgcacagcttaaagctgaccatatcgcagattacaagtcatactatgaccgtgcgaatatctccctttgcgacaacagctcaggtaattccaccctgcctacagacgaaagacttgcacttgtgaaagagggcgatcccgacaacaagcttattgaaatgtatcacaatttcggcagatatcttcttattgcaggcagccgagaaaagaccctgcctacaaatctccaaggcatttggaacaaggatatgtggcctgcttggggctgtaaattcactatcaatatcaataccgaaatgaactattggtgtgctgaaaactgcaacctttccgagctgcatatgcctcttatcgaccatatcgagaagctccgtccaaacggcagaaagaccgcaaggaatatgtatggctgccgtggctttgtctgtcaccataacactgacatatggggcgacaccgcaccgcaggacttgtggatacccggaacacaatggccaatgggtgcagcatggctctgcctgcacatatgggagcattatctctatgttcaggacagagagtttctcagcgagaaatatgacaccctgaaagaagcggcagaatttttccttgacttccttatcgaagacaaaaagggcagacttgttacctgcccgtcagtttcccctgagaatacctatctcacagcttcaggctcaaaaggctctatctgcataggtccgtctatggacagccagataatctatgagcttttcactgccgttgcggaagcttcaaaaatacttgaaactgacggaggtttcagaaagaaagtccttgaagccagagacagacttcctgcacctgagataggcaaatacggtcagataatggaatgggcagaggactatgacgaggtagagcctggtcacaggcacatctcacagcttttcgcactctatcctgctgacatcataacaatgcgaaagacccctgagcttgccaaagccgcaagggctacccttgaaagacgtctttcacacggcggcggacacacaggctggtcaagggcatggataataaaccactgggcaagactttttgacggcgaaaaagtgtacgaaaatgttatagcacttctttcaaactccacaagcgagaatatgttcgatatgcaccctcctttccagatagacggaaatttcggtggcacagctggtatcacggaggcacttttgcaaagcgagaacggcgagataattctcctgcctgcactgccgaaagaatggtcggagggcagcttcaaaggactttgtgcaagaggcggctttgttatcgaccttgagtggaaagactcaaagataaaagcctgccacattcactcaaggtgcggaaagaagtgcaggatagtgtgtgacagtgtaaaggtacacactgcaagcagcgaggtacaaaccttgtacacagacggcgcagcagagtttgacacggaaacaggtaaaacatacacgctcacattctgagcaaaagacaaaatttgagaggatattgaaatgagacattatcggataatggcagcggctgttgcagcaatttgcacgctgtcaggctgcggagtgcagataggcagaaacgagagcatgaccgcccccgaaaaaacatctgttgtaaccacaacaaagaaacagacaaacgatgacagcaaggctgacgagcaggctttaaaaagctacgaagaaacaaagatagtggcaaacgccataccttatgtgaagttttcaaaaagcgttgaagccgaaacaggctcagtttcaggcaaggcgaaagtaaaaagtgaccgcaagggctacaagggcaagggttatgtgacgaacatttccactgaggaagattggtcaagagagatcgagcttaccgactcacagtattatgaccttaccataacagtggcttccgatgtgccgtgtgtgaacggcatagctgtgaacggcaaaaagcttcaggatttttcagccagcggctcgggcaagtttgaaaaggtgactttcaagaacatctacatagaaaaaggcaagacggcaatatccgttatccctgtggacggcggacttgacgttgactgcctgaccctcaccgcaagcgaggatatatcaaagcttgaccttactatatcaaagcctgctctttcaaacaaagactccgactacaacgcaaaagcgctttatcagtatctttgcgaaagctacggcaagcaggtgcttttgggtcagcatgacactatcggcacatctgccgaaacagacatgatatacaaaaccacaggaaaatatcctgccatacgttttggcgaccttatgcttgccactgaaaaggacagcattaccaccgacaccgaaatgaacatcgccatggattgggcttcaaaggacggcatagtgggctatatgtggcactgggctgcccctgacgacaagcgtgaatattatgccgaccagacggattttgacatcaaaaaggcagttacaaaggaaaatatcgcagaactcagccttgaggatatcaaaaagcttcaaaaggacggcaaggtaagcaaagaatgtgttgctgtcgttcaggatatcgacaccgtatctgagaaactctccaccctccgtgatgagggaatagcagtgctttggcgaccgctccacgaggccagcaacggcgatttctggtggggcaatgacaaggaagcctacaaatggctttggaagcttatgtacgagcgtcagacgaaataccacaagctgaacaatctcatatgggtatggtcagcacagaatgccgattggtatgtgggcgacgaatactgcgacgtgctttcctgcgatgtttatgacgacggcaataaggacgcacaggtgaacataatgcttttcctgcaaagcatatcaaagaacaagcctattgcaatgagcgaatgtggaagcttccctgacatacagagcattgcagacgaaaaagccatgtgggcgttcataggtcaatggggcggaaattatcttatgaccgatgacggcaagcttgctgaagaaaacaacaccgccgccgagcttatcaagatgtataacaacaatctcactctaacaagggataagctccccgacttcacccaccttgcaagttccataaaggacacggaagaaaaatccgctgagagcaaaaagaatgatagctcaaaggctgacagcaagacgaagaaagaaaatacttctaaagcagaataggaaaaaaggggctgtaaaaaaacgcgcaataaaaaaagactgcaaccacccttaaaagggtaggaaagcagtcttttttgtggtataataaatttgatgaaaaaatacttggtggtacttaacattatatcattttggaagttgtttttcaatttgttttgtcaactatctattgtaacataacatttgtttatctaaaaatgtaagaatgtctcgtgagtacattatactttgttcataatatttaataaatcttgataacttttaactttgtgatatctaacttgacttgatgacattttgttgaatagtacttccgcacaatctatcttggctttttctattggtttaagttctatatttttcatcgagccttttgtttctgcaataaaaaatatgtgtttaacagttccttcgtagaaagcgatagcccagtctggtgagtaattgccaagtggagttgggatatgaaatgttcttggcagctttgcataaacgcaaacttcttcagcagcgtcaagttctttgacaaattttttttctacgctttctgttgccgttccgtctgtgaagacatagtcctggatagccttttttgcaaggaatgctttttcaaagctttgagatgatttttccgctgtaaagatattattatcatattcacccgcaatggtatcatagcttatgtggtcaactatggcagtagctttttgctcgtttatcaattctgtgatcgttataagaaattcttctgggttatttctgaacatatagagtttatctattcttatgccttgcaggatcttggaaacagtttttcgtgtgagagttgttccctcagcgatctttccgataaggtcatatctaatgtcactgatttctgtgtgctttaaagtgtgagttcttgttatgacatttgcaaatgagtcgccattatctaggtcgtaagagcttatctctgctttctgacttccgacagttgtggtatatcttaattctgataccataagatctttatttatgtgatatattgagtttcttatgagttcattgctgtcaaaatctactgtgtaagcatacttgtggtttatttctttccatagtgcctgaaattctttcttcgcaaaattatcgttcaacggattgtctttgacttttgtttcgtggccgtctgtaaacatatcagtaagcacattatcatcatatacagcttgtataagactatgtattccgtcagccataggtttgagttcgtctggtaattctgcaaccatatcatttttgatatcctgacgatatttgtctgtaactttacgtttcatatccacatagccgttctggataaggtaaaattcgatactgtttgctgtttcctcatcaatgatttttgtttcaccgtcaactttaacatatttgcccttgaaataatcgcttgttgcgacagtaggtctgtcataaaggacggttttgatatctgactgcaagtctgttacaaaagttttatagctttcacttgcgattactgtcagaatgtttatatcgtggacagattcgccgcagctttgcacgtccatgcgagtgccattttggttaacgcaaagacgcagacctctgcccacttcctgccgtttggcggtgttgctgtcggaatgtttcagggtgcatatctgaaagacgttaggattgtcccaaccctcacggagggcagaatgtgaaaagataaaacgtgttggctcttcaaatgaaagcagtctttctttatttttcaggataagatcgtaagctgaaatgtcatcagaaaattcactgcctcttttaagcttgctgtcaacacttctgcctgtctttttgtcaatgctgaaatagcctttatggacagcattgacgtcgctgcaagttgatttgagatacttctgatatggtgtatctatgagctgggtattatcattgaggattttcagatattcctgctcaaacatttctccgtattcgccaagcctttcatttccgtcctcatcatactgacgatactttgaaacttcatcaatgaaaaacagtgacagacactttatgcccatattaaataacttctcttctttttcaaagtgtgaaagaatggtttctctgatctggatacgccgcatatctttttcggaaacatcacctgttacgtcgcctgtttttatggtaactccgtttaagaaagttacggtgccgcttaatgggtctatttcagaaatggtatagctcttatactgctccatttcttgcgatatgtagaaaagatcgtcgcctactgacaatatacgcaattcacgtttgacgttatttttacgctttatttcgatttccatttttgccataggcggtttctttgatgagaggactatctgttcaaggtaaaggtaactatttgttcctttgagattttttatgtcaaagcctttgacctctattttctttacaagttttttgttgaatgcgtcaagagcgtcaagcacataaacaaggttgtgatgcttggcgtgagttgcagaataattcagggtgaagagagggtcaaagtttttcaaggctttctgtgtgacagctccgcccattttctgcggctcgtcgaggattatgatagggcggttagctttgataacgtcgatagggcgtcgtgagccaaattcatcacgcttggaatagattatacgagcctctttacttttgccgtcctctttaagtgaagatgcaaaagcctgtgtgtttattatcataacgtttattccgccgtcagaggagaagttatcaagctggttaagattagagctgttatatatgaaaaagcgtgctttcttgccgtaatgttccataaagtggtcttcggttatctcaaaggtcttatacacgccctcacggatcgcaatacttggaactacaacaataaacttgctccagccgtattttttattcagctcaaacattgttttgatatacacataggtcttgcctgtgcctgtttccatttcgatatcaaggctgcacctgccgaggtcttttataagctcaggggagagttttatattgttttcacgctgtattttatgcacattttccaaaagctgttcgcttgaaagttcaagggcgttgtttttaaagcctatatcatcatatgggtcattttcataatcaaaagagagctgagccacagtgggcttttcaagtgtgccgaggtcacggatataatgagaggtctttcggtagctctgtccgctgaacacgtttacgacagcatttacagcgtcggtttgatactgttgtattttaaagttgaatttcattacagcaccttcctaactgtatcaggcgaataagctgcaaatatctgctcaaagtttgttgcaacgctgtcatttgccattgagctgtcacgcataacaaaataatatggcttttgctttgctatcgcagttatcacttcgtctgtaacattatcatcaaagcaggcgataagatagctgtcttcgacattgaaaacagttttgccgccgatagtgcttttctctattttgcttgaaagcagaacgccaagatcaagcataacctgaaaaagtaggtcttcgggagttctgtcttctttgatattatccacagttcccattatggtatcaatggttatttcggcaggattatagtagacgtctttcatatttgtgctgtcgagtttgagaacacggaaacctgtgtcaaggtcactagccatttgcttattagcagatttatactctggtgaatcaatccaataggctttactaacggctactgcattgccctgtgcttttttctcggcaatatctctagtttcttttccctcagccattaactgagcttttattttcttgcctgctcgtcttattctttccttgcctatttcgcagatgtttttatagcctgccttgaaagcttcgcttttctcgtctgtcttttcaggaagttgtaccataatgaatttgcggtgtccgccgtcttcggcgtttaactgcattactgcgtgggcggttgtggcagaaccgctgaaaaagtcgagaaccattatatcattacatggatacatcgataatatatattttatataatctatggcttttgggaagtcaaagccaaattgttctgctttcatccaccttgtagatgtttgcgagtcgaaaaacaaaacagattttggcaatgacaattcattttcaaatagatagttctttagttgtggcattacattttcatcttttccaaataaaacataattgctatctattaactttttcatctctgcttctgagtaagcccaacctcttgtacccattttgcaaggcttattggttgtaggatgcataatactatatttgtttttgcttccaggagctgttagatcagaagctctgaaaggtccttttttatcgacatatgtgtaatgatcaaattcgtaatattttggatatttaacaagtgaaagcaattctgaatggatttcatcatcgcttaatttgcttttcattagttgctttgttatttttaaaaactcgatagaattattcttctttactttccaattggttggtaacatatctttatttttagccacacataataaatattcatgtgtgactgagacaaattttgagttgttttttgcagaattggaaacaataataaaattagcgatgatatttgattgtccaaatatttcagaacaaattttaattatactgtctaattcactatcatcaatcgaaataaaaataacgccgtcatcagaaagcaaatttcttgcaattttaagccttggatatatcatattaagccaatcggtatgaaatctgccgttgctttcggtgttctgaaaaaggcggttgccgtcttcgtcaaactgtccgctgcggtcaagataatcgtcagtattttctgcaaaatcatcattgtagacaaagtcattgcctgtgttgtaaggaggatcaatgtatatcattttgaccttgccaagataagtttcctgcaaaagtttgagaacatcaaggttatcgccctctatgtagagattttccgtgttgtcaaagtcaacgctttcctcacggcaggggcggagagtttcagcaataggggaatttgcgagcagtacagactttttcttgtcaggccaagtgaactgataacgttcctctttgccgtcaacaacgtgggtgtttatttcctgcataagcacgtccttgtcaatggcacggacgacctcgcctgtggtttcatctattgtttcagtaactgcgttaggaaacagctcggcaagctttttatagttctcgtcagctttgttttgggtacgcattttaagttttgtcatttagtgttcctccaattaccttgattaggtatttcattactacgcttgttagttcaattatatattcaatctcatcttcattaactgagtcgtcatgttttatgtgatggttttgaaaatcggtatagtatgttattatcttaacaatcatattgcataattctggtgatgcgttagcattatttaaacggctgcctatttctcgtatctgattttcgagacttttattattattaagtagtgattttacaagtaattcaaatgacaaacgcatgtcatcaagagtgtttctttgaaatattccactttcatactttgagagagcattttcatattgaattaaagattctggataattgtcgagccaatgctttgttttctgcacaagttgcgtttcacttattttattatcagaatatgtgccatatcgtttgtataaattttcttttaattcttttacttcctcattttttgagaaacatgaaaggtcacatagttcttttattatacaaaattgttctttagcctcaaataccattaaattttcccttaatgcagtccttttattaggtgctttaaatggattggtgctatgtggaatgactttgtcataatctatagcataggagttgcagtattcaataatttttgatccacttaaaccagaattagtttcagctagaatatcgcatgcatggctaataaaaatattatctaatttcggcattgtcattatctctccttagttgctttattctttgtaccaactcaaatttctttctgggctgcttttcagacctcgcaagcttttcaagtttagctatttctttttcaagcttttgtcggctttcatcaagctgtatctgctcatcaagagtgttgttgtccgcaatagttatgccgcctatctgtgcgacaatgttttcccacaccttgtcaaggtcgatgcctttgagctcaatactatattgatcgtcaggccgccattgtgtttgcataagcttggtgtgatatatcgcaagcttgcaactgtcctcatattcgaggataaacagtatattctgcggtataagttttgacagcatagctatattcttctcatcaaaatttcttctttttagcgttacaagcaacacaaagaaacactgaacgttttcacccgcagggatatttaccttatcagccgttatttcattgacaatagttatcctcgaaatgtcagcgtctattttatcctttgcggcggtgttcatttgaaatttagtgtaaatagcttttttaggcaactgcttgctcatttctgttgatttaggaagtcccagcatataatcacctcatctgataacaaggaaacagataagttcaaaatcgtcaagaccttttatatcgttggacaaaaagcttatttgtccaccaccaagaaagctgtcgatatcgctttcttctttgacctcgataatagaggctattgctttgccaagcaggtcagagaattttgacatatcttttccgtctttagtttctttattgaattttttatacacttgtggtataggttcagactttcccttgcataagaaacgcattttatcaagcattgcttttggcgaaagatgatcgcatacaacattgccttcatctgctatataaaccatataaaatgggtgaagtctgttctgattatcaatatttacgctgtcagaacgatttttcaatacgaagataaccccgggaggtgcgtcctctgacgcaggaacaactgagtcaagcccgaacggagctttttctatctcagggtgacgtttaacatattcaagaagatcaagcctaaattcattaagcccaagatccattatggaaattccgcttgacatatcctcgatatcaacaacttcttcctgaagctttttaagctgtgctttacgatattcaaggtctgttttttcttcctcgctgagtatattatcatcacctgtggcggtcatgtcaacgatcttcattctcgtttctaccttggatttgaggttgatgtattcatcaagagtaacgttaggccagaagtttacgagctggataactttgtttttgctgccgatacggtctatacgtccaaaacgctgtataatacgcaccggattccaatgtatatcataattgacaaggtaatcgcaatcctgtaaattctgaccctcggaaatacaatcagtagctatgagaatatcaatatctgttttcggcatattttcaaagagatctctgtcctttgaaacaggagaaaagcaggtgagtacagtatttaaatcagtctttttgagatccgctgtggtgcggccgtcaacagtacctgtgattattgctgtgttaagtccaaatttttcttttacataattgctgacgtgttcatagagatagtcagctgtatctgcaaaggcagtaaatattataatttttctgtttccctcgtttatagggtttgttattttcttatctataactttgtaaagttcctgcagttttgaatcgtgctcggctgttatatcacctaccatatatgtgagcagatcaaggatttcagcgtctttttcaagactttctttccattcaagccactccatatcggcaagatcaattttaacttttcgaccaaaggagaataactcgtcgttattttgatcttccaagtcaaaatcatcaacacaagagatatctgtcatatttagtactgaacttgtgtgtttattaaatttgttaatggtgctgatagtatttgttataagttcttttattcgttttagagtaagattgaatgaataaacagaactctccatacgtttcataagattgatagcggtaagtctgcgtattccttgttcacgattagcctgtgtgaaccctacgtttaccttgttgtctccgtagagttcagaatatttgctcattttactaggctgaatataatgtgacggtgtgtatatcgtcaatgatagctgcataagctgatcaaatatttcattataatttatcgctgattttatatcagtaaggtttggttgcagcgaaataggtttaagcctttgtggaaatgtacctattgcacttgtgtcatagaacttctgaatgtgttttcttgatcttgcaatagtgacgctatcaagaacttcaaagaaatcaaaatcaagcattttcagcaggctttcagttgttctttcggacggatcccacttgctccatatgttgaacgctttttgggcgttcttgaatatgtcgtcaatagaacgtttggtgtttagtttttcgtcaatgtaatcggtatggccttcataagcaagggcaagttgattttttaaatcaagaaatttgttattaacaggcgttgcggatagcataagcacttttgtcctgacaccagactgaatgacctttttcattaagatcgcataacgattaagcttgctgttaccgtcatcgtcatcaacaatttttccgccatttctaaaattatgtgattcatcaatgaccacaagatcatagttgccccaatttaagcgacctaagtctatgccattagattctcctgatgttcggctcagatcagtatgatacagaacatcatagttcaagcggtcagacgctatgggattattgacatagttatctttataggtgttccagttatttgcgagctttttaggacacaaaacgagaatggttttgtttctgctttcatagtattttatcacagctaatgcggtaaaagtttttccgaggcctacgctgtcagcaaggatacagccattatatttttcaagcttatttataatagcaagaacggcgtctttctgaaagttatataacataccccatatcttgctttctttaaaaccagtagcttcattaggcagaacatcttcagagatatcttcaagaaattcattgaagatgttgtagagtgtaacaaaataaatgaagtcaggggagttttcggtgtaggcagttgtgatattgtcaattacctcatcagtaacatcttgcaaacgggttttatcattccatagctcgtcaaacaggtcgatatacgatgagctgaatggagtttcaaacttatttatcatcaaataggcattgtttccacgttcacaaccaaggtcaactgttgtaaatccattgacaggcatatatgttgtatcgtcaacatttatgaatcctgccatattgtcatttgttatatttgatttaaacgttacctttttctttatccaatctgcacattctttagcgatagctctttgggtaagttcattcctaagttttatttcaaactcggttccatacaggctgcgttcacgatttagcctaggaatatagaactcacgcttttcttttttagccttttcattagtaaaagtcggcgaagtaaaaataaaacgcagttcatcaatagatgtcagctgtttctttaattcctggaatgcatagattgaaaagcaggcggcagcaatggaaattttactgccttttttgatctcgacagataaatcatctttaagcgtattggtgatattattaataatattcatagcatttttctcccctatatttaaaaagacaactttaatattcattataccacataatctactctttttcaatataataggataaaaacttggaataatttcacaatgaaaaaaagacttgtttcagcttttgcgtcagggaagtttcaatgctctcgtaaagtacacgataatcctttttccgtatggcagacattgtaacaacaggaacgccgagcttttcagaaagtgcggctgtatcaatgacaatgccctgacccttggctacatctatcatattgagaacaagaatggcagggactttcattccaacgaaatccgccagcatatacaggctgcgttttaactgcgaggcgtcagccataactaccacaaggtcagcgtttcctgcggcgatatagtcccgtgtgatgacttcctcatctgagccggcggaaagagagtagctgcctggaaggttggcgattatcaaacgcttgccgttccatttacattcgccctctttttggtctaccgtcttgcccggccagttgccgacgtgttgatgagagccggtcgtcatattaaaaatagtggatttgcctgagttcggctgaccaagcagggcgataacgggagtgtttccgtcctttttataaagctgactgctgccgtggtacttgcagtttttgtttgacggaccgctttcacagttactcatttgtcggcaactcccaccatactttttttactttcttcacgaccgattgcaacaagtgtatctcttgcaaatatcagaacaggctgtttctcatgattctgacacacctcaatggtactgccgcagagcagacccattgaggacagtcggttgactaagcggttttcttcttttatctccaaaatgcaataccgaatgccagccgttgcatcggaaagtgctatcgcattcatattacttcctccgattcattattatgtagttagtaaactataactgcataataatgtaccacaaaaaaagaatactgtaaaatccatttactgaatttaagcccgtttagtagcgaatctagtttgttgatgctataatagtattatggaaattctaagtcaaaaaccaatatttcataaaggagccgagggacagttggctctttacacattggcacctggtattcgactttcattcaatgagatttacacaagcagctgggaaaaaggagacagctcaatctttgaagaacgaatgctgatagtcaatttttgtattcacggccgatgtgatgtttctctcgccaaaaatcggtatgccattgttaaggaaaatcaagtctgcataagtacagtaatgcccacaaaggatttttactaccccagaagtttgtacgaggggatacagctttatctagatcttgatattttgcgtgatgaaaacggacacctatttcacacgctcacagatagctatggccaaggaggctgaaacgctgatactcatcgacttgaaaactcgcataacggcaaaagaattggcggaaagattcagcgttagtgagagcagtttcaagttctatgtgaaaggtatccttggcgacagttatctgaattgcttccgcaagaagagaatggaaaaagcagctgaactgctggagaccaccaatctcaaggtcatcgagatagcaagtgcggtggggtatgaaaatcaaggaaaattcgcaaaggtcttggcagacaattatggtgtttcttcgccggagtttcggaggttatcgaagtaggggagagcgatagagtttgtgcgggggttgggtttgtatatgaagataaaccgccgcaggggacctgtgggtcctgcggcggatattttcgtgtgaaaactcatatattcgttattttaagattttacatcaaataatattctatccagtttagtttcaagtcgctctttttcaccgctgcctgtcgtgctgaatctcattatcggtattgcgtatttttgaagtatagcgttcttcatcatatcacgtttgtgctgatcagaatttttaccatgaaaagcatatccgtctacttcaatagccagaaccggcattttgtccagtctgccgaaaatcagaaaatcaatatgtgtcgcaaaattcatagcgtatctgcattcatcatcagtcggtcattttttgcggacagttcatacatgctatccttttctgttctctgctcctgcgtttgctctcgtttgatttctccctccgtatcttcttggcacaagcaggacaataccttgatgcaccagagcccgggacatattcaacgccgcacaccgtacaatttttagcgggcattgctgcccaccgttttgtaggtatgatatgtaattcatcgacaaagccgatgaatttatagtaaatcttgatttcctgcttcactgttccgtctgccatcttctcacgctccgaaacaagtatcttgtctatgagtgcgtttataactgttgcatccagttcttttaagccttgataatttcggataagggcgaggaagtcacggattccccgtgatttctcgtagctttcattaagagtttccgtcacctctttcagccttgcttcaatttcaagctgctctttctggtatttccccgacatcatctcaaaattccgctcggtaatacgctccatgaccttatcctcgtagagagaggaaaacagcctgtccagttccgcaaggcgtttgttcagcttcttacgttctttctctaatgctttcgccctgctctggtctgtttccgtgagccgcttttctatggccctgaccgccttttcatcattcactgccatatccgcaaaacagttgatgtcggcaagaacggcattgaataaatcccttgcttctatattgtgggcactacactcgcttcttccgtttcttgcataattattacatgaatactgtacacagtcgataatctctgggcgtttcctcctgtgtacgttcattgcccgcagagcacatccgcagtccacacacttgataacgcctgcaaaaatatttacaaatcctcccttgttctgtggaagcctacgacttgtaataagctgttggacaatatcaaattcctcctgcgtgactattccctcatgggtattgggtatcacttcccattcttcgggcagcttagaggggcgtttcttgcttttcatattggcggcaatccgtttgtagcctacaagatttcccgcatatatcgggcttcttaaaatgctcctcacgctgttcccactccaaatatagcgtttgtcctcgttcccctcaaaatgacgttcaaagcctgtttcgccacgctccgccgcataagcggcagggcgtaggatatgctgtttattaagatgtctgcaaattttggcaactccattcccttttaatgcaaggtcgaatatctcttttacaacatgtgccactttatcatctatcagcagatggttgtggtcggcagggtctttgatatagccataaggggcggtagttcccatgaatttcccctgttgaaacctcgcccgatatgccgattttatcttaacagatatgtcagcggcatacatttcgtttaaaatgttgcggaaaggcgtgatgtccatagcagatttattcaaggtatctacgccgtcattgaccgctatatacctcacgttatgctctgggaagaaaacttccagatataacccacaatcaagatagtttctccccagacgggataaatctttcgtaatcacgcagtttatcagaccgctttcaatgtcttttatcatattctggaaacttggtctttggaaatttgtaccagaataaccatcgtccacatacgtttttgctatgtgccatccctgctttttcacataatccgtgaggatggatttctgtgtcgcaatgctcgcactctcgttatccgtaccatcgtctttagataagcggcaataaatgccgactaaatagattttcttttcttctttgattcctgccatactgtaaaacctccgtatctgtcctatctgttttcatgtcccattgcgtacattctaagcggacagcccctcattgtcgaaggtgtcgccctcggcaatcttcttccgaatatcctcggagataatcgggacaaacgcttctgtaacggtctgtgtgccgacatattcacggctgattatcatctgcactggtgcttttggcacgatacgctttctctttttatctgctttcttatcctcgcccatacttaaatcttcctttccagacagggcagggaagagtttggaaatgtccccgccctgccaatcagataccattaatcctcgctgtttaattctttctgtaatgctttaaggagtgccgccgcttcatcagcgttcagcgtgattcccttgccgcacttttcacggttcggggaaaagctgcggatgtcatacttcggctctttcccattccatgaaatgagattgatttcctttgtgtagccactgtcgcccgtagacaatactgcgatttcctttacgatttcatactggatttctctcattctccatacctcaactctctgtatttacttcccgaaaaaagaagattagcggctgtcacggttgcgtttcctctgcaactcacgctccaaaagtttgatgatggtttcctccatctgcttcggcgttgtgttcttcggaaagtattttttcagcttgcttgtgttgattttcaaggtttctttctggttgcccttttcctccgtcataatcgcaaatatcgtatccatgtcaagccgcccgctctggcttaactgtttcatccgctgtgcctgtgagagtgagggcgttgcttcttcgctctccatcgtggcaaagaggttttcctgctcgtctttcttcaagaaggacagttccaccgcaggcgtgagggcgattttcccctcgtccaccatctgcaaaatcggcggtatcagttccgtcaggcggataaaacgctgcacggtcatcctgcccacgccgaagccctgtgccaccttgtcgtccgtccgcaacttcgtcacaacttgtgacgaggttaagtctgtgcggaaaccctgccgcttcatggcttcggatttcatcttgtaagcaaacgcccgctccgatggcaggatattctcacgctgcaaattgctgtctacaagggtgatgatggctcggtcacggtctaagggcaggacaaacgcaggcacggtatttatccctgcaagttcagaagcacggacacgccgctgtcctgcaatcacttcataaccgtccccgtcctctttcgggcgtgtgattatcggcgtgacaatgccaaattccttgatgctttccgctaactctgacagtgtttcatcttctgccacatgaaacggattgtcggggaacgggtacaagtctttggtctttaacaccttaaaatcctgtttcttcattcacatatctacctttctttcgctctgcttctatgatttttctgcaattcttccaacacttcgggcggtatttttgacagcagccgccccatctgctcgttggttctctgcaattcaaatatcttctgattcgctttctgcacctttagttcctgctcgtacttttcatcacgcatacgccccgcatagtctgattcctgcccaattctctctttcaaactgtcgatatacgcctgctgtttcccgatttccttagagaatttctccacgtctggcagccatgcagagagtaaatctaacgctttatcccttttcttccctgcgttaaaggcgttgatgtcggatagggcagacacgatttcttcatactgtttatcaagcctgccgcctaatttatagagccatgtggggacgtgtttccgcttggtttccattgaggactgcccccgttcaagctgattccaccgtgaggacatccgctcatggtaggcggtctgccactcggataatgatttctggttgcctaagatagctttcgctgacagcttattgtctggcgtaatcggcacaaagcagaggtgcatatggggcgttctctcgtccatatggacgacagcggagaggatattctgctttccaacacgctccgaaatgaagtcaagagccgtctggaaatacgctttttgttcttcgggcggtaactggttcataaattctggtgaagctgtgatgagcgtttccaacatcatcacgctgtctttccttgtcctgcaccccgcttcggctaccatgcggttaatctctttcttgtaggtgtactttggtggtgctatgagatggtaattgtttttagagcgttccatatctatatctgggttgcttttgtaggcttctttcttccgctcgttgtggcgttcacaagccgcaacgccgcccgcttttcgtttctggaaacgcaggattgcataaggcataggcggattcctcctttctttcggcgggtgaccgtcctttggggtgacagcggtgacggtggtgacagcagttttgggataccccctgccgactgccgcaactgtcaccctcaccccctgcatgacggtcatgtcgatgatgacggtgtttttgggatacccccctcgcaagagccgtcaccgtcatgccgccattcttttatccgaagccgtaaggcgtaggatagcagggcacagccctgccttaagggagtccagagggaacgtctggcacacgactttgcagggcaaagtgtagtgtgttacaccctgtaaacgcagtcggaaaaatcggaatgatttttctgaccgcaggggtggttttacacgaccgaaaagggcgagtaaatctcacgcctgcattttgcgtttacggggtgttctcccgtagggatgacagcggcagggtatcctaaaatcactgtcaccaccgtcactgctgtcacccgcagggcagagccgccagctttacatggctttaagcgtcaatgacagtaacaggggggtatcctaatatcgctgtcaccaccatcaccgctgtcacccgccctccttgcaagggcaatccgcctgccgtctttcctgcggctgtactggtagcagatacggttctcgcttaaaaatgtggtgcggtattcattcagccatttcgtaatcaccgtgggtatggtttccgtttcccccatagcggctaacagttccgttgccgtgcctatccattcttccttatccctcataaaatccaccaaccgaaaaaggacatctggtatcgtttctttcgcaagctgctcctgcgttttccgctccacaagctcccaacggcaatcacggaaacgcagcgtgtattcctgataaggcgtgtccctgcccgtcacatacagcttggcggtgtcagacgcacgtttctccttttccagaacaaaggtagcgtccgcactccccgttaatcctgtcgtcccagacaccttgttgaacacgtcgctgtcattctgctttcggatgtggtgtacgacaatgaccgccagagagtgcctgtcggcaaagtctttgatgagggagatgtccccatagtcgcttgcataggcattgtcttttgaagctgtacggactttctgcaaggtatcaatgacaatgagcctgctgtctgggtaatctttcagataatcttcaagctgcacgataagaccgtctgacagcttgcagcttgccacggcaaagtggagccgcccgcttgcttcgtccgtcaaacgaaataacctgtcctgtatgcggcagaacgtgtcctcaaggcagaggtaaagcacatcgccctccattgtcggcatatcccataaagggattccctgcgacacgcataagcatagcttcagcatgagccagcttttgcctatcttctgtgagccgcagaacagcgataagcctgtcgggataaggctgtccaccacaaaggatggtttctcaagcggttcataaaggagcgtttcggcgttgactgtctgtaacttctgcatggctttcctcctttcgggcggtgtctttgttttcgttgcacataggcgttgacctccttaaaaatagatttactcccacggaaaaaagtgagagtatgtaatgccgccaatcccacacaaataaaaaacagatttctttttcgggcggtgtcggtcacggttggagatatttcttcaatttccgcctttactttctcctttgcaatcgcaacagatttctgtattgccgaagcggtgcaatgctccatagcgacgatttggtaaaaattgaactcatactcgtagtagagcaggaaacgccgcctttgtatctctggaaggctcccaaccgccttatagagcgtttcattccgttcttcctcaaccatgcgttcatcaaggctcttaggcacacgcaacgcccgtctgtaaagggtttcgtcccatacctcgttaaactccctgtgccgctcgtcccattagaaaagattcctgttcctgcgctccatctgccgaaactccataaagaactgttccgacacttccaactcgtgggatttgccctgcccgtccttaaagctgataaaataccttgtgccgctttccgtggattcctcccgaagcgtgtatgccttaaccctgtatgccatcctgttgtcctcctgcaaaaaatgagtgaggggatttccatccctcacccagtagcccgcaggatggcaggctgttttagaagctataaaattttccgcagcttcttccgcagatggtctaacctcgcatagatggcaccagtcgtcaaatgcacaagcggggcaatctcctttgtggaatacccctgcattttcagcaggacgattttcaaggtacgcccgtccaccgtgactaatacttgatagagattttcgctctcaatctcttccagtaactccgcaaccgtacccacttccgcctgccgctccctgcctgccatgtcctcaagatattccgcaacgtcattcgtccatcggtaaaaccgcctgttggaattgaagtctgccctgtccgccatgcgtatctgctcaatggtcgcttcatcaacgccgcactcacgcagcagcttttcctccgcttctttccagatacgccatttcctgtcctcccgtccgtggttgtatgccattcttacttcctccaatcagaattgattgagagggcagagaaaagccccctcatcttcccaaaggaaaaaacaagggggctgaacgccttaaattttaattttctattatctttcttagttttattaggattctggctttgcgtttgtttacaacgctctgggttatgcccaacctcgccccgacttcacgctcggaaagtccgtcaaaaaagattgcctgtatcagctcctgttcactatccgacagcaaaggcagggcggctttcagcctgtccaccatgaccgcattgacaacggtttctgcaatgtccaccgcttcatcagtgataaagtccagaggattcccctcgctgtccgtaaatccgtcgagagatagcagtctattctttgtatctaatttttgcagataacgccaccgttccttgtcacggtagaagtctgtgtattgctccctcacgacttcaagcagacagccttgaatggggataaacagcttgtccatataggtctggtcggattccctgcaacggcagaactccgtgtaggataattccacatagccgccactttctctgatatatacctttcttggtgcatatttcaccataaatacctcccatctgaatttttgaaatgtaaaaaatccagatggagaggcggagaacgacaccgcatatcagaaacagccctacggcactttccaacaaaaatcgacaaaagaaaaaccgcaaaggctctgtgacctttacggttataggaaatagtaattctattgtatggagattgtacttctactttcaaggtgagaagtaccgttgcactggcagaaatttttttaactggtttcctgccgttctctgatatgctatgtattgataaattttgcttcgtatgagcagatagataactgcccgaaaaaaggacataaaaaaatccctccaaatttaaaaacaaattcagagggtaatttagggtataacaaaataacccacccgaatatcgttttttttatttggtgagtttgttctttcaaatacgaaacaaaaagagccgatgattcgtgaattgttccacaatttcatcggctctgcgtcttaagcgtctggctctttgatgacagttatcttcaagttgtcaactttaatcaatctttcttgtctgcattttggacaataaaggggataattctccaaaacagtgtccttcctaattttattacgggttttgctcccacaaacaggacacaatatccattcgcatttcatcataattagtctctaatcctttcaaatctcattttatatgacttttgcaagctgttaagctaacttgtggaacatatgccgaaccttatctatacggctattcgggcggcggggttggcaaataaatttaccaatagctggctggtatccttttaactctgtcaagcagactccctgcccatttgtgaaataagttaaatcgttcctgtattcttgaatacatctagcagggatttctcctttcagaatgacctcgtcattctttatctgagtacttacaatatctgcacaataccttggagcatcatgatacgcccgtgagagatattcctgcggtgcataaatttcaaagtggagatatggctctaatagttctgtccctgctttttttaaagcctgctccaatacgataggggaaagcagccgaaagtctgcgggggtacttacaggactataatacaatccatattcaaaacagattttacagtctgtcactttccatccatacagcccctgctcgcagccataaagaaccccctccataaccgcattttggaacgattgatttaaatatccaagtgaaactctgctttcatactgcactccgcttccaatagggagcggctctatggacaacccgacagaagcccagaaaggatttggcgggacttctatgtggatggtatattctgcttttctaagcggtctttccatatatataacagtaggctcttttatttctgcctccacatgatatttttcctcaaggatggcacaaatgacttccatctgcacattccccaaaaaagaaagtataatctcatgcgttgtagtatccacataatattttaaaagagggtcgccatctgaaatttctgtaagtgccccaagcaatatttcccgctgttcaggtttctttactgcaatcgttgtttggagcatagggagaggattttcaataaattttctctgcggcaacagcatttcgttccccaaaatactgtttagctgcaaaacatcatttggtaaaattacaatatcaccagagcaggctgtatcggatggatataattcaccgtttgtcggaacacacatctctgtgatttttattttctctttttcagatattctaataacatccctcaaatgcaatgttccgctatatatacgcacataaacaaaacgccgccttttctctgaatattcaatcttaaaaacctgcccgcataattcagattgaccttcaggcgttgatgaataaaatttactggcaatcacttctataagctgccgaatccccagattgtttttagcgcttccgtgataaacgggaaataacgttccgttttggaatctcctgttttcttcctgttccagttctgacattttaaacggtttccctgacatatatttctctaatagttcatcgtttcccataattaccgcatcccactgttccatatcgtcattgtccgttacatttatatggggatgctgcccaaccttttgcttcactataatttccgaagaaagctttgctttcatttcccgatataccattggcaaatcaatcccctcttggtcaattttattgatgaaaaagattgtcggaatcttcattgtctgtagtgcatgaaacagtatacgggtctgtgcctgtatgccatcctttgcagaaactaataatactgctccgtctaaaacggataaagaacggtatacttccgccaaaaaatccatatggcctggcgtatctataatgttgacttttacatcctcccactgaaaagatgtcactgctgtctggatagtgattcccctttgacgctccaaattcattgtatctgtccttgttgtgccttcatctacgctccctggttctgcaattgcaccactggtatataataaactttccgttaatgttgtctttcctgcgtcaacgtgagccagaatgcctaagttaattattttcatgtgattttcctcctatcaacacccaaaaaagggcataaaaatacccagtgataaatactcctatcactgggtaaataactccaatagccccaaaacacttatatgttttcgggcatataaaattacatgataaaagtattcttaaactgggtacaaaaaactaagccccatattaaaagtgaaacgggactgctactttttgttcccactatcaaattgacagtttatttaagaataccttgccgcatatttattaactccttgtataaaactgaatctaattatatcacagattaaccgatttgtcaagctgacaaactaaagcagaaaaagcggcaggatttccccctgccactaatcatctgtttatgcaaaaataatttccttttccacaatctccctcgcacaagcccttatgttattgaggcatcctgtccattctaaggcgttttctgcctttagctgttccgttatgccctgtgcctgtttcataccctctatgagcctttcaaagcgttcctgtgcctgtctgttgatgtcggcaaggtaggcgtttagcctgccgcttgtaagaagattggtgtatgtaactttacggtactgttttagataatctaaatgccgttgcccccagatgcctattgcctgttcttcttcggcgggtacagttaagcacggtatcaaataatccccttgcctttcgtatttgccgcccagttcctcaaataatgattttgccattgtctgttacctccacattcttttttattttgaatgtccgcaaaatccgtcctacatctgtcaatctgtgcgggtcatatataagagcacataaaggctgatgtgcaactacatcaagctttgaaaatctgtcctgtgacaaaacatcttctattacagagtacataagattttcagaatcatattcggatattttcttcttattcttagatgataaatactcctttttcttatgctcataccccttgtatagcatatcaaacacagagtacacctcgctgtttatgacctcaaaattgttatagcggatatatttcagcaggtcgcctatgttggtcttttcattgctctcgttttccgaaacaacaagccttaacctgttcttcgctctcgatactgcaacgttcagcatattagggtcatctgtaaatgtcgttatctcattatctaccgtcgaaattattatatcattcttttctctgccttgaaatttatgtaccgttgatatgtccatgtcattggcaagatcctttgtcagtgcagaggtctgtgcattatacggagcgattatacccagatcgtctgagttcagctcaggaataatagtgtattttatctcgtctatctgtcgctgattgtaacgtcctcttgcatgatttcccttaacggttacataagcccttagaacctccttttcgccattgtcctccgtcattatgataagctgatcattgtagaatttcttgttgcaaaaatctattatctttgggtgacagcggtaatgctctcgcagcagcgttcttggagcgtcgggaattacctttattacagaagaaagcaagctgttatcctcatatctgtatttttcttcgattgcagaactgtccgatattgcagttatcttttttcttgtttcctcagttatgacatttggcagctgttttagatctcccacaataacaatgttttttgaacttgacattgcaagtactcccgttgccagatccacctgagatgattcgtcaactataacataatcatatacaatatcttttagactgctgcgaacagagtgagtggtactgagtataatagggtattcattaagcacagctttcggtgaccgccacagatcgtccgtcgtaaattttcttctcttaccgttttccgaatacctcttcgccaaagcagccttcagcagagcaacagactttcccgaaagctccttttgtttatcgtcaaaatgacagccaacaagactcttttccagcttgtgtatctcttttgtaagctcttcctctttgtattcataatacagcttttgcagcacagggataatatcatttatatcccgcttgaagagcgaaaaatttaatattaaataatgcagcactagcctcagcttaaagaaaaatccaatatgcctgtcctttttctgcatatcctccagctctgcccacatctcaatagccgttgacgaattaaaatgtttcttataaaccttaacaacatcgctgtcgtatgtggaggaataatagttatcaaagtaagtcttttcagtctgtagttcagaaagctcacgtttgtgctgtgcaatgagattttcatattccaacagcttttttagatcagcctccaaagaaaatatttcattgcttagagctttcatctcatcttttgaaagtatatcctttgaaaaatcaggataatcagactgtttgttttctatgaaatcagctttgttgctgctgcttccaagctgagctgcaatgtaatcaaaaccatatttctgaagtttctcaaatacgttatccgtagcggaattgttgtttgaaactacggcaacattttttccgtttataagagcattggctattatatttaaaatagtctgtgttttgcccgtccctggaggtccttcaatgatacttatcttgttggcaacggcattgctgaccgctgtcatctggcttaaattgcagccaaacggaaatataacagtatctttcggactttttacatatatcttttggggctcaatataccgagccagtaccgtgtttttatccacaaaagagatcttattaagttgattgtacagtatatttgttccgtcattagcatgcaagcctatcttctttgatatcagtttgtaataatccagcaaatttcgtgctgcaggggttgacgcagcattttcataaattttaagctctttcgatgaatatacctcgctcctgccacccaagaaataaaatttgtaataacgtacaaaattccctgaataacattctgcatgctgtatgtggtcaagctactttccagcggctgtgacaaaccttaagtcatcaggatcaactttaacaggatcagtgagtatttgaacattgtcttttttatatgtgtattttttgccatttccaaaaaaaacatcaactgtgtacaaagaagaatcatcataatcacttacattattttttacttcacctttgataataacaagagatcggcgatcgctcatttaatcggcctttccgtcataatgacatatattacaataattatactccatttccttgcagatttcaactgccaaatcgttttttgtcagtaaatgtgaagtggatttatcccggtctttgcacccataatatgaacactcactctgcggtttataccatggtcatcatttttatcggaataatacacgtatataaaaggtttgccataacatttcagaactactctatcatcccaaaatcctatgtaacacctctaccacatcatcattttttaacccatagcttttcaaagaattgctgtcaaatggttcttgctctagcgagccgataaaagcgtcaatatccgcttttactgttgcaggtaattctgatatgctttcaagtacaagttcagcagttattctcaaaatgtcctttttgtgtttcttgatatcgctggaatcaacagattcaccgttgtcttttctctgctttaaatcaagatatgcctttgctttaaacaaaataagatactcgggacggagaacggataaaccatttcgcacaactcttccgtccatcaaggctttgtaatactcatcatcaagcagtattgctgataggcttgaaacagaatcatctatgtgaatcggcgttatccctgtcatctcacgaagttcaaaatcatttctgcaaaatagttctatcattttcgggtatgtgtcatcttctggtttatcaaatctgtaaaactgcggcttttgaccgctcgtggccttgtttctgtatctgccgatctcaataaactcccaaagcttttctccaaattcaggcgtgagagcctcaacgataagaaccatatcaagatctcttgtcgccctaaaagatgcgtcgttgctttcaaatacaatatcacaggcagcaccgcctataagcacatactgttcttcatatccggcaaaatgatttctgaaagtgtctagtccttttaccacacatattcctccaacatttcatttatagatatcattactctttcgtcctgcttttcttcatcggtcaatgataaagctacgctcaaggggtcttgtatcgacttctgcccatagtcaatgaaatagccaagctcaagaacaatacagccaatttcttctcctctgcggacttgtttcagcttttttatacctgtgtcagcaagctcttttttcgtcaccccataggtaggaaagtcattatctgacaacaatgaatactcacacaaagctttaatgccggcttttttctctaagtgaatatcatcaggaaacgcatatcttctgataacagggtttctcaaaatatgttgtatctgttcccacaaccgctttacaccaggcggaatcgtaatagctcttgacttgccttttgtgtcgagaatattcacattcaggtattctatttcatcaaaacatctgcttgctgacgtttttgatacacccaatttttcggcagctgttgatactgttactttatcccacttttcatatatcgcagtaagtatcagcttttgcgtcagaaatgaaataagctcgacaggtgcgatatcacgttcgcccgaatttgaaagcagacagccaatgaacggcaaatatatctgcttgtctttcagcacaaaagggataccgtcctctataagtttttcctttatataaggggtggtggatctaagaaatatggcacagttcagtcctgaaatattctgaactttagccctgtcctttcggagagcaacaagtccgatatcgttctttggttgaattgcaagccagcccattccgttggtttcaacattaaagagatcatatcgtcccttaaaagccagcggcagtttattatacaggtctttattttctttgatcgtaactatttgtcttaaagttttttctaagtattctttcatatgctcacctttttatatttgtaacgtattttaagttacaaatataaaataacatatttttatcaatgtgtcaagccacttacatatttttctcactttattttatgtacagcctatccgccaatctgaggagtgcaagcaggtagtcaagttcgcttttcaacgttgtctgcaacgggtcgccctcacggatacgcatggtgcgccttatttctttaggtatgacaactctgccgagatcgtcgatcctgcggacaattcctgttgctttcatatttatgacctccgttgttttttcaaaattgcagtaatattatttgcaggtcggtgggatttatgcaggaaaatggagagcatagttgtcaactgagttataggttagttaaatagaagtacaaaacaatcacgattgtgaatacaatgataaaagcaatagaaagtattgtagtttttgctgaattattatttgatttaagtgaaggggcgtgataatatgggtcaagtctatacagttgattatctatatttgcaatagcatctaaccaccgtgacctttgtctatacttatacgatgctctgcggtaaattgaatagatataactatattgttgccttaatatttgccagagatatattgttttctttttatcagttataactcctattatatgttcaatagattcgatcattcctaacgatagttcgataaacatatcaaatgtatagctactgtcatttgatgtataattgccgttgtttacggtgttcattacaaaagaactattcatcatactaagcagatcagcattaatattttgaatcaagactttgttttcttcatatttatcaggtgagttgtcataattgtcatcaattacagatatcgaattttttaacactttaattttctgttctcttttaaagcggtcagaatctacaagtgccattcttgcttttccatagctggagtaaaaaatagcctcaatatttgttggctcatactgctctaccatgttatagtatttttcacattcttcccaatcttctttagcttttgcacggcgtgcgttttcgagggaacgctctacaaaagaggtgttatcgactgtgactttacttcctgacacatcgaccttgccattaacttcgacaataagacgtttagcttcttcaggtgaatatttagcaccgcaatactgacagataaagcagccgtcctctttgactaaatcattgctaccgcaaacttcgcatacgatttgtttcatgctttaacatcttctttctgtgatttgtattttcgtgattaaaaaaattattatatttctggtccgctataatgtggtaaaccagctaaatccatgttttcgttataataatcaatactatatactgacaatgcgagtgcattacttccatttggtgttatggataacaggtagacatagtttccgcattttaccgaaaccgaatcagactcgtcagttaagtaatctccggtgtacctatatctttctaaagaagtgtcaagaatatcacacgaatcgctaatatcttcagaagaaagaccaacatcagtgtataaaattgcactggcataaaacattctgagtatatttaaagcgtcaacttccgaaatttcatcgctcgttttttcaatagtacagtctgcgtcttcgtaatattcccttatccattctcctagatcatcatatatgatagacatactttcaatgctgttatcatctgagccggtaatagtgcatttaagttttgttggtgtgttgttgacagttatagtgcagataacctcaatgtttctcgtttcagtttcattaatgctgttttcgtcataatcaaaaacagacatattttcttttgcataatctaaattcttttttacatttgttataaatgtatcttcatggacatcttgcgtaacctcgcttgtggttagcgtggtggtcgcaacctcatctgacgttgttgttgagatcgctgttgttgtgaaatcggtttgctgtgaattatcggttgattcattgctgcttttagtattgtttccataagaacttaaaatcaatgttgaaataacaagtgataatactaaataaccattcttcataagaaatcctccatattccttatagtgctttttttgacactatttattttgtactgtcattataccacattatttccacgatttgttaagctggctgcttaggataacgattacattttgtaaacaaagtgtaaattttgcaggcgtaaacgttgatagggggtgcttttgaaataaggagtggggagcgaggggtgttatttcaaaaagtcgggagattttgaaataaggggttatgtaaaaaagctcgcacatatttcagattcacgattcggcaacaggagatggtgctgaatagtggctgatgatatgtacgagcttatagctctaagtggttgattatgtttttatgtatgtggagcagaaacggttatggcaagaaaactatcaccagcaattacggcgaatgcgaaatatccgtaccccgtgaccgcaatggtaaatttgagcctaaagtcatcgaaaaaagacagactcacacagatgaaattgaacagaaaatcatggcaatgtacgcaaaggaaatgtcccagcgtgacattgaagataccctaagagaaatctatggtgcagaaatttctcagggacttgtttcacgcataaccgacataattcttcctgaggtaaatgactggcagaaccgtcctcttgacaaaatataccccgtagttttctttgagggaattgttttcaattcaagaaaagacaacaagatcatcagcaaatgcgtgtactccgtgcttggcataaacatggagggacatggatattcgaaaatgaatccgcaagtttctacgcaagtatatgctcagacctgaaaaaccgcggtgttacggacattttcatagcttgtcacgataatccgactggactttgtgatgcaataaatgcaatatttccaagggcaaaaaatcagctctgtatgacagatttgcagcctgacggctgatgagggttccaccctcaaactcccgaggtttattcgctttgggaatatccagtgaagatgaagaaaagcagcaacatttctgtcattgctcttcaccgttttattccgcagcctgcgtcggggcactcctcagcgttgccctgtttggactgcatctttactatggtcagaattttggcgattattgcgtttatacggttattttttcatacccgtaatacctttacaaaatcaaaattacaccaaagttcttttgcaaatgtcaataacttagccttacgcttttttatggattccaacgtccacacatcatcaatcatgaattcttcaagctcattctggcacttatatggtgctttcgcaaagtattttgagttcttttcatcaacatcttttttacctttacttgagttagccgactgaggatcaagtgttagatttccaatgctattgaggtacttttcatcaaacacttcaacagaaccaacatctattttaagcgcatcagtaataaccttagatttttcgcctgaattgctttgcgcaacaatatgttcgattgtcatgacgagcttcttgttttctttctgacgtaaatcctcgtgtgtcattggggtagcaactggctgctcagtacgtctaagatagttttcatatttccagtagaagtagtttttttcggggctgctgtacttggtgcaaaaatcgggagcagtaagtgcctgaataaaagcatcatcactctcaacgtccttgatcatggctattatttcatcagaagcatttttgaagttgccatcaaagtctctggcaaggctgtaccacttactttgcaatttgtttgccatcttatcaaagataacatatactctgaaactgaaaatttcacacagtctgcatataatcctaaatttggatttatcattagtttcatcgtatctgtaacacttaatcaaaagcggcatgaacgaagcagttctgtcaagagctattatatccatgaattcaaggtaacgaccttcatacattgatttgtaagctgagaagctctgctgtacattgtaagtatagttttctatgtagtcagataataacggtttatcttctttagcgccattgctgtttcgagccaattcttcgacagtgttcttgaaatactccatatatcttgtatattctttgatactactgtcagttttccatttttcataagcgatatagttgtactgcaagacggagttttcatcaactcctatattaagagaaatcatgctctcgaagtcacgataaacttcactaaaccttgactgtattttaccgagtatttgctccggttcatcaaggcataacgaagccttatacataagaaagctctttgttttttccaggttagtgaggctcttgccacgatcatttgttgtttcaaaaatcatagcagcttcgatactatcctgaatcagataaatcaaaacgttagttgagcatactctatcaagcagttcctcaatctgttcgtctgaacaacacttgatcttatcttcaaaaaaagccttagcatacaaaagtcgtttttgcgcaggggttttggtttcacttgcctttttatcatcaaggatcacagtcgaaaagaagtcgttatcatctgcttgcagttttaatatgcagagatccccgttctttatgaaatgcttgtacagcatagcggtttcgtcatattctatcgacgataaccttgaaatcaagcatttcataaagataatcaaagttgtaaaacgctgttgaccatcaacaatgtcacaaaactcttttttatcttttttcgtcatttgaagaagaattgtgccataatagtattcctgagaattatagttattcatatagtcctcgaagaaatccctcaactgcttttcttcccaagcatagctgcgctgataatcaggaatagaaaagaaagttttgccgttgaagatattatctattcttaattttccattgtccatcgttacacctcctattattcttctgctgccttctttaaggaattatagatttcttctgtgaaaattccaagaacttcacgcttgatttcctcatcgttcaacagcagggagaagaaatcctgattttgctctaagccctcgatcaaggcatcgtcaatatcatcgaagtaagagaactcaaagtcctttacagtattgttctttgcacttgctttcagcttatccgacttcatgagaatgtctctgatctggagcatagcttttacagcaacatcgctgtcataggcttttccagtccgagcatttatcgctgcaatgatttctgagagtctttcttcctttgcaggcgttaatccgaagttttcggcggacggcagcttgacaacaggctttgcgacaatatcggattttgtatgttcgtcctgcttcttttgaacaaactgcgtagctctgatcttgccgtcaagattgaagcctggtcctgaatgcttgatattgatatgagaaagcaggagaataatatagttatacttcttgtgaagctctatatcctcgaagctcgatacctgaatcatgaactcatagaaacggacgaagtgtcggagatcaacaacgatctctttctggcgttctatgctgtaatgctcgattaacttctgagacttgtcaaggcagaagttgactttcttcttatctggagcaagtactttttctttgtatagtatctcatttaccttatccacatcttcgggatcaatgattgcataagcatcaatctgagcttcaagatcatagatagctgtaggcgttaccgagttggaaagaagcgtcgttgtataatatggagcaaatgcaccgattatatcctcataggtgttcacaaagtcaagaataaatgtctttttctcaaacggagggcagattctgttcaggcgtgaaagtgtctgcacagcgtttacgcccttgagcttcttcattacatacattgcacagagtttcggctgatcgaatcctgtctgatacttattcgccacaagaagcacttgataatcgtctttatcgaactcttttgtgagcctatcttcaggaataccgttgatacccggctctatgtattctgtatcatcatcagggagcttcaccttgccagaaaacgcaacaagcgcacgaatgcccttgtatccctttttagagcaatagtcctcaaatgcttgacaatacttgacggcggcctgtcttgatgcggtgatgaccattgcctttgcctgtccgccaagttcctgcataacagttgtgcggaaatgctctacgatgacctctatacgctgggcaatattcgtttcgtgcagctcaacaaaccgagcgatctgccgtttcgcacttgcagtctgcatttttggatcttcttcaatttccttgtttatctgatagaaggtcttgtaggtggtgtaattctgcaatacatcgaggataaagccctcctcaatagcctgcttcatcgaatacacatggaacgcttcacgctgtccgttgggattgatcgtgccgaaaagctgtaaggtagtcggtttcggagtagccgtgaaagcaaacatcgaaacattctgctgtttgccgtttcttgcaagctctgcggcaatctcgtcctccatatcctgatacagctcatcacccataccgagggactgtgtgactgctgccatatcttttccggcagtagatgaatgagcctcgtcaataataaccgcaaagtgtttattcttcaagccctgaacactgtccacaatatacgggaacttctggatcgttgttgcaatgatcttcgtattgccgttgagggcgatagcgaggtcggcagaattgcacttttcgtccatcacacggataagccccgacttatgctccatacccatgatcgctttctgaagctgtcggtcaacaaccactctgtcggtcatgatgataacattatcgaaaatgatcttgttgtcagcatcatgaagtgtcgcaaggcggtatgcaagccaagcaatagtattggtcttgccggagcctgcactgtgctggatcagatagttgagcgaggtgcggttttcctctacatcggcaaggagcttgcggacagcatcgagctgatgataacggggaaaaataatactttccttgacttctacctttcctgtcttttcattctctttctcagaggtctgaatgaaaatgaatttggatatcaggtcgagaatggtatctttggtaagaatatcgtcccacatataatgtacaggataatcgtcctcacagggagcgtttcctgcacctgtattgacaccctcaccgttgccctgattgaacggcaggaagaaagtcttttcaccgtcgagcttcgttgtcatatagacttcgtgcaagtccatagcgaaattgacgagtgtgcctgccttgaataagaacagtctggacttcggatcacgctccatacggtactgatatatcgcatcgtccgttgactgtcctgcatagttgcatttcagctccatcgagataattgcaaagccgttgaggaagataacgacatcaattcgctctttgtcattcgcccacacttcttccatgacggtaaagcggttcatttcgtatttccgcatcagatctttattgaaagtggttgcaggctttgtgaacatcagctccagcttatgccccgacagctcaacaccgtgtcggaggacttcaagcaggctgccccttttcttcgtacactccgcattgatgaacgaaacaatggtatcttcgagcctgtccttatgtatcttgcggagcttctccattgtctcaggctgggtatcgttcagaaagccgaacagcatttcacggtcgatcgcaaaacggcggtcaaagtcggtcgcttttctgatcgtgtagccgttttggtcacggagtatgccgagcagttcagcttgatagtctttttcggattctattctattcaatttaagtttccctccttatatatttcgttgtaaagatcaatagggataaatgcttgattatgacattgtgatagttcacattgattcatggtgatgataaactgtatatcttcatctgagcaaatcaattccttgctttcccatttcttcagataatctctgaattgataaggataaatgccaatagcaatgtacggatttatcgggaagaagattaccgtgctggcattgcctataccattatcgcctcttgaaaatgaccgggtttttaggttcgtcataacaacaggattatcacttgtgataaacgggagagcctgataatacctgtttatgtaaaccacccacggcttatctattagaatgcgacaatattgttccattttatctggattggtgatgtatgaaaggataaaatgcttgacctgattatcagtgaagctaaccctttttacggctttcttttgctcattacttagcagattaccatatagagctaaaaatttgcttttgtagcttggaaaaatgttgctctgagcgttgttaatttgatagtctataaaatcaggaactctcaggaattgagcaactataaatttactcagattgcttttatcactatccgtgagattgatttttccgaagttagaaagcgtaacctttgcaataagatttgtaatagttctcaggcagggtgcttctatttcgtcagcaaagtagtgttcccattgtttcttgtcatcaaggaaatcaatgtcatagtagttctgtatgtagccgacattattcgtcgaagtggtataatgcttgaggtctttttgccgaacgccgatcatgtatttgtctttgccctttcccggcgtagcaaaaccattcagatacgccctggggacaatatgctgttttgtatagccatgatcttttttcttcggcatagttttatgctacctccttcttccccgtcacatactcaaatatcagcgacttcttgtattcctctattgtttcaatctgctgcttcttatcggcaataatagcgtttgtacgctccagaacggagtcgatgtgttcaacgatagcctgctgttcctcaacaggcggcataggataaagcaattcagcgagcttgttccaacgaagatcgcaggaacgcacacgaatacctgttgccaaagcaacaaatacatcattatacgccatactgtgcagataatacatgatgtatcgcttattctgttctgtgtcgagaacattcaggacgggagaagccttacctttggaatcggaaataccgatagagcctgcaaaaccgtccataccgtgaacaacgagatcaccaacatcaatgccctgatagccgatttccttgtcagccatagtgaagccttcttctcgtctgttgctgcggagcgtaacttcaccgtcacggaaacaggtgataaccccgtcatcatctctaacaggcttctgaacatagcggagaagatactttccacgctggcagtcccaatgtgtgggcatcataccgatccactgcacaccactatccctcatctccacatcaggatcaagcccctttgtgaccgcttcggtgatgacggaacgcttgtattcttcaagggcttcgatttgggattgaatgtcggagattagagagtcaatctcagcacattgttcatcgagaaaatcggctattgctttttgttcaggtatcgtaggaagaatataatctatttctcgaagtttcttccaatttgtatcacaagttcttacacggatgcctgttgctaaagataggaacagctcacagtatgccattgtccgcattaaatacatcatatatcgtttattctgctctgtgtcaagcacatttaatacgggtgtagcttttcctcttgaatccgagataccaatagagccagcaaatccgtccataccatgaaccaccaagtcaccaatttcgataccctgatagcctgcttcggtcaaagaaacagtaaaaccttcttctctccttttagaacgcagagtaacctcaccatcacgaaagcaagttattacttcatcagtttctaaagtagggcgagttagtagttccataaaatacttacccttgtttatgttccaagtatttgggattactcctgcccactctatcccgctatccttcatttcacgcattgctgttcaccgtcctatgcttcttgaaaaatctcatagctgtcaccaccagtgtgcagagcatagcggcacctgccacaccgcctgcaatcataagaatgatctgccagtttgcgatcatgaagtagtatccctgaatagcaccgtaggcaagaagccacagacccacaaagagaataagtctgatgagccaatggaagaacgagccttccgttctgccgctgataagaccgccatggtacatatcaccgaccttgctgtatgcgataccataggcgaccgcaccgatcacagcgagaataatatattcgtaaagtgtattgataggcagaccgaggggatcggtcgctctctcaaacaaaaacttaaaaatagcgctcattatagctcctttcattagccaaacagccgtgcgatacgctcactcacagacttttcaagctccaagaaccgctgttcaagctcctcgctgggcttcggctgctggtacttatagaaataacgggtaaacggtatctccgcacctgtcttgacaacaggatttttcttgcccaaatcttcctcaaagaaccactgggcatcgggaacatggggaagaacctcacgagccatatagtcctcgatactctcctcaaatttgacgatctccgtgtcctttgtctctttatcgtagataatgttgcctttcttatcacgctgaatttcggcagatttgtccatgatcgaaagtccgtcagcaatcttgtcaaggagcttcttgtctgctgttgccgtgctgagtatctttgtcagaacgggcaggaactccgcaggggataaatataccttatcatcatcggcgcatctcagcagttcgatgatagcttcgtaaacatgtgcgttgttttggtagttttcgagctttttcaattctttgcccgtcagctcctcctcagagttttcaagctctgccacctttgcaggatcgtacagtgaggagagcgaaccctttgacagcattgccctgatacgctcctcggtcacggcatagcttctctgcaacggctgcatgaccgtgtactcacgatagataaactccgtgtttgggtagatcttgcaaagctcgttctcagcaaagtctgcatacagcttcgtgatagcggaacggtcttcgggactgatctcgttcttcttgtttccaagagctttgcgcagcttgtggaagatcgaacctgcatcaatgagctgaattttaccacggcgctcctcacgcttgttcttcgacagcacccaaatgtatgtagcgatacctgtgttgtagaacaggtcaacgggaagtgcgatgatcgcttccatcaggtcattttcaagtagccaccgtctgatctggctttcacccgaagaagtaccgcccgaaaacagcggagagccgttttcgatgatcgcagcccgaccgagggcattgtccattttattcacagccgactgaatgaaaagcaactgcatatcgcctgaacctggcagtcctgcaccaaagcgaccgtcaaagcctttctggttttcttccttgacagcctgctcaacaccctctgctgcgtccttaccaccccacggcgtaccgaacggcggattttcgattacgaaacgcatctgtctgtcagggaaacagtcagctttcatagtgtcctgcatacggatattctcggcattctgccccttgataagcatttcagccacgcacatagcataggactcagggttgatctcctgcccaaacagacgaacattcgcagtcgggttatagcggtgaatgaagttatatgaagtcgagagcataccgcccgtgcctgctgcctggtccagtatggtgatctccttgtggtcatcaaatatatcgtcacaaccctctgcaagcagaatgttgaccatgagcttgataatatctctgccagtgtagtgatcgccagcctcggcattttcagagaacctacggatcaagtcctcaaagatatagcccatcttaacattgtcaatggtcttgggatcgaggtcaagctccgagaaagcctttaccaccgacagcagacggttattcttgtccattttgtcaatctgcttatcaaaatcaaggcttttgataatgtcctgcacattggcagaaaagccctcgatatagttgcggaaattcgctgcaagatgatcgggatcgttcacaagctccgcaagggtgtactcgctcgtattgaagaactgataccccgacacacggcacatcgcctttgcagggtacgcaggattcttcttgtactgctccacgacagcctgctttgtagcttccaatgcgcactcaaaacgacgaataatgaccataggaatgataacgtccttgtacttatcgctctgatatgtaccacgcagcttattggcaatagaccaaatgaagttgacctcggtggaaacatctacgggagcatcgtcccacatgacatctatcttatgttcgctcatttataattactccaatcttgatttcatattctcaatcatatcgaaaagttctgcatctaaaataaacgattctgaaaatgcgttcagcacaattccggcaacattcttctcgctatttcgtgccattggaatgacctctaagatatgcttctgtacttttgagaagtgttcgccgtattctcccatttcttctacacttgaaaagatagggaaaaagaattgttcgccgttttgcagaatgtcaggaatcatacgaacagcctctttagtgctgaatgtcttgccaatcatagatgaaagatcgtctccggattctttaacaccctgttcttaaaataccctataacgcaagtattcggtagttttctaacaacactactaaatgcatttccaagtttaacactaatatgcgcatcggatcctaatacaaccctacgtcctccaagctgaacatatcgatcaatgatactgtatcgaggcagcggttcgtcagaagcattcatgatggaagacgtattaacttcaagaataatgtcttttttaatcatagcatttaatatttcatccatgatagtatcactgacgttccaattatcaaaataacgtctgggaaaatctatatgtgccatcgcctggaactcgcaggtctgaattgattttaacataagattatagtattcatcaatcgcttttgattcctctatgttttttgcacctggaaaaacagagccatagcaatgatgaatgcttcctagaatataatcaaaaggcatagaactgtaatcctcgaattcagtagggaatagatgtggctcggagaattcaatcccaatcaaaatctgaatggagttataaatacgtcttagcctattcacttcatagaaatattctgacacatcaaaatttgtagaagctttattaattattcttcccacatttatttcagaagaattgaaatctacatgatccgtaaaacaaataattggaatcccaatctctatggcttttatacactgctcttccatagatgactttccgtcgggcgaaaaagtagtatgaatatgcatatctgccagcctcatattatccctccacataaaataatatggttattccttttatacacaaaaataattgcattatattgtcattgtagagacacacctactgccgtgcaaaggaaagacagtacacccacctttcatgttatggttagcacgggcgcatacataggtgcgtccgtgcgtcatagtattatggtgagcgcaaacgataaccattaaaagaatagtcaacaatggttagagggataattcatcattagtttttcttacgtttccttttggctttatgttttgcaaaagggtgacgtttttcttttcttatccctcttgttgtatcagctttattgtcagaaagcttgtgtatcacaggcgacatcttttcaggtgaatcagacataggggcgtcgttccctttattataatcacttactaattgaccacaggcagcttttattctattacctcttgattcccgaagttttacttccaagccagcctcctctagtctaatcttaaatgcaaccaattgttgcttgttaggacgtttgattctcttacaggcagtttcattatattgtaaaagattaatcagtacattttttcctctaaaccatttaccaagttgtcttacgtctgaagccctatcattaattccaggagcgagcagatatgcaatggtaatctttctgttatgtcgttcagaataggaaagcgcagcttcgacaacactatgaatgctattggatttcatgtgcggcataatcatgtttctagttgcttgatccgttgcgtgaagagagagtgtaaactgaatctttaaatgctcctctctcagtcgcttcaactgttcaactggtccaacagtcgatacatttatgccatctgtaggaaaattaagtccattgcgatcacgaagtatatgaatacttttaatcagattatcataattaaagagaggttctcccatccccataaaaacgattctgttgacacgttctttcaaaagaacgatttgctgaactatttcagctggtgaaagattgcgaataaatccattttttcctgatgcacagaaaatacaccccaccggacaaccgaccatagtgctaacgcataccgtattgccagtccttcttttaatgcatactgtttcaatgcagtagccatcttgtaattcaaaagcatactttgtagtatctccccctacatatatgtcttttatagtcatagtttgatttttaggacttacgccatttttatacaaggttttgaataaagacttagctcgttcttctcccatacatttggctacttcatcaaaagtataattgtacggattgccctgaatcatttctaatgtaggagggcccattttctctttatttgccatgataattcctttcctcgcattgtatttaagtaatattttacacaagccaacttgtgtggattataacttgaaaacatcaaaagggtacacaaaccccattgtatatattatacatctttttttctttctgtcaagatagaaattgcatcccaataatgtgaattatatcatttttcacttattgggatgcatacttacttagaataatcttatagttgcttattcaattccttgcttcttgctcctgccctttgtctggtccttcggcgtttttggctttttgccgagccttgcggcatcacgcttcatcttcgccctctcaaagtagcaagtcttttcacgcttcggagcgttcttctttgcttcgatagccgcctgattcagctcatcagttacgactttcagcctttgctccttagtatcaagctcctcctgctgggggaacggctctgctacgatctttttggcttcttcatggtcaagcctgagctttgcaaggtcagcctgagtacgctcaattctgccgtcaatgttgtagagggcagcttcaagacgattcaggttatgggcaaaactctcgatgagcttcgtagtatgtgaagcggcacctttcaggcaagcggacataccgccgctcatcatgttgctgtttgccgtcacgctcaggtcaaagccctggaatgagcctactttcacaggtgtatcggcatacttgatagccagtaccgcatcttcaagagccttagcagcttcttttctatcggtgtactcagtttcaccaatggtgatcttgaatacgggcagtttgcgttcgggatcagttggaagttttcggagtgcttcacggtcagtatgcagatcgatgaggatagcagtcaatctctgttcatgttcagggaaacgagcaaccctgtcctccatctcaaacaccgtgtttctatgctctgctgcgagaacccccagctccttcacatcgttttcaagcatcagcttttccttgattcgctcatctcccgtacagagagccttgatctccgagtaagtgagagcctgctggtccacatcttcacattttctcgacggagttttgcttgtcatgatccgagagataaacttctgtttattctccaaagtctgatagctgtacgcatcaaacgtacccttcgtgacatagcggaaaatctgaacattcttgttttcgttgccatgtctgatgatacgtccggcacgctgttacagatcagccagtcgccacggaatatcgaggtcgtggactgcgatcagccgtttctggacgtttgtaccagtacccattttcaccgtagaaccgagtagaacacggatttctccgctgcggactttatccaaaagatcggacttctgctgttcggtttggtttcgtcaatatcacttgacacattttattcgaacaagaattatgcaacgagaaagatatgatcatagtagagctttcttcgggctgccggaggcagcccaccgttgctcctgtttctttcttttattataccactgtcacgatgttttggcaattttgtgttcagtttctagggtacattatattcagaagtaatcgttgaacgtatacagaaagacggagtaaacactataatcatagcagcggtcatagctatactaagctggatatttaatatgtatcacaaaagtgcaaacaagtatcgtgaccaaaaagaccaacaatttcgtgaagcaagagctacatttgaatcggctttaaagcagatcaacaaagatgatactgattttaatgaattttatgatttattaaaatacactaaaacgactgaggaatattatcagttagatcagttaattaatgataaaaatgaggttgaaataaagaaatacataactggtagaatatttgaattaaatgacaaaaatccaactccatttaatgaatctgaatttgcatacaaaattatacttggaaagatacgaaatttaagaatatatgagaatattgttgttcctacactttatacattatttacagtgattgtaattacgattgctataggattagtattgaatataaataacaaccctttaggctgtttggtattagcaaacatattaatatccgctattttctttgtaacgtatggttcactcttgcttgatgacgataaagttttcttatcatcatctttagtaaaaatacttgttattctagaatttgtcgccgctacaaccgttgagtataatcagaaattcggcaatgcttttgccctttttgtaaatgtatgtttctttataacaacagttgtttcagcacatctaaacaatgtaaaaaacattactcgtatcttaaacaaaaagagcaaattgcgtggttataatatgatcatatctttcgtaaaatcacaaaatggtgaacttttgtcagatgaaaaactggtatctttcatttactttttcaaccataagatctatggcatttatcaattcaaaaaaattgagaataacaaattcgttttggtcaaagaaataaggaagtcatactatgattcaataatcgatcaaaaaaaggtcttttcagaaattgaagaaaactccaaatgcagaattattcaataagataggcattaccttgaatctaatagccaaacctgaaaaagccaaccgcacccaaatggatgcgatcggcttttttatcttattctatttttttctaccccagcttcaaaacattcagcaggaatatccagctagttccatagtaagccacaactgccaccagatcgttcagcgtggttatcatagggcctgacgcaacggcagggtctatctttattttcttgaagaaaagcggtgtgagcgttcccactgcactggatactattatggcaagtataagtgaaatgcctatacagcccgacattgcaaaggagtataccagccccttgcccttgaagaagaaaatatacagccccactgctatgaacgacagcacgcctataagagtgccgtttagaagtccaactcgcatttcttttgacacaaggtgaagcttctgctttgcagtaaggcctccgtctgtaagcacacggatagtcactgcaagggattgtgtaccaacatttcctgccatgtcaagtatcagcgattgaaacgccacaataagagtgagctgtgcaacaactttctcaaacgctcccaccactgttgacaccaccatgccaagtcccaacagcacaagaagccatggcaatctctttttcacactctgcaacacaggctcgttaagatcctcctctgcagaaagaccaccaagctttgcataatcctcgcccatttcatcatctgacgcctcgatgatattttgcgccgtgataactcccagcagtctgtttgaatcgtcaagcaccggtataatatactctgaataatccttcagtttttcgatacaattggcagtctgctcgttggcgtaaacatatgggaaagaagttgccgttatgctctcaagttccacctcgctgtcagccgtgataagatccttcagatctatagctccgctgaaaaccttattttcgtccaccacgaacagcgttgagatgttgtcattttttctcgcctgactaacaagagcgttcattgcctgctttacagtcatgtcttcgtcaatgataatgcagttcgtagtcattctgcttcctatctcttcctcatcaaatgaagcgataagcttgagttcactgcgtacatcaggtgcaacagcgtctataataaggcttctcctgtccttatctgtttcagacagaatattcaccgctgtatcagtgtcaagctccgatataagctccgaagccttgtggatatccatttccctgagatactcccctgcctgcttttcgtcaagatattcaaatatctctgccagcatttcaagactgcacacacgatagaatttccttctgttgagaacagaaaacgtacttattacctctgcgatatcactgccatgataatcgtcaagcttgttcatcatggctttcggggaatcattgctattgatgacagcggttatctcgtcgcagtgaatgttctttactgcgtcctcgtttaaaattacatttttgttcagttcatttttcttcatttgcttgtcctccgtttcatttttttatgacgtgagggacaaacaggcataaaaatgcccgtgcatgacaggtcacacacgggcagatatatcagatcacaacgaataaaacggcaacgcaaagcgaagcccgtcggctgtgttcacatatatacataatcgcccgttagacccgcaactgtcgctgtttgccactttattcacctccgtattatattagtccttcgacattataccattttagcaaagatctatcaacacccaaaatcttattttaatattaaaaagctgttaaagcaacggtgcaaatatccttagcacgccgtcaatgagccgtccaaagaaaccacgctttgtgtcctcaagcgtgcgctgtctgcacttgctctgagtgtccagaatgtccgccttaaaggtctttattatagatgaatcaaagaatatggagctgcactcaaaatgcaggaaaagacttctatagtcaagatttaccgaaccaagcaccgcaagcttgtcatcgcatatacagccctttgcgtgaacaaacccaggggtgtattcatatatcttcactcctgcctcgataagctgacgataatagcttctcgaaagcctgaaaaccacctttttgtcagcgataccgggcattatgatgcgcacgtcgaccccacgtttagccgcccttataaaagcgtcaaaaaggctgtcaccaagcataagatacggtgtgtagaaccacacataatcgcttgcggcatagagcatctcagaaaaaaacgtgttgctcacattttcgtccaccataggggaatcataataaggcaaaacatagccgtcgccacccttgccctctttttcaaagctctcccccacaaggtcatgaggtatcatgtcatttgaaaaagcgttccagaactccataaacatataggtgtagctttttacgccctcgcctgttatcttaaagccgatatctttccagtgaccatatttcgagcctatgtttatatactcgtccgaaagatttattccgccgctgtatgcaactctgccgtctattaccattatttttctgtggtcacggttgttgagctgtgattttataaaaaggaacggattgaaaggcacacattttatacctttctcaccaagcttcaaagcgtctgcaagagaatatgttgctatacttccaaggtcgtcatacattatcctgacgtcaacgccctgagccgcctttttcgccatgatatccaccacagtgttaagaaacttgccgttttgcaaaataaaatactccgcaaaaatatatttctcagccttttcaagctccttgcacatatcagcgaacatttcctcgcccacggaaaaatactctgcgctatcaagcttcaccataggaaaacccgttgcatcgcttattcttttcaccgattgagcaagccttttgtcctcacgttcaagctcccctatgcacttttccccgtcaggaagctcatagtccatgtgaagccttgcctttgtgatattcttttcaagctttttcgcagtattgttattgccgaaaattatatacataactgcaccaagcacaggaaaagtaagtatcacaataagccaaagggtcttgtagctgctctcctcacgctttgtgttgatataaagcacaaacagaaatgacagcacagtaagcacgatgctgagaagccctgccgccttgctgagccatttaagtataagaagataccacaaaaactgcatcgccacaggaactatcaccgccaccactctgcctgctattttctttacattgttccacgtcaactccgtttcgctcctttcatttatcatcttagggtaacacaacactatcattatgcgatgttaccactattataacaatttttttaacataagtcaacgccattgattttaactgcaaaaagtgttatattaaatataacgagtcctgcggatagctttgtcagcgggcgggcaaactgttcgcccctacgataataatataattggaggtaacaaaatgtgtactgcggcaacttataaaacgaacgatttttattttggaagaacccttgactatgaaagctcctacggcgaggaaatagtcataatgccaagaaactttccccttaactttgttaatatgggcaggatagctacccattatgcggtaataggcacagctcatgttgctcaggattatcctcttttctatgacgccgcaaacgaaaaaggtcttgccatggcaggtcttaactttgttggcaatgccttttaccgtgatgatatcggcggcagggacaacgttgcgcagtttgagtttatcccatggatactctgtcagtgtgcaaacgtgacagaagcaaggacgcttatagaaaagataaacataaccaaaactcagttcagcccgcaaatgccgtcaggtcagctccattggataatagcagacaagaacgactgcatagtggtcgagtctgtaaaagagggcataaacgtctatgacgacccagtgggagtgctcacgaacaatcctccattcgatatgcagatgttcaggctcaacgatttccgtggactttctccaaaacagcctgaaaacactttttcagacaagcttgaccttacttcctacagccgtggcatgggtgcaatgggtctgccaggtgacttatcctcacagtcaagatttgtaagagccgcatttgtgaaaatgaactcacgctcaggtgcagacgagcaggacagcgtaagtcagtttttccacatcttaaactcagttgaccagcaaagaggctgctgcgaggtggcagagagcaagtatgagataaccatttatacaagctgctgcaatactgaaaagggcatttactattacaccacctacaacggacatcagatatccgctgttgatatgtacaaagaagaccttgactccgccaagcttattgcctaccctatgataaccaacgagataataaactttcagaactagcaagcgctccgtacaaaatctgtacggagcgtttttattactcaaatctgaaatattcaaagtcaaagttgcttcccggcaggaacgcaaatgaaaccttctgtttgccgctgatacctgagatatcaaagctcttctgggcataattttcgctgtcatctgtcctgaactcgcagagtattcggttttcgtcctcactgccattcaaaataagatgtatgctgttgagggcaagcggtgactttccgcttataacgagcctgctcggctgtttttcagaaaaatcgaactcgccgaaatcaagcataacattattgcctatctcggtcacacacttttcgccctttgtgaacttgtcaccataaatgttgtcagcatcagccgcattattcaccgcaaattcacggctgaccttttcaaagttgaaaccgcccacttggaaaccgtcctcagtaaggatacaaagggtctcaatacccttgagctttcttgtgagcttgaatgtgtcaggcttgaagatcatccactcaggctctttgtgataacaaaacgtgccaagaggctttccgctctcctcaggtattccgtcatagaagcttattttaacagggtcaagggtgttcgcccatatctgcaccgtaacagtgtcagagcctgcactgccgaagtccagattatcatatgccgcccatgatgttaccttgcccattgcaaagcctacacccttcttcatgccgcttgaaacgttgtcgctcgcccttgtgaatagtccgccgataacgaactgatatgggtcggtaagtgcgtttccaagaccctcagcagtgaatttgagcatagatatgatgtgataacgctcagtgccgtttttgcacattgcacgaagccagaagcttccgtcaccctttgctttcaccttaatgctgtctgctgtcacctcgcactctgcaagattagatgttatgcccttttcatttgttaccctgaactctatatcttcagcataatccgaattgacagggagcgccttatatttcactgttatctcaggattatccttgtcaagagtaaaagtatcagtataaagctctatctttctcaccggtatctcgtctgtcctgccgcactcggtaggagcaaagcccacgttttcaagcgatgatgtgccgctgtcatattctgccttaacagcatcaagggtaacaacacagtcaggcagaccctttgatgtaagcgttacctttatctcccccgtcttatcagccacaccaataacagcaagcatttttcctgagaaaagtctgcgtgaagtacccttgtactggtcatagtctgtgctgtcgccgttgtcaagacccataagccttgccgcaccctcaacgctgacgttcacacgattgttggcatttgcgcagaaagtgccgtccttatcaaatgctgatatctcaatataaacaaggtcagagccgtctgcaagtatctctgtcttgtcagggacagcttctattctaacagcgtccccgaatgaacgctgcatatcctctgcgatgatatttccattctcgtcatatgcaacagctttaagctcgcccttttcatatggtatgatatagttcgctgtcagctccttgccatgcttgtggtcaatatcatatgcacccattgaaacaccgtccttgaaaagctcaactctcggagcatttgagcaaactctcacgtcacaaggaagtccgtcgctgaaatcccagtatgggaaaatatgcacgaatgggtcgtccttatagtccgtccactctgcacggaaaacatatgcactgtcttttgcaaagcctgctgtgtcgaactgaccaaagtaggagtttttcgtgctgtatggagtaggctcgcctatgtagtcaaagcctgtccaaatgaactgacctgcacagtattcagcgtcacggtcagggattatgcaagcctcagtattttttgcgccccagcctgtgcagctattgcccaaagatgaacactgctcgtcatcgtcagttagcaaggtttcagacagcgggaaatgatatattccacggctctgaacaacagaagccgtttcgcttccgtatatcatccaatcagggtgagcggtgtggtgttcctcataaagtttttcaccgtagttatagcctgcaagcttgagaatatcagcgcatttctgaccgttctcccactgcatatagttagagccgaatgtgacatagccgttgccctcagggtcatggagcctaacgagccttttaagccaagccgttacctcctgacctctctcgtcagcgtgtgtgtcaaaaatctcatttcccacactccagcctatgatagaagggtgatttctgtcacggcgcacccatgaagcaacgtccttttctacccactcatcaaaaaatctggcatagtcatagtcggtctttgacctttcccacatatcaaagctctcagagagaatgagcatacctgtttcgtcagcgatgtccataaactcctccgcaggcatattgtgagaagttctgatagcgttgatgcccattttgcgtagttttttaaatcttctccttatagccgcaggattggaaactgccccaagacagccgttgtcatggtgttcacatgagccgtggagcttaacgtgtctgccattgagataaaaaccgctgtcgcacttgaatttgatagtcctgaagccgaatttctgacttacacgctgtacacagccgccgtccacaagaatttccgacaccatggtgtaaagcacaggcgaggcgatatcccaaagctcagggtctttcactgtcatggtctgagcggtgagagaatagctcacgcctttcacacgcaccgccttagggatacacgaaatatccgccccacaggcgtcagactcatggcttgccacctctttgccgtccttgtcaaaaatagtgttcctgatgcgtattcccccaagaggagtacccacaggacgaagcatctcagccttcacagtcgcctgccagccgtcctcctgctttgacgtggtgatataaatgccgtcattgccgaagcgtatctcagggctttcgcaaagccaaacctttctgaaaattcccgcacccgaataccacctggagtttggcgagtggtgatccacacggacagtaataatgttctctccgtccttaacaaggtcggtgatatcgaacataaatgccgagtagccgtatttccactcccctgccaaagcaccgttcacatacaccttgctgtccatgtaaactccgtcaaagcggataaaagtgcgtatgccctctttcttttggtaagaaaaagcctttctgtaccagcctgtagaagtttcatataggtcatttgtattataaataagccaatcgtgaggaatgtccacaggcttgaaagcaaagtcctctgagtagtcagagccgaaagccgccttgtaaaattcccaatcgttgcaaaaaagctttctgtctgagtatgtttcacagatatccataaaaactcctttatattttacttatctgaatatgaaaatgtgcgtttatcaaaggcttttcaagctgatatttctccgcaagccttggtccgcaggagttagaaccgacccctgccattgtatagtcaacgcagataacattgctctcgcacctttcaagctcatagttatgtgcctttgccgcaagctcctcctgcgtgaactgcgacgcattgaatgaaaactcctctcctgcagtgaacatcacacttgtgtcctcactgctcacagtgagatatctgcacccatagtgcgatgaattttcctgcggtctgatatagtcctcgtgcatatccccgatatcagccacaaatttgcccatatagcaagcctgacgcttgtcaatatagctttctgtaggaccatatccgaaatattccgcccttgaaaaatcttttggcatgaaaagccttataccgaaccttggaagcatatctatcttatttgaaaactccgcttcgcattttatgtcaagcccactgccgtcaataacataaactgctttcagcctgcaaaacggctgttgtatggaccagccaaaagactgtgtgacgcttatctccgctctgttctcgctcgctgaaagctcacagccgtagcttttcacatcaaagtcattaagatgcaccttgtaccaattgtacttcatgacatcattatccgtaggcgcacggaagaagttatactgcaaaggtctgtcaagaagctctctgccgccgaatttcacagaaacaaaagccgacttacgcttgtcaaagcggtaaacaacagctcccactgtcacagtgatatcaagaggcgtttccacagccttaacatttcctttcacctcagcgaccttacaagccttgccctctgctatcctaagctgatcaaagcacacctcatagccattttgacaatagtcagtgtcctcctttgcagtgaaaataaaccttatgaatgtttcattttcatactccgctgtatcattgggaacattcaccacagtgcttcccataggctcgatgtcaaaatccactctgccgatatgtataataccgtttttgtccgttatctcatagtggcaatcgagaatatccccagcgttcacaaactccagcgtgcttgaaaaaacaaagcttccctcgctttccccttttgttactcgcacaggtctgtatacctgctttacctctaaaagtccggtgtgtggcgttctgtcaggataaacaagaccgtccatgcagaaatttccgtcattgtgtctttccccaaaatctccgccatagccgtattttatccttccctcaaccgtcttaccaagcggtacagaatggtcgcaccactcccacacaaagccaccgcagaaacgctcattggaatagaacacattgtgataatcctccagatctcccggaccatttcccatggcgtggcagtattcacactgcacaagaggtctgttttcctcaggcttttcaagatagcctttcagcccgtttagatcccagtacatacccgaaactacgtcaagcacgctgtcggaagttccgtcaaggcagtgtgtgctttcataatgcacaagccttgtatcatcaagcctctttataagctcagcttcatcgagcatatttttgccatatccgctctcattacccaatgaccagaacaccacacaagggcggttgatgtcacgctttacaagacattccgcacgatcttttatggcattgccaaacctctcgtcgcaagcaagcatcgcaatgccgttgtaatctgaatagtcccacttgtagtcataatagacctccacacagccatgtgactccagatccgcttcatcaataacataaagccccagcctatcgcaaagctgataaaacacaggggagttaggataatgtgacgttctcacagcgtttatgttgtgctttttcataagcacaaggtcagctctcatctgctcataagaagcataatatcccgtgtcaggatagctgtcatgacgatttacacccttgaacttcactgccctgccgtttatcttaacaacgcccttatccacctttacatctctgaagccaacctcctcgccgataacctcgtcgcctgcattgatagtaagcctgtaaagataaggtgtttcagcactccaaaacttgacgttctctaactttatctcaacgctctcaccgtcataagccgaaaactgagccattgtaacaccatcatcatcgcaaagctttgccgaaacatcacagccgaataccgtaaactccagccttgcagagccattttcaccgagaatagttttcacgatataattttcaagacgcattttcggtcttgacagcacataaacatctctgaaaattcccgaaagccttatcttgtcctgatcttcaagataagttccgtcgcaccatttcagcacagcggcagtaatgatattcctgccctcagcaagatatggtgtaatattaaactcagccgtagcgtgagaaacctgtgaatatcccacaaagctgtcgttcacatacaaataaacacagctgtccacgccctcgaacacaagcaccctgtccatgccgtcagggaaatgatcatattcacgctgataaactcccacaggtatatcgtcaggcacaaaaggcgggtcaaatggtattggatagcacacgttcgtatactgcggcttgtcatagccgtaaaactgccagtttgacggcactgggatagtgttctcaaacttttcgtgaataaaatcgtcccctaggtctattatgctgtcataataacgaaaaccccagttgccgtttaaaagctccattcgctgagaattttcacggtcctcaaaaggatcctgcccctttgcaaacggcacaaaatagcagtgcttgtcaagcgtgccaatgtgcagcgcctgagtatcctcatgatatatcattttcgatcttggcgaattttccgccgcaagctttaaaatatccatagatgttctcctttacaagtttataaattactgtaattattttatcagctattgacaggcaagtcaatgaatgatattattaatttataacaatatgaatatggagttgatatttttgttctttgccgattatcctatcctgggaaacgaaaagtccctgccactatatctgcaaaatatgggtcatcatcactgtcaggatcaccttataagacccgagggctatcactatgaccagatactctactgcaccaaaggcagcggcacgcttatctttgagaataaagccatttccataccacatgataccgccatattcatacccgctgaaacgccccacgaatactatccagaagaggatatatgggatatccactggatagtcccctgcggatatgccgccaaggatatccttacccagttcggccttaccgagcttaaaacctttcacctcagcgacacgaaaatgctcgagcatattttccgcaaaatgcacaatgctctgcgaaccgacagcattttcggcaattacaaagcctctggctatttgtatgattttcttatggagttttaccgcctcatcgcctacaaagaccctgccacgtcagtatcctccgcccttatgaaagcactggactacataaactacaactatttttcccctatcacaatggacgagctttgcagtgtgtcaggagtaactaaacagcacctttgtctgctttttcgcaaaaaactcagtatgcgtccaatggaatacatcgcaaaacgtcgtatccaagaagccaaagccctgcttaccggtacagaaaaaagcatcgagcaggtagccgaggaaacaggcttttgctcagaaagctatttctgcaagcttttcaaaagatacgagggcatgaccccctccgctttccgccagatcaaataatcacaaacaaaaaaagagccgcccaaaggcagctcaattatgcagaaaaattagccctgctccttcatcttagcgaaacactcgctgcagtaaacaggtctgtcctctcttggcttgaaaggaataacagcctcgccgccgcaagaagcacaagttgctgtgtaagtctgtctttcagactttgtagcagcctttcttgcatctctgcaagctttacatctctgtggctcatttacgaaacctttctcagcatagaactcctgctctcctgctgtgaaaacgaactcgtttccgcactccttacatactaatgtcttgtcttcgtacatggttcttacctcattacataaaattgtgcctagtcggatttgcaccgacacctttgaataaacaacgctctgctattaagctatacggccatattcctatctcaacagtgatctcaatttccgtctgactctctgcattgcattgtctaccgccttttccgacgtgcccaagcctaatgctatctgattgtatgacattcctctcaaaaacgattgaaatacctgccactcctgctccgaaagtgcagaagtgatcttatcataaagctcattcagctcctcacgctccactacgacttcctcaggtacagtgccaccgccgccaagaatagcctcaaggtcagcttcctcgccgcctgaaagaagtgcatttctgtgaacagacgaaatgatcttattttttatacattttgtagcgtaagttgaaaacttcgcatttttgtcttcacgataggtcctaaccgcacccagaagccccataagcccctcttggacaagatcttcatgaacctcggcgccatatttttttgccagaaactccaccgtacagatatatctcgcaataagctcaccgatagccattttgtcactctgtgcatttagcacgagctgctcatctgaaagcttttcctgctgatcctgccgatcgcctctcaaaaaataccgcccacctaatcgtagaaattaccgcaaagccccattctgacgccactgcgtaatgttataataccattttagaccataaaagtcaagagaattgacgaaatccgccgtccctgtgaaaatatttgtaacataccacagttttaagaatgtattcttgtgattttcaacaaacaaaaagtcagccgtgtcgaaatacacggctgaccgcaatttacgcaactttgatgttatacacggcagtattttgctctgccatcgctgaaaatatctcctccgtggcaatcgtcagccacaacaagaggaaaatcctcaacgtaaagttttttcacagattcacagcccagctcctcaaaagccactacctcacaagactttatgcagttgcaggcaagtgcgcccgcacctcctatagcacagagatagaccgcaccatttcttatcacggcgtcccttacctcttgtgatctctcgcccttgccgatcattccgcccaatccaaggtcaagcagcctcggtgcaaacctgtccattcttcctgaagtggtcggtccgcatgaaccgataggctttccctcaggtgcaggagtaggtccggcatagtagataacagcgtctttcaaagggataggaagctcctttccctcgtcaagcaaagcattgaatcttttatgtgcagcgtcccttgcagtgtacacaacgcccgaaagcaatatcttgtcaccgcatttaagctctccgctcaccgctttaagctcctcggaacgcacctttcttatttccgacatgacaaactgttattcagcgtcatcatcgcttacaagagaaagaccatcgtcaataagatctcttgcagtgtttacagcaccgatactattgccatacagatcgttaagtgatgtaacgagctgctgaacagtttcgctcagacttgtgaattgtgtcttaacagactctctcagatcagcagactgtgctctgatgttcttagcttcgttcttagcgtcgcttactacctttgcagcctcggcatttgcctttgatgttacgtcagcggcttctgcgttagcctttgatgtaacagcctctgcctctgcgttagccttagaagttacctcggcagcctgcttgtttgcagcacttgtaacagcttcagcctcctgcttagcggcagctgtcattgcggcagcgcttgacttagctgtctgaagtgtagtatcagcctctgtctgagcatttgtaacaagcttctgtgcctgtgcgtttgcgtcagcaagaacctgatcctgaagctgcttagcttcatcttccatctgcttagctgccttcttagcttcctgaacgaccttattagctgtgttctgagcttccatgaacacgcttccaagatcgaatgcaggagtggctgtgccggcattagcctcagcagtttcgagcttctctttaagatcctcgatctcctgcttctgcttttcaagctcagcgtccttttcagttacctgctgctcatagtcagcgatacgaaccttcattgtatcagtattagccataagctcggctatcttgtttttagcctcttctacctttttctcaagttccttcttgccctcgaagtcctgcttctgagcgccgccctgcttctcaagacgttcgatagtttcgttctggtcattgacctgagcctcaagagtataaattttagaagtaaggtcgtctacataagcaagaacgtcctgcttatcaaatccgccgactctaaccgttcttaaataaccattactagccatttcaatccctccacattagtgattatctctattatacaataaaccacgttatttttcaactgatttaagccgttttcaaaaatttcattattccatacaaaatagcaactgaaatttatacaaaatgtcttaaaatcatatttatcacagaataattatatcaaattttccgtaagatttcaagtgcttttgcgaaaaattttcaatatcatgataattttctgagaatacgaaaacctcttcgattatgtaaacgttttccgattttggttcaaacaaggcggacagcgtaaacgccgatccgcctttgaaagcattattacttgttcttgaagatattgaagatatcgtcgtaataatttggattatcagcagccttaacgccagccttgtgcatcgcttcagcgtcagcctttgcgtcgtcagccttctgagtaaaatttgcagtatatgttgtcgcagcctttggtgcagcagcctcaggaacgtcatctctgtcaacaaagtcagcagcgataacagtaacgtccatagcgtccttggtatcaggatttgtaccgttaccgaagatgatctcaacgttatcgtcagcagcgtctgctatagcagcagtaagctcgtccatatcgctgataaggagatcctcgctcattgtaacgtttacgataagtcttctcgcacccttgatagaagtttcaagaaggtcagaagaaattacctgattgatgatatcctgtaccttatccttgccctcgccgtggccgatagcaatatgcgctcttcctgcacccttaagaatagtagtaacgtcagcgaagtcaacgttgatctcatcatgtcttgtaatgatctcagcaatagcgataacgtctgtcttaagaacttcatcagcgatagcataagactgcttcatagtgaggcgcatctcgtttgtgataaggttctggttagggataacgataagagcgtcaacgtgcttgataagagcctcgatacccttttccgctctctccatcttcttagcgccctcaaatttgaaaggctttgtaacaactgcgatagtaagcttgtcaagtgactgtgcgatctcagcaactacaggtgcagcaccagtacctgttccaccgcccatacctgctgtgatgaataccatatcagcgtccttgatagcgttctcgatctcgtccttgctttcctgagcggaagcctcgccgatctcaggctttgcacctgcgcccagaccgtgagtaagcttctcacctatctggatctgtgtgtgtgcagctgacttatgcagtgcctggatatcagtattaacagcgatatattcaacatttccctcgataccggcctgtgcgatacagttaagtgcgtttccaccgccgccaccgacaccgattaccttgatctttgcgcctacgactggctcttcaacatactcgtaacccataatagaactcctcctaaaagcgaattttcatacttctccgtatttttacatatcaatttatcaaatcaaaaataaaatgcaaaaaagcctatgtgccgaatatgcacataaatagatacaataatatattatcatacttttgtcaaaaagtaaagaacttaaatgaaaccattataaactttttattaattatcaataaaacgactgatttttcagtttcatttgtgtatactatacaattagttatcctgacccctaccaatctgtgttcgtctgatcgtccacatagccgttgtcagcatatccattgtcggtatagccctgatcaccgccgttatcatattcccagtcggtgtttccgttctcgtttgtccactgatctgtgcctgcattgtcagcatcatcattgccgtcccatgcgttggtatcgtcgctgtagccttggctatcgtcccctgaccatgagttatcaccgtcccatgtgttgccgtcatcaatattagtatcagccgataccgcactgctgctgtcatctggctttgcagagcttgtgtcgtcaggttttgacgactcgtcctgcgatttcggaatagccgaaatgccgctgtcagcaccattgtaaataagcgtaccctcgtaatcgtcagtaatgctcttgtcaattaccgccttaagatatgtaagcttatattccatatccaccgagcttccaagctttatttcaagcctgccgtcatacataagcttgatatccgaacgggtggtcaggtcaatagagtctatattcttaaatttcagatcatgaagatcattcagaagctctttaaggatatccgccttaaatgaatcctccgaggcaagcttgtcgccctgactaaggcttttaagctcaaagccctttataacaggtatatcccctgtcggagcaggatttttcgtttcaagtatctttcccgaagcagacagcacatagtatgaatttttatactcgatatcagccgccttttcggcctctgtgcaggttataacaagtgttgacggaaatttctttgtgaccttgacatcatcaagatacacaagagtatctttcaagcgcttttcaactatatccgtattcgtcctcacaaggttttgtcccgttgaaacgccgcccacgccaaggatctgatcctgctcgtaaagggtaacgccctctatttttatctccgacacattaaaaaacaaaaacatactcagcaccagcagcagcgccgcagccgcaaaaaagctggcaacatacacattgcgcatattcactgtctgccgacgtgccgcaggccgctgtgagttcattctgttttccttgtaagttccgttcattttcctctttcctaactgctagtaatttacacgttttatgtttccgcccagaagcgtaaaagcattttcaatgcagtcatagcccctgtccataagctttatattagtgagagatgtttctccctctgccgaaagcgccgccacagctaacgccgcaccgcctctaaggtcaggcgcacggacttttgctccgtaaagctccttcacaccctcgataacagccacttttccctctgtctttatatccgcacccattctcacaagctcgtcaacatggcggtagcggttttcaaaaatattttccaccaccacactggtgccttttgccttagcaagtgccgccgtgactatcgcctgagcgtctgtagggaatcccgggtaaggcatagtcctcaccgttcgcacagcttttagctgtttaggcgcttttataaatatcctgtcctcatatagaaatacctgacagcccatttgctcaaatataggtatgaccgcacggatatcccctgcccttgccccaagcagacctatctcaccgcccgttgccgctgccgcgctcataaaagtcgccgcaacaatcctgtcgggcatgacagagtattcacagccgtgtagcttttccacaccgcttattgttatcgttccgccccctgcgccgcttatctttgcaccgcagcagttcagaaactccgcaagatcgcatatctcaggctctcttgccgcattgtatatcactgtgtcgccctttgccagaacagccgcaagcatgatgttctcagtcgctcccacagaggggaacgaaaggtctatcctagcccctctaagccctctcgggcaggtgcagctaagcacgccatactcctcgtttatcctgacgcccatttttctaagtgcgcacaggtgcatatctataggtctcggaccaagctcacaccctcccgggaatgacagtctgcattcacctgttcttccaagaacagctcccagaaaaacgatagacgaacgcatctctctcataagctcatctggcacaaaggtctttacagcgccccttgcgtccacagtaacacagccgtcctcacggctgcaccttgccccaagcaccgacagaatgcgacaagccgcaaatacgtccgaaagtgcaggacagttatgtagcctgatctctccgtttataagaacacaccctgccagcagcggcagagctgcgttttttgctccctgaacggttatctctccgttcagcctgcttcctccctgaatgataagccgttgcataagcgtcgctccttttaaggttttgacttatcttatgcaggaccgcccatataggttaaagctatttgttgatatatatctctgtagcgtttgaaacaggcataaaagcaggcaaacaaggcagataggagtcattgcctatcttctttttcatatccttagttgaaagtatcataccggtaacgcaatcatcaaacgtactatcgtccatatcagtgatattcacaagtatccttacagtgacctccttgctggaaaacggaggaacagtgtcgcctatgacctcgccgtcgctgtttgttgtaacgctggtcgcatagcataccgcgttgtcatattcagaagaaacatggctgatctcatactgcggtatctttatctcaaaaggagacgggtttttgatattgaacactatatctgcaaaacggtagcttgaactcaactcagaaccaaaagcttcttcgttgtatacagaataatttgacagcgcatatgttttaaaatccgtcatacccattgttttgaacacgttgtcgtcatatctaaccacgctcttgtctgcgtcgttgaaaaacagcggtgggaagaagaacaccataagcacaagcacgataataacagccacaactgtctttattatcttgctacgctttacatatgaatctcccacctttactcccttgctaagacctgtcgccgcctgcgcaggcatagccgcagcgtcctcaaggaaatcgtcctcatcgtcctcttccttgtgcttggtagggtcatcgtaagtctttgtggcacggtcgaactcccctgccttgttgaacttttctccgtcaaaaatctcgtcggcggtgcggttcactccgctgcccttgaactttttatctgacagcttttttatcttgtcaacatcaggcacttcaatgctgtccattgaagccctcttgttatactgtctgtaattcttatccattattttatccccttaaattttacgttccttatcccttaataagcggctctaaagccttgaatatcctgtcctcagtatcggcaacatgaagctttgcagcgttttccgagcactgtctgagcttctcagggtcttctataagtccctttacagtatcaatgaaaagcttttccgtcaagtctttttcttcgataacaaagcctgctcctgcgttttgcaataccatgccgttgtaatactggtgattttcagccaccataggtgacgggataagcacagaagctctgcccattgcttcaagctctgccagcgaagctgctccgcaccttgatataacaaggtcagccgcagccattgccacaggcatattgatataatcctttatgatacgtctgctgttgttgatatctatacccatagcccccagcttttcaggatagtccttatagccctgataagtgccgtaggaatgtatatgacacaccttaacatcattgtcctgataccatttcaaaagctttgcgatattctcattaagcaccctcgcaccaagacttccgcctgttgaaagcacacatatttcattttcatcaaagccaagctgttttttagcctccgactttgacatggtgttgaaagctccccttacaggcagacctgtcaccaccgtcttagcattttcgggcatatacttttctgcctcttttacagtgagcataacaacgtctgcagactttgcaagtatcttgtttgttacgcccggaaaagcgttctgctcgtgaatagccgtctttatgcccattttagcggcttttctaactataggtcctgaaacatatcctccggttcctataacaagatcaggtcttgcttcctttattatcttctttgcagtgcttcctgactttacaagacactctgccgcatggatatttcttttgagatttacccagttaggctttctctgaaagccctctatctttataggatagaacttatatcctgccgcaggcacgagcctagcctcaagcttttcaggatttcccgcaaagcttatctcagcgtcaggatagtgtttttttatgatctccgcaatggcaagagcaggatttacatgacctgccgtacctccgcctgcaagtaaaactctgagcatagaactaatacctctttacttttttttgatgcactgacgtgaaacgttgagcatgatacccatttctgcgagctgtatcatcagtgcagtaccgccgtagctgaaaaacggcagtgaaatacccgtgttagggaaagcgttgcaggctaccataatgttgaaaagtgcctgcgagcctatctgtattgttataccagccgcaagaagcataccaaaacgatccttgcttcttgaagcgatcatgaagccctcgattataaaaagcacaaacagcagtaccactaccattgcacccacgaagccaagctcctcgcagataatagcgaaaacgaagtcgttttgcgactcaggcagatagtatttttgccttgactctccaaatcccagtccgaaccagccgcccgaacctatagacaatagagattcataggtctggaaggtctttccgctagggtcagattcaggatttttccagctctgtatacgatctgaaatataagaaaagcctgagcctgacgccattttatatatcagcagcagcaccccgaaaacagcacacacaccgataaatttccagaaggtttttttcggcataccacttatgaacatcatagacacgcctatgatacccaccagcattaccgccgacatatgcctttgcaaaacaagcaccagtgccaccgcacccattatcacagtaaacggtataacacagaatttccaatccttgaacttaggataattcaccgacattatgtatgcgaaaataataatgaacgttaccttcagaagctccgacggctgaaagctgatcggacctatttgtatccaacgccttgcaccggcaacgtctattccgaaaaaagctgtataaaacgtaagaagatatgtggcgataaacgcaatatatgctatcttagtgttctgaaagaagtgataatcaagatagctcgtggcaaacatgagaagaagaccaagtccggcagacttgagctggctcaccagataataatatccatcgttatattcactcagaccccacgcatagcttgcagaaaacatcatcagaagtccgaatacaagcaataccattacaagaatgaaaaacggcttgtctatctccgtaagtataaatctgaatctatgttttctttttgcctgtgccacaggttgtttaagaggaacgtgactattatacactatgcttccgtcacgttcacgtctaggacctcttatagccaaacaaacaacctcccaacaaaatctctatatgaaaaactttcccgaatatatcaaaaacgctatcgccgccgcagcccctgccacagatatcacagcgaatatcccgatcacggagtgatccccatgaccctttttctgcaaatgctcatgaagcgtatagcccctcatgagcagcttttttcttatcttaaacacgatatactgcaaaagcccacaagctccgtcaacgaccaccgccgcacctgccagcaggaaaacgaaatattctcccgaaagcagcaccgccatagtcataagaccaccaatcgccagcgcacccgactcgcccaaataaagcttcgcaggactgaacccccaaaagagaaagcctcctgccgcacccattgtgcaaacagcaaaaagctgagcagcgtcagaacctgcccttgccgcaagaccacttgacaaccctgccgaaaatatcaaagccgtaacggcacacagcccgtcagtgcccgtgtcggtcttaccgcccgcacaatcgtgtatcttcaccatgtttatccccactgtcataaacagcggaaaaagcggataaaaaagcctgccgaactgcacatagcccaagtgaaaaggcataagcacagccgtctgcactcctccgcagtatctaagccccacgcacactccaagacatataagatactccatacatatcttgtaaaaaggcttcatgcctatgccaagctttttctccttaacatagtcctccgaaagcccgatagccgtgagcatcaaaactccgcccaaagcgataaacacacgccttgaaaactctccgttctcaaaactcagcaccgcctgcgagtcataaaatataactcccgtaacaatgccaaatataacgcagagcattatgacaactccgccgaattttggctcagagccgtcctttgcgaacctgtcgcctatataaaaatcgaatttgcctgtttttatcctgcggaaatatggtatgaacactctgccgagaacatatcccagcaccatttcacaccccagtatcaccgcctgcacgctccaactcattttgtcagcgcattgaacacttcttcaagcttcattcctctgcttcccttgaaaagcacagcgtcgccctttgcaactacctctttcaaagccgccgcaaggtcatctctgctttcaaagtgcctgcaattttcctttgcaaagccctttttctcagcaccctctatatagcattttgagtcctcgccaaagcagtaaagcaggtcagcctttgaagccgcaacatactctcccacatttctgtgataggtctttgagttcttgccaagctccagcatatctccaagcacgcaaatgcgcttgccctccgcctgtgcctgtgaaagcaccgaaaggctcgctttcattgagtcaggcgcagcattgtagcagtcaactatatatgtaactccgtcaatgacggtaacattctgtcttaaaccctccggtttgaactgagcaataccctttacgatatcctcaggcggtatatccagcgcaagacccacgcagaacgccgcaagagcgttctttacattatgctcgcccaagcagtttatctgggcggctatctttccgccctcatagtttatagtaaatgttatgctgttgtcaacagtcttaacaccgcttgcataaacatcgcagtccttctttgatacagaatagtaataaacctttctgtcagaatgtaactgcacccctgcaagcaatttatcatcacggcaaagtatcagcggagcgtcataagccgcaccgtcaagtatctcaagcttcgccttgagaatgttttcctgcgtgccgagattttcaatatgtgaaatgccaatgttggttataacagccacgtcaggctgacatgacattgacattctcgatatctcgccctgatgtgacatacccatttcgataacagccgcctcataactgctgtcaagaccgaaaagcgtctgcggcatacctatctcattgttgtggttgccctgagttttcagcgtcttgtatttctgcgccacaacaagggctatcatatccttagtggtggtctttcccacgcttcctgttacgccaactaccttaacatcgaatttagacctgtagtatcccgcaatgtcgagcaatgcccttgcagtggagtcaacgatcatacatcttgcaccctccacaggtctttccgtgacaacagcctccgcaccaagctccatagcctttgcggcaaagttgtgtccgtcaaaattctcaccctttagtgcaataaaaagcgagcctggctttattgttctcgtattggtggagatatcggaaatttcaacgtcagcaggatagccgtagcttccgtgaaccgccgatattatctcctgtaagcttaatttttccattttaattcttatccgccaatttctcggcagtatctcctttcccttatcttataaatatatctttatcgcaaaaccgcccacagccgctttgcatatcacgggcgagctgttcacccctacatttttctcttatctgccctcagcttcaagctctttaagagcgtccgcaacgacttctctctcgtcaaaatgtatcttcacaccacctgcaagtatctgataatcctcatgacccttgccggcaagcacgatgatatcgtccttttccgcatgatgtatagcccagtggatagcctcacgcctgtcaacgatagttatgtaaggggtcgtcttgccctccagacctaccagaacatcgtttatgatatcctgcggatcttcatttctcgggttgtcggaagtgacgataagaaaatcagcattgtccgccgcagccgcagccataaggcttctctttgaagcgtctctgtttccgccgcagccaaaaaggcattttacctttccgcttgcactgttctttatagccgaaagcacgttcacaagtgcgtcaggagtgtgagcatagtcgcatataacagtgaaatctctgcccgtcggaactatctccgctcttcctcttacgccctgcatagtacccaaagctctgatagtcttgtcaacgtcaaatccaagggtcttacagcaggcgataacagccagcgagtttgaaacgttgaaaagtccgggcatattgaacgaaacattgtgctttatctttccgtcagtgaaaacatacttcacaccgcttgctgaaagcaggatatcctctgctctgaaatcagcctttgtacagcatgaataagttttcgcaggacagcttatctctttgagataccttctgccgtattcatcgtctatattgatgattgcgttgtcagatatagtgaaaagtatcttcttagcctgatagtagttctccatagtgccgtgaacgtcaagatgatcctgcgtcaggttagtgaaaacgcctaccttataatgacagcctgaaagtcttttctgttccaagccctgcgaggaagcttccataacaacatagtcgcacttctcatcagccatttttctgaaaagctcataaaggtcataaggctcaggagtcgttcttgcagtaggataaacgtcgtcgcctatctcgttctgacaagtgccgataagaccaaccttacagccgaatgaagaaagcaccttctttataacagttgtgatagtcgtctttccgttagtgcctgttacaccgataagagtaagctccttttcagggtgaccgaaaaatgccgcacacagcagagggaaagcctctcttgtgttctccacgattatctgacagtcaagccccagatctctttcgcagactacaactgtacagcccttttctatcatgtccttagcagcgtcatgtccgtcaaaggtctttccttttatgcacacgaacatcgagcctgccttgacagcctttcttgtgtcgctcgtgacgtcgcttatctccatatcaggcagagaagttttcgcaacgtcctttatgatatcatatagtttcataattatcattccttatcatggtttcttactgtgagcctaccgaggtcactgcaaatgttaccgacacagccgttcccattggaacgctctgtcctgctcccacgctctgatcggactgtgcaactgcaccctcctcctcatagcctgagccttctgccgtcaagttaagaccatacatatcaagcgtagcccttgcctgctcctttgtaagtcctttaagttcaggcaccgtaacagtttcttccttggcgtttgcttctgtgtaaagcacaaccgatccgccatgctctatctttgcggcaacaggcgtctgcttaacaacagtgtcgccctcgcccttgaccttgacctcaagcccaagatcttcaagtgtctttttggcttcctcaacagtataatactgaacgctaggtactgatacctgcaagtctgcaagctcgctttcgtcatactcagggaagatccccacataaggcagaacgtctgaaagcacgttcacgcatataggtgctgccacctggcttccgtagaatttctcgcccgtcgggtggtctaccattacgagcattactatctccggatcgtcagcaggagcgaatgcacagtatgaagaaacatacgtctgaccggtcgagtcctcgtcaattttctgtgaagtacccgacttaccgcctatcctgtatccctttatatagcagttagagccaggctgaccttcaacaacgccctcgagtatctctctcatagatgctgaggtgtcctcagaaatgacctgacgtcttacaacagtgtccattttctttacaatgttgccgttctcgtcagttatactgttcactacctgtggtgtaacaagataaccgccgtttatagccgccgagtaagctgttatcatctgtatcggcgttaccttatttgtctgaccgaatgaagatgaagcaagctgaacagggcccatgttgctaagcggcatactgatagaatttgattccgcaggcaggtcgatacctgtcagctcgttgaaaccgaacgcattgtaatactgacagaacttttcagagccaagcttcatgcctatctgaatgaatgcagggttacatgagtttagcattgcctgggcaaaatcctgcgaaccgtggtcggtagttgaccagcagtggaaagtcgtgtcctccacctgtatctgagtgccgcagccaaaagtatcattaggagtgatagtcttttcttccaaagccgaagcacctgttatgaccttgaatacagaacccggattgtatgtttctgaaaccgccttgttcttccactgaagcgaccatgcgtcaagctgtttctgcttgtaatcgtttgaattttcatcaagccccgcaagctccgccgccgtcttttcatcggagatagccgcaggctcgttagggtcataaggatcagaagtcgccattgcgtatatctgacctgtcttaggattcattatgataccgcaggctctgtcagtaggctgattttccttaactgcctttgcaagctctttttcaaggatatactgaatgttggcgtcgatattcagattaagatcgtcgccgtcctgagcgtcataactctgcttgtatctgtatggtatctcagttccgtcgctggcctttgcagtgattatcctgccgtcaatgccgctgagataatcgtcatagtaagcttcaagaccatatatgccgttgccctcatagtccgtgtgaccaagaacaacagaagcaagagtattctgtggataaagtcgccttgtggtagggtcgcaccttacgccgtcaatgccaagctccgtgagcttatcctcgatagccgtggaaacggtcttttccacctcttttttcagcacgatgtactgagtatccgtcttagtgagtttttctctcacagtgttagtgtctatctcaagattgagtgccaaaaactccacaagctcgtcaagacattcgtcccctgatttcgttgcgtcaagtctttgctgatatgtagccttcttggacgcatcgtcctctttggctatatatcctttaagctcctctatcttcttgtcgttgtcatcaagcttttctttgagcataagagggtctgcataaacagtatagaccgttgcgctctgagaaagcaccgttccgtttgaatcataaatagtgcctcttgacgctgaaacagccgtgcttttaagctgctgagcgtttgcaagggactgccacctcttgccgtcctttatagacaccgaaaagatggtcgcaaccgtatatataagtatcgccgccacaggcaggctcagccaaatattcagacgttgtttcattctggcacttggtctgtcggtcataaatatctcctctcaggacatcaccgcacatacaaaatcttcaataatttagcatgatacggcaaatatcttattttcacacatacaaattaatagaacaagaaagctaagcacaaatatcttgtccctaactttccccataattattttattcactaagccccgatatattccagaacagagctgaaccagtgttttatcttaacgaacacattgtcgtcctcggcctttaccacctttgccaccgagtctgattccacagttacatactctatctgagatttatccagctttttaagtcccagctcattctcagcatactcctcgacctttgacatattggtcttctgagcaagctctgactgtaagcttacattctcaccctgaagctgagcaagctgttcctcctgtctggtctgctccgaacataggcttgatatttcgactctgccgtatatcatcgttccaagaacaacggccaccagcagacaaatgcctatcacagctactaccgatatggttttctgctttagtgcagggtttttcttatattttatggctctctgagcctccgcctcctgagcgttgtcataggcactgtaatcaaatgccaagttatgtacctttgccattgcggtaaaacacctctcacgatccacgggcaagcccgttatttacacattcccaatttcacacaaatttcactcagtccttgatcttctcgatcaccctgagcttagcgctgcggcttctgttattctccgcaagctccttttcatcagcctctataggctttctgttcacaagccttcccctaggcgttcttccgcatatgcactgaggaaaatcaggcggacatatacagcccttgcagaagctctgaaatctctgctttaccaatctgtcctccagcgagtggaaagtgattatgcaaagcctgccgcccacgttaagacaatcgaacgccttgtcaagagcgatattcaaatgttcaagctccttatttacctctatcctgatagcctgaaaagtctttttgcaagggtttttctcacgccttgccttctgcggaactgcgctttttattatctcggcaagctccatagttgtctctatcggtttttgttctctgtattttactatcttagaagcaatgcttcttgaaaacttttcttcgccgtactcgaaaattatcctcgcaaggctctgataatcatatccgttcacaacgtccttagcggaaagcccctcccctgacatcctcatgtcaagaggtgcgtcattgtgataggaaaaacctctctccgcattgtcaagctgataagaggaaacgcccagatccataagaatgccgtcagcaccgcttatgccgagcctttcaaatatctcgtctatctcagagtagttccctctcacaacagtcgcaggatagcccgccaaccgttcagtcgcagttttcaccgcctcgggatctctgtctatagccacaagcctgccgcccttttcgccgtcaagccttttagcgatctctctcgaatgtcccgctcctccggcagtgccgtcgcagtaaatgccgtcaggtcgaatgttcaaaccctccaagcactcatcaagcagtacgggaatgtggttaaattccattaaaaatcaagcccctccagagcttccataagctcgttatcatcaatgctgctgttgaaatcgtcccaacgctttttatcccatatctcacatctgtcagatactccggccacaacgatctccttttcaagccctgccacctctctcagtgactgcggaacaagtatcctgccctgcttgtcaggctcgacctcgcacgcccacgccataaagcttcgctgtaaagctctcgccttagccataggcagacttctgatcttttcggctcttttctcgaaatcctcaagggaataaacgaacagacagccgtctatacctttagttacaatgaaccgctcgccgataagctctctgagcttagtaggaaaagtcattcttcccttagcgtccatagtctgattgtaagttcctttaagcaagcacgcctgcaagccgttcacctcccttgaccgagttaagcagtgaaatgccacttttgaagcactcatcaccacttttttgcacttttaaccaccgtacaataattatacactatattatagaaaattgcaacagtaatatttcccaaagtgaattttcgcaagggatttttcttggacacttggtcaatttaagagagattttagggggattttgtaactttcgccttttaatttgtcaccatcttgtaatttgtaaacttttaattaattttacgtcatacaatatcttgtggcacttcaaacatttgcgcctgtataaagatagcagatatttccgcaaaactctcatacattcacatcgtattgaccttataaagttattgtaacacaacatatagtatacgtcaataggttttgcgaaaaaaagcacaattatttctgacgctgtgacagaaaaagcaagaagggtgatgaacggtagaatatagtgtcgcaaaaaggttaaaattcggtaacaaggaaatttgttttctaatttaattattacactttccgattttgtaaattttcattgcttagataaagaaaataaagtttgaagaggaatggagcatgagagagggtttttaacgttaaaacagccaaaaataatagtaaaattgcacaaaaccgcaaaataaagtggcaaaaaaggcaactgcaagggtagaaatacaatatgcagtaaaaaagcggacgcaccccagtgcgtccgccaagcctcagttatttacttgcaaaaattctcaatgtatctgtcgatacactgtgccacgatctcagtagcatgttcacgatccttaacatcatcgaccacagtgtccttgtgttcaagtgccttgtataccgagaagaaatgacacatctcatcaaaaatgtgcttaggcaactctgaaatgtccttatatatgttgtatgtaggatcattgagcggaatgcagattatcttctcgtcagccgcaccattgtcaagcatggagataacgcctataggataacagtcaaccaaagacaaaggcgcaagcgtttccgagcaaagcaccagtacgtccaacgggtcgccgtcctctgcatacgtcctagggataaaaccatagtttgcaggatagtgggtcgatgtgtaaagtatcctgtccattctcagaagacccgtggtcttgtcaagctcgtattttacctttgagccttttggtatctctattaccgccgtgaatttttcctttgttatcacctttggtgaaatatcgtgccagatgttcatgtacattcctcctgtattttcattcagcttcgtacataccctcagactttagattttcaggtatgtcaaaaaccgtttcgccgtccgcctcaacgcatgagatacaaccggcgttgtcctcgtttatcaagtcccacagtgttacaacttcatcttcacccacaacgtctatcccaagtctgtcaaaaagcttctcaagcttctttggattgcgtgagtatatctgaaattcctgatagtctgtgaaatatatctcctcgtcattcttgtgcgagccaaacccaaatctcgatactccgtcatttacaagcacagtgccgtaacgcttcattatagcaagggcgacctctttcgtgcagttatcaagataataggtcttgtatccatctctttcgctgtcaggaagctccagaaagaagaatataggctcagcgagcttctctatcacaccgcaggcgaccttcgccatgatgtcacaactcagcacaccccttatattatccccctgaatgtggcaacaagaccgcagtttttccgctccgcccacagatacgccctgacagagggtaaaattatcttccataatatcctccgtaaaatagttttattaccaatagtataaaccattttcgcagatatttcaagtataacctatgaatttacattaaaagtttacggcagtacagcccttcagccataccgccgctagaaatcacaaaattcagaaaaaagaacagcgttctcacgcatatgtcgcaaacagcctgttacttgcctctctgctcaataatgccgatcatctcgcccacatctttcatacccgaaacttcgcccattttgaacctcatcttgaactcgtcctccaccgcaccgataagagtgatatgctcgatagagtcccaatcctcgatatcatcagccgtggtgttctcgtccacctccaaagtatcgtcatcaaaaacatctctgaaaacatcatcaagtctttcaattatctcgtccttgctaagcataatgctcctccttcacctttataacagtatttttatcctcatacccctcaactaaaagccgccaagccgtgttgccctcttcgtcctgagatatcttctcaaagccgaagctttcataaagccctgccaccattttatttttcgccgtagggtaataatgcccgtatatctcccttatgccacgtttttttgcttgttccacaagactatccagcatagcaagctccatatcccttttcagcacacgacatgacatcagccaaagctcgatatcaagcctgcccttgtcctcgctgtctgtctttccgatagtcaccgccacaacgccgttgtcaccgaatttgtcataaagctttccatacagccttatgtattcatcagagttatagaccgcctccatttgctccgcagtgtatctctttgtggtgagattgaactgattgctcttgttggtgagctgagttatcctttgcagatacaaaggcgaaaaatcccctatctctgccgtcatttcaagactcaaaagataatcatgataatccgcaaacctgctctgcgcctttgcacgctgagcgttcgccctgtacatatcattgcgtttgagatcgtcctccgacagcgtaacagtttcaaaatatcccgaacggtcaagcactcttatgtagtccgtgacttcccctatctcaggcacagccgttcccccaagctgtcccctgactatctccctctccgcagggttatcgtccacaaaaacaaacgcctcagaaagaatgttaagctcctccgccgtgtcaacgatatttttgtcctttggcagccagttggcttttatcgccacaaaatcatcaggccttagcacgccctcagggtgggaaagcccagccaaagcgttctcttcctcgtttttggagcataccgtcaaaagcacgcccaagtccttgtgcgccttaacatactgctgaaactcaaaataagccattgcctcagccgtttccttgcctatctccagattttccacaccgtcgtcaccaacgatgccgccccaaagagtgttgtcaaggtcaagagccagcgcctttttattcttgccaaagatagcctttataatactcgccacctgaaaagccagctcaggtatagcctcgatatttagggcatatttgtagagataccaatacttcggctcgctccacttttcaagcccatatgccgctgacagccagtttatatcattgagataaacctcaggcctctgggctatcctgtcatacaaagccgaattgagccttgtgacgaagttcacctttccacgcctgtcggaagcgtccatgtttcccataaggcggaaaaacggaagctcaaaattgttctgtatcacaggacagccgaaatgctctttcactccgtcccaagcctgagaaagcctgtcaagctcagcgttcaacccctgctctatctcctcttcacccgacctgggggtaggtgaaaagctgaggtttctaaggctcgtgtgtatataaacgatatcaggtttaaagcggtcaagctcctcgtttgagaacacagcgtcctgccagaactgtccgtattccgatcgatagaactcacattcaaagcccatgtcaagcaaaaacagttccaataccgacacaatatcgtccgtagtcgagccgcccagcacagccaccctctttttcagccgcaccgctccgtcgcccaaaagctgccttttcagcgaccttttctttttcattataaacccattgtcaaatggatactccaactctttcattcttttttaccttctcttaaataactctcagcccctatgagcctgtcacttcttcctgctgtacctaaaatcgcagtatgatgcaccctcagcaatagtccccgtcctaacgagtttcatgttcatcatgtccgccagcacaaaatccattctgcatatgtaagccgccagctcaggacacccctcgtccttacaaagcttgcacgccccacattcgtgataatcatacccaaggtcatattcaccattgcccggcagtatgtccaccacccagtcgttttcatataacctcttgtgactgtcctccgaccatttcaaacgccccggcatcttcttagggtcaagataactgtccacatcacccatgaccttgtgaaaaagctttgaagcgcaaagcccgtcacggaatatctcaaaattctcctgcgcagacttccctgtgctcctgttcatcgcaatgtaatagctcgccataatgtacgaactcaaaagctttgacttaccaatatccttagccctcgcaactatcttcccatgttcttcctctatcttcttagccacctctttaggaaagcctctccttttaagctccgcctttaccacactgtgataaaagtgaaatatcatcttcacactaaacgtattttccatattttcacctttctatccgttaaacaacgccaactctattcccgattatccatattgtaaataacgcaagcaaacccggttatcaccgcaaacagtatcgcaccgcccatttcctcctgcaatgctgccccaacaaaatagccagccatagccgcaaaaaacatgataacaacagccgccaccgtcctaaattttttcataacgctcaacctccaacctatcacatattatccatattgtaaataacgcaagcaaacccggttatcaccgcaaacagtatcgcaccgcccatttcctcctgcaatgctgccccaacaaaatagccagccatagccgcaaaaaacatgataacaacagccgccaccgtcctaaattttttcataacgctcaacctccaacctatcacatattatccaaagccatacggcaaacctcgtccgttagtttcaccttacccaaacctacagcacacaaaccacaaaccagtacacataaggtaccagcgtcataacaatatcataaactgcaagaatttttcccgacagagcatgaccattcgccgtaccctttttccaaaccaacaaactgtacagcacgctcaccgcaatatgtatcaaaccacaagcaaaaattatccaatgaaaaacaccgtactgaaacttcccctcactgcctgtcagctcaaagctaatgattatcacccagcccaaaaggtcatttcccaggccactgataacatgagccgctatagccaaaaatttcttcataatcataccccctatgccaaaagcatctattttttattttctgataactcacattttatcatcgccctgcacaaaatttgctctacaaatttgtgcaaacaaatgatttatattttaatttggcaatatttctgcaattgttgcattttttatgcaacaaaagtggtgattttcggggataagtagagagcgttttgatacttgcgggcacgtacaagccctgcgacttagtgaaaccgaggtgcgtttctggaacaggctgtagagtacttgtgtcaaagcgtgggtgtgcattgcggtattttgtgtatacgcaaccaagggcataatacccaatgtcacaccccgaacgcaacttgaaaatcaaataaaaaaattcggacacactcataaaattacggcaacaaatctgtaggggcgaacagcgttcgcccgtcgaagaaacaagtccacgattacaaccattgtagggcagaacaaaaaactatcctatcacgcttgtatgggacggcgcccccgacgtcccgaccctccgacatttcgtctgcaatctcatttgtgttatccacataatgttttctacatgagctcttgataactccttcgagcgggctgtcgagggcgccagcccctacaatgctgaaattgcataatttcagaacacaggcgaacgctgttcgcccctacagttattcgggatagtttatcttgccgcaaaatcgctccgctctttgcgtatctacgttttgctatgggatagaaaagcggtgcagatttaattctccgatatcacttttatctgatatttgacttctatatgctatttttcattaaatctgcaccttgtcggcttacgccgaatgaggctctgcctcatactccgctaggggctttgcccccagaccccacaatgggtttcaccccttgaccctgaccagggacgtgtccctggaccttttgctcgcttcgctcggtgctttattttactttatgcttgcaatttactctggtctgctttgcccattcctcattcctcattcctaattcctcattcctctctcctcactcctcacctaaactcctactgtatcctaatattattcaaacaatccaccttgctaggcgttgaacagctcgtcaacgatattgcaaacagcaggtccgtacaacccacttctttacaaaaatcaatagcgtttatatcaaaatatctgaaatcacaaacataaatttttgagaaaccatgggtgaaaaatggtatcagagcatttccaaagctgtctttaaacaccacaagcactctgccattgtccacgcccgtgtctatctcagctatctcctgatccacgttgagtatcgcagaatagcagttcacgccctctgcatagtcaaaaaacagcgtagactccacagggtttttaaactccgtatcataatactttaccgtcagatcatcattattgtcaggcttatagtaaatgaacttgtcaggatattttttcaactcactgttgtaattgctgtaagcatacatcgttcccacaaagccgtctatctcccatttatcgtaggtatcaaggtccggaaaatctattcccgactgatcggcaaaaacctgcgccgcataatatgctcccaaaggctgccagtgatgatccgttcttgagtagatatattcctttgtatgctcagccagagcgtcataaacattggtgttgattattccgttaagacctgcggcaatgttgtcgatattgtctttctgatctgaaacagcgtccttgagattgttcggcatataataagccgccgaagtcgggatagacatattgtatacgttcacgctgtccccaaggtcagctttccatttgtttatggtgttggcatacttgtcgccgttctcgaacgtgccatagtatgcacccattgcacggacgttttcgcccttgccggatactataacgtcaccctcccactgaccgtcgtcaagattgtcaggcacgtcaactaccttttcgctttccgttaattttttcgtagttgtgcttgtgtcggtggtctttgtatccgcagtggtggtggtcctcgaacctgtaaaagccgttacagttgttgtttttgcgatcttatcctgatccagctcttctttttccaccgttttgaaatcgcccgttataacagtatcgttgagctttattccaagcatattcgtgaaatcagagcagaaagatttaagcttttctctgtttggaacagtgtcggtaaaatattcggttattccgcttgtgaagtcaccgtcaaaatatgatgacagcgaaaatttcggaaaagtcgcaaggtttctgttttctgactgtataaaaccgctttcacgcttcatcacaagcagtgccgcaaacacgctgaaaacaataagcaggcaaacaacagagtttataacattaaactccagctcatgaatattgtttttcttagccttttcacgttcctcacgacgtttttttgccttttcgatgccttttctgtaagcttcctctgccttagcgtcgctttcttctttttccacaggatcaggtttcggctcagatttaggttcagcctttttttcagctttcctgacaggctcctgctctttctgaacaggcactctgacatttattgtcgcctctaccctgctgggcttctgagcgttctcaggctttttctcagggcttctcttgtcgattatctcgaccctttttcctgcgataacagggcctttatcctgtgccgctgcgtcatattccctataatagctgtcagggatcttcagcacgaaattcttcttattcggcagctttttcacagttccgtctgctgaaactgccacagatatctcttttttagtgccgtttatgtgatttttctctttggaaaatgggataatgacctcattatcagaagccttttcctcagcttttttctcctgagctttttgtacagactgagagttttcaactttttcagcttttttctcaacttttttcaatgcttcttcattatcatcatcagtatttagccatacgcttttctttggcttcaaaacaggctcgtccgtccaaatgctgtggctgagagccttgttttttctgactatcttttctactatctcgtcatggacagtggagcttttctccgtttcgtcaacttttgccatgctgacagcttcaggctttttcttttcctcgcctataggctttccaccgaaagtaacgctgtcaagatactctgtataggcttctgaaagagcctttgtatcaggcagtttgaagtccttttcaaaatctttattatttgccatactctttcacctgcctaaaatctgaaatacaagaacggattgtttgttgtgttcacaagcagaacgcttgagagaacaagtatcgccgcattgcataggatacctgctgactgcataaaataggctgtaccatttgcagagagcgccttttctttgatctttggtataacaggcattgtgaaaagcactgccgctgcaaaaagccagatattgttcatgaaaaggtgctgtgtaactgtgtcggtcagcttgtttccatttgctccaacaagtgccttgaagaacgtacccagcgagccaaggttctcaaaatagaatattccaaagcctatgaaaataacaagctttgtatagatatgtgcaaggggtacaggcattttcttcatgcgctttttgcctatgagcatttcaaagaatatgaacattccatagtaaagtccccagaaaacaaagttccagcttgcgccgtgccaaagtcctgtgcagaaccatacaaggaaaagtcctccgtattttcttcttttgccgaagatagggagataaagcacataatctctgaaaaatgagctaagggagatatgccacctctgccagaactctgagatagttttgcagataaaaggatatttaaagttctcatcaaagtggaagccgaatatcctgccaagaccgatagcgatatctgaatagcctgagaagtcaaaataataccacagacccacaagaattgcgccaagccatgtgcctgccacagagagggtctttatattttcatagccgtttgaagcagagccgaaaagggctgttacaatggtgctgagattatttgcgataatgacctttttaccaagtccgaggattattcttgaaaagccgtcggagatatccttggcggtggtctttctttcgtttatctcctcgccgataacggagtatcttacgataggtcctgcaacgagctgtgggaacatggatacatacaaaagaaatctgccgaagtttttctgcggcttgaccttgccccaatagcaatcgacggtataggaaatagtctggaacgtatagaaagagataccgataggcaaaacgatattaggcaccggtatgcctagaccgaaccaattgttgagattttccacaaagaacgccgtatacttgaaaccgaacagcactccaaggttaaagacaagcgaccatgcaagcgccgcttttgcctgccagccttcggggtgtttttctatcacccgaccatttatgtagtccacaagggaggaaactatgaggatactcacccagacaggctcgccccatgcgtaaaagataagtgaaaacaccaccagcactgcatttcttatggctgtactgcgtgtgataaaatagcatatcaggcacacaggcaggaaaaaatacaagaaaaatagatctgcaaataccacaacaaaactcctaacaaaaattgataaaacagccattgtcggcttattccgacaaaaggcgatacacatttaagtatatcactgaacaaactaaaagtcaattaaaacagaggcctgcggaaagtttttcggttatgcacaaaaaaagccgcacaaattgtacggcttagaaatatctaaaaatcatgtgcaagtgaccgataacgggcaaacaatgtccgcccctacagaaagtcacgcatttacgctgtttaatactttattttcagggtcttgcccggaacgctcacgccgtctgacagagtgatagggagcttttgctcctcagagaagccgatagtttcgccgtctttaagctcaacgccctcagaaagcacatactcggagatagaaagcaggaagcctagtaggtcgttaggctgttttggagagtcaactatctccatttcctcatatccgaaaaatctcatgcctgatgtgaaagcgcaaagacctgttttagcaagatacataccggtataaataagtataggcatcggatactcgccgtctttgatagtttcggcaaagttcacatagaaattcttttcataaactgtcgggtctttatagataccgatagcgttatcgagcttgagcagagagcttgccacctttgcaaagaggatagcctgttcaacagcgcttgttttattcattacagcgagcataacgtgcgcctgatgcttagcgacctcgtttgcgccctctttccagagaatgttatactttgccgcattttcagcttccttgttaggaactgggttaggcataagtgagcaagcgaccaccatatcgccaaccttgaataccatagcgttgtcttttacatcgtcctgcggaacgatgttccaatcgtctttcagaaactttttaaatctgagccaatccatgttagcatctgtgtagagaacgaagcctgcaaggacgttgccttcctttttatcgtccttgttttcctgaacgtttttgttttcttctgacattttgttacctccataagataaagtctgttgaagtcattatagcacacttagggagaaaatgcaacaggggggaggtaaatgaggaatgaggagtgttcagttgtcaatgataggtgacacatcttctcaaaaaataatgttaagtaactaattgcagcttttcatttggactcctgtttctttcttttattataccactgtcacgatgttttggcaattttgtgttcagtttctagggtacattatagtacacaggaaacaatggttatttgactaaatggggcgcaaaggacgtgttggcgtattacggaagtgtattggcgtttataggaacagttttactgggtgctttatcattatatcaaaacaatgtattcaaaaaaagcaatgaaaaaagagaaaaattgatgataaagccctacatttttactagtattgaatatgaaaatgctacatatttaactaaagaaaagaaagagtatactttgattgaatatagtaatagtggcggtgaatttcatgtaaaacattcatcaagaaatacccattctgcaatcagtgattatgaacgcaaagagaaagaatatagtgattttttaaaattaccaaaagacaaacaagattacagtaaacaaataagattacttgaagaacaaacaaacattttaaactgtctcaataaaagatttttgcttgttatatatgacgttacaaatgctggtcatggaaatgctattaatattgatattacacttaataaaaataaaataacaccattgttttgtttatctcaaaatcaatcaaaagaactaatatttttatttgattttcaaaacgctaaacataataaagagtatacttttaatatcgaattctgtttttatgatatagaatgtgacatacattaccatcaagaagaaactttttatataaacaaagatagtgaaagtaatctatcattgagatttaaagagcaaatatctaaaccacataataaggagaagatctgaaattccgaaaatcagtgaaagatcattggatataaaagaaggaacttcccaacagtacttagcttattttcacagagcttgaatatgacgaaaaaactttacgagattatttttgaacaggtctctaatcttgatttacgcataaaaaaatgatataattaaagcagattgtttattgcaaaaagttaggggtttattatgagtaaatatgtttggtgcgaggacagtgcttcaggatttgaattttggaaaaacattttcaaagtgataaatcctgagtttactgtacaaactaaaagaaataatacagaattacgaaaggcagcatcaagaattgaagctgatggcaacgaatactatattctaatagatagttctgttgataatcatgatgttgtacgtgaagtgaaaaagttaaaagaatgcgtagaacaaaaagaaaacgttcaaataaaagaaatccattcatttgaatttgcgcttttatcttttcaaaaattagaggattgggtatttgctaaagatgatgaattgaaagataagagaataaagtttcttagagcaaaagatatttttgttgatatacaattaaattctagaagccaagaaggccttatagaacttaagaatagtcttaactattcaaacaactacaatacagagcagttgtcagcaaaactgttgttcgacattacacgtaatacaggatttgaaactgacaagggacatcttggagagtgctttgttaataactgttgtgaaatggaaaacagacaagcagatgacatttgcggtttagatacagacaggctttcttcagaagataaggcaagacaaatttatcagtgttccattttaaaagatatgttgcagttagagaggtaataaatgattacaatatataaacacggtcagattccaaaatcaatagaaattgttaaattgaacgatgtttattttaacaaatatactgctcaaatgctggataacagggcaaatagagtaattgaaaaaattgaccacgctgaattgatcggaccatatacaattaagtcacgttttgacgggacaacgctgaacactgataagctttccagtggctgcaagacggtattgaatataatgtacaatactgataagatttttgacataagagaatgtggtgataatgctcttgatatgatctattctcttgacgaaggaaagatctgttgtgattatccgattatatcatttgatatgacacgagtgaacgtgtatgataagagtaagaagaaatgcagagaaatagatgattatgaagaattgaaggagtggtggagcgatgaagattaaaccgatcgtgatgcaagagatcaatactacccacacttccttcatcattgatctacattttgattacaacgttacttttatcacaggcgactctggcgttggcaaatccgctctgtattcatttattgaagaactgtctgcaaatgataaaagaataaggtgctttaattaccttgaccaaaaaaagaattacaaagcttcaataaaaaattcgaaggataaactttttgtaatagacaatgcagatattctgttggacgataaaatgaggcagtatattgcttttgatgtgcaaaaccaatatgtaataatagggcgaaaccccaccggcttaatgcttgagttagatgagatctacgaattgtcaagcgagaatatcaatggcagaacactattatcattaaagaaaagcttttaaacgatgagttggaagatagattctaaaaaagctgtttaattttttcagcccaataaaatctaaactgttttatagtagaatcccaccaaatccccatacgccaattttacgccaaaatggcatagcttttgcgataatatataaactttcgtaaaaagcaaaaacgtcgcgaatccggtaaaatcaagggtttgcgagcttttgaaaagttattaaaaagcggagtggatatttccctacgatgaagacgttggaataaacatagtaagataatttgtagaattaatgggcaattcagaatatgggtcgcccattttctaagcagaaatataattaggattcatagaaaaaataaactaaaatttaaaggagaagcacatgggaaagaaacaagttccaaccgcatctgaattgcgtgagtacctcgcaaaagaaagagcatatctagttgattgtgtcaaaaacaataaaacatttgtaataacaggtccaaagtttccgggcgaaacaatttggagatctaagatcacattgcctttgctggaagctgccgaagaggtcggcacatcaaacgaggaaatatgggaactgtgcaaaaaaagaactcaaacgacacacgctcctgttacgcttaaagaatatcagcgcatgcttccttttgcacagaaagaaaaaacggtcgacgctgtattaaaacttttggaaacgtatatcccaccttttgatgacaagtattggacgggttttgatattgccggatattattattgccttgctcttatttcattgtccgattatagaaaagaatattgtgaaaaacagctatggacgaccattgaccaattctttaaatacgatattgggctggagaacatcccagttttgttaagaaacatgactatattagggtcttcaagacctgtactgaaaaaaatgggggcaatcattgaagcagagatcgaaaaaagagcggtaaacaagtgacgttcttacgagttgtttcacaatagtggcttacattttcgttgaaaactaccctttgagagaggagaaatccctttctcaaagggtatttttatattgtgcagtttgtatgaggtttcttgtgtttcatattatcacataagaaaccgcaaagacatcaccgctcttacttctcctcaaacatccacttgaccgccttttcagcatactcactccaaaacatcatatcgtggttgcctttgctttcaaaatactcgtgagaaacgtttctgctttcaagaaatttgtgaagatcacggttgttttcaagcaggaaatcttctgcaccgcagcacataaatatatctgggatatttttgccctctcgctgaagttcgtctataagaaattcgggattgttcctgctgttcagcacctcagaggtttcgccgaaacattctctgtaatattcataattcgccacatcgttgccttgcccctctgacattcctgcgacttcgtgtacaataagagccgaagataatgcagcaaccttgccaaaggtttctggatatgcaaatgctgtatgaagtgcaccaaatccgcccattgaaagacccataatgtatgtttcactgccgtctttcgcaagtctgaaaactcgtcttacatagtccacaagctcctcgccgacgaatttgcagaactgatgaccagtcgagcgtccgtccagccaaaaagaattttcgcccgaggggataactaccgcaaaattgtacttgtccgaaaggtattcaggcacccagttttctgcgtcgcctgtaaaaccgtgcagcaagaaaagcgttttggtgctgttttccgagtatttcgtatctgtctgcccccagtcctgccttatgtcacatggcaggtacattttaaacgtggtatatctccgcaggcaatttgaataaaatctgatcgttaagtttgacatagtttttcctcctgttttttatataattatactacataaaatcaggtttgtccaagggagaagcgaaaaaatttttcaatttccctcacaaaatcatttatccctataaaaaaatcacatctgtcaaagcctcgtcccaacgtaccttgccgctttttcataatattttttgtcgatcataattctacgctcctccgcatttacaaggtgtctatctaccccgtctgcaactattttattcattatatcaaaatcaaagccgcaaagtcaaaccagcaaaaaagctgtctgaccttgcggcttttgacctttataatacaatgctaaccgaaatgtgccctacatatcctccctcatcatatcattctcactctttataaacataagcacaaagcatataagcagcaatgcacaagatatccatataaactcattgcctatgtataatgaatatgctccgcctattcctgcaccgcaggcaaatacgaatatcgtaagaaaatattgcagcgatttcctaagcagcgacttgtcccctatcctcatgtatgcacttatggattccattgcacttctcatatttcctatgcacatcgtgcttgcgtatggataactatttactttcctgaacgattgcacctgcattgcacaggcacatgatgaaagtgcattcgcaacaaaatcgtatgaaccgccaagcggtataaaccccacaatgcaaagcagcaccatttccgtgaaaactattatctgccgccaatgtataaatcccacgtccttgaaacgtgcgtgcagacgctcggctatgaaaatccccattgcaaacgccagcacaggtataagatagtgcaacgccctgtgccagttgccttttgcgacatatgtgctcataagcacaatgtttcccgtctgtgcatttgaaaaaacttcacctcgcacaaaatacgaatatgcgtcctgcaagccccctgatatggtcagaagtatcatgagcatattggtttcagacatttgttttcttgatcgtaacatcattttatcatattccttcataaaaaattaacaagaaaaatatttttatacactttaattttctcctttttccattataattatctcagatatataagtcaaatgtataatttatatgcaagatataaaatattgatatagcaagaaagtgataaagtgaatataaattacgaatattataagatattttattatgccgcaaagaaccgcagcttttcaagaacggcaaaagtgctgctcacaaatcagcctaatatcacaagggtgataaaaatactcgaaggagaacttggctgcacgcttttcaatcgaatgaaaaacggcgtcacgcttacccctgagggagagatactttacgagcacatctcaaaggcggtggaacttattacagagggcgaagatgagatctcaaaagccaacgacctgcaaagcggaactgtcaccataagtgtgacggagaccgcacttcacggcgttatgctgccacttctcaatgagttccatgaaagatatccgggaataaaaataaagctgctgaaccattcaacccctcaggcactgactgctctcaaaagcggcattgcaaacctcgctgtggtaacaacgccgataagcacagagggctcgctgaattttcataagctcagagagttccgtgaacttatcatatgcagcacaaagctaaaggatattgcaaagcgaacgctcactcttgaggaactttgcagccaccctataatatcacttaaccgaaacacaaggacatatgatttctattccgatttctttttccagcatggaatagattttcagccggatatagaggtcgcaactgccgatcagataatgccgcttgtgaaaagcaaccttggcataggtcttatacctgaaccaatggcacaaagcggcgatgtttatattctgaaaactgatgaagagtttccaaagaggagcatcgttcttgcagaaaatgcagacaaaaaactcaatgccgccgctacagagatacaaaaaatgatactgaaaaagtgtaatatgtttgcaaatgctgagatatgacatacatgaaaggagataataatatgcctacagttttgccaaaagaaaatgaagtcgaacagtttttttcaaggataatggcatcggaaggagcttgcgaaaggctcagcaacgtgctttacgatcaccttagtgacgacgatatgcagaccgatcctgacccaaaacatcttgtgcaggtgcttttgaccgcatatacgaacggtgatataagtgcacttctgctggagctttgtggaagaagtcttttcgatctgctgagagaggcataccttataccaaagcgttttcacggaaaagccggaaaaaatcctgaactccttacgacccctgaaggcgatgtcattgaagaaaagaaaaagcttgtcacaaagcatgagttcgaaaaatttcgtgatgtgtacaaaaaccacagctgtgcaccacgttcaaagctttatcttgcagacggatatgaccttatgagggtctataccgacggaatgaacattaaggaaaagcgtgttgacaaaagacgtggcgtgcttatactttacgccctgcctgacactgtaaagcttggactttccgaggctcagacctataatgttatatggaatactttccacaagatacagcagactgccccaactgcaatggtctattacggacaggaaacaggcgaaaaggctggaaaatcatttgatgagatcggcgttttactgcctgttcatcagtttgaaaagaaaatgctcatgcacctcagcgagatagacggcattgtgcttgcctgccgtgaggaaatgatgaaaaaagcaggctcagacagccttgatctttaaaaacggaagtgatactgaatgtcacaaactatagttaagaaaaatcacatggatatcccatggcacgatttcacagacgccgaaaaggacgagccagtatcaaaggcaagcctaaaagaaaaagcctctgttataggcagggtgggaatgatgtttctctcctgcggaacgggagcgtggcgtgtgagaagttccatgaacaccatgtcggaatgtatgggactgacctgcacagcagatatcgggcttatgtccataaactacacctgttttgacggcgaggcttgcttttcgcagtctctttgccttactaacacgggagtaaacaattcaaagctaacacgtcttgaaaatttcatcaacgattttgtcagccgctgcgatagtttgacttgcgaacaggtccacaatgaacttgacgatatcgaaaagatacacggactttactcgccgcctgttttgggccttgcggcggcacttgcctgcggagcgttcacattcctgcttggcggtggactgaccgagatgatatgtgcatttttcggtgcaggcattggcaattatgtgcggagcaaattcacaaagcaccaccttacccttgtgcttggaatagttgcctcagtatcggcggcgtgcctttcatatgcagggctgtttgaacttgcgaaaatacttttcaatataaaaatgcagcatgaggcaggctacatatgtgcaatgctttttattatacctggttttccgttcatcacaagcggcatagacctttcaaagctcgatatgcgttcgggcatcgagcggctgacctacgccctcatcattataattgtagccacaatgacggcgtggttaatggcacttatcctgcaccttacgccaatggactttttgcctctgcaccttaccttatggcagttcatactgtttagacttgcggcaagtttctgcggggttttcggattttccgttatgttcaacagccctgtcaagcttgcagcctctgcggcagttataggtgcacttgcaaacactctgagattggaacttgttgaccttgtttcatttcctccggcagctgctgcgtttgtgggggcattcaccgcaggcatactcgcctcgctgctgaaaaagtatgtgggctatccgagaatatccataaccgttccgtccatagtcataatggttccgggattatatctttacaaggctttctataatttgggcgtcatgtcccttgaaacatctgcgtcatggcttgcgtctgctctgctgataatactagcgctgcctttgggacttatcttcgctaggataattacggacaggtcatttaggtgttgtacttaaaatcttagtcatagcctaaagctataccgaacccacataaaaaaactatattgatatacactttcctattaagactattctccattacctataactggcgtcagcggcatttgtcagcaaaagcgaagtgctgaggtgttttaagaacataacaggacagtcgccgtttgaatatctaaaaaattatcgtctgcgtaatgcggcatatatgataaaaaacacatctgtctcgataaatgctatctgtgtgctttgcggctttgacgatcacagctatttttcaaaagcctttaaagaagcctacgggtgcagtcccagagattttagaaagtagaatatacgggacaatatctcacagatttatccgtctgtcatgcagacattacattttcctgtttataggactacgataaaactattatcaaacaacagacgtttcattttatccaaatggaacgtcctttgcatttgtgctttttattgtatgaaaaaagagtcaattattctcctcccaataatcctctgcatcctcatagtcatagaaatcatcatagttatcttcatagagatcctctgggtcgtcataatcatgagcatcatactcagcagatttactggttgaggttttattggtattcttatgggtagctctggtagctgaactacttgctgtagtggttttcggacgtgatgttgtagcagttgtgaatgctgaagaatagctgttcttattattgtaatacttagggtcatgtatcaaacagtagcagctgccttcttcaggagtattgtcacagccggagtgtgcgcatttggggcgcagggcatcatagatcatggctatccctatgacgatcaacacagcgacaacgattcctttgagattgaacgaactatgctgagagctgttttctgttgtcagcctgtagcctatataatcgtcaagcatttcctcgtttctgttgttttttccagattccataatcacacctccaaactgtatttctgatattataccatattttttaagatttgtggtaacaatttttggacagttgcatattctgtccattttatcattttttagtggcaaagtcgggtagtgtacggaatatttaacggttactattactcaactccccttaattttatccccattatacagcttgaagcaaactctatgccaatgggtaaaaaatttttcaaacctccccaattttacccctaagtatgttataatagaataaacaagaaacccgacccaaaacccagtgaggtgcttttatgacatatgcaatatctgatatccacggctgttatgaggagtatattaagcttctggaaaaaatcaacttttctgaagacgataccctctatattctaggtgatatctgcgacaggggcgaaaagcctatggagatctataacgacatcatgactcgggataatgttatcccgctgttcggcaaccacgaacaccttgcctatatcaatctccgccaccttataaaagatgacgtgagcaagcttacaaaagacgaacggctagacctgattgattggctcaccagcggaggcaaacccactttcagcgaatttatctccctctccaaagccgaccgcatggactttatggagtttcttaaaagcttttcaatgtatgaggatatcaccataaacggcaaacgttttgtcctcacccatgcaggtcttgggggctttagcgaggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatgtatgaggatatcaccataaacggcaaacgttttgtcctcacccatgcaggtcttgggggctttagcgaggataagccccttgatgaatataccctccaccagcttatctgggagcgtgccgactattcaaaacgctatttcagcgacccgaatactttccttgtgacaggtcacacccctaccgccaatatcccaaaccacggcagacccgaagcctacaaagccaacggacacatagccatagactgtggctgtgcctcaggtggacggctgtgcgcctactgctttgaaactgacagggagttttatgttgacaaaataaaccagccccttgaaaatcacttcaaaatgtgatatacttgtcctaataacataaccgacgaggacaaaacgggggttatgccgtattaaagcgtatttatagattatattttatggaggtaatcatggcttttgattttaagaaagagtacaaagaattttatatgcctaaaaacaagccagaaattgtaactgttcctaaagcaaattatattgcaatcagaggaaaaggcgacccaaatgaagtatgtggagcatatcaacaagcaattagtgtgctatatgctgttgcttatacactgaaaatgagttataaaacagatcataaaattgaaggattttttgaatatgtagttccaccacttgagggtttttggtggcaggacggcatagacggtatagactatactgataaggcatcattcaattggatatctgttatccgtttacctgaatttataactcaaaaagactttgaatgggcagttgaaacagcaactaaaaagaaaaagttagattgttcgtcagcagagctaatgacaattgacgagggattatgtgttcaaataatgcacttgggttcgtttgatgatgaaccagctactattgctctaattgatgaatatttagaaaaaaacggatatgtcaatgacataactaagacaaggttacaccatgaaatttatctctcagatgcaaggagagttgtccctgaaaaatggaaaactgtcattaggcatccaataaagaagatatagaatacttccatttagtcattcttttcttaaataattattcaccggtacagcccctctgtatcggtatttttctgccccaacgcccctatccgccccacctctattgacatttccccctcaatgtgctatcataaaaaaagatgagttagtcacaactatcttaataacaccacaggaggaagaaaaatggatatgaatgaaaaaccaaagctctcaggcgtgcctgaaactatgctacaaaccgtgtatgcccgtgcaaaagaaaccaaaacaaggggtgcgataaaagatacaaaagccgtggagataatagataagataaactatgatttttcacttgccgataaggactcagcaatgcacagtggcgttgtggcaaggacaatagtcctcgataagcttgcgaacaagtatcttgcaaaaaacaaaggcgcagtggtggtgaatatcgcctgcggacttgatacacgctgttacagaatgaacggctacacccattggtataacctcgacctgcccgaaactatcgccgtgagagaaaagcttctccctgaatcaggcgaaatatcccagatagcaatgtccgcaatggacgattggagcggagaaataaccgagcacgatgcccctgctatcgtcattatcgagggtctgactatgtacctctcagaaaaggacgtaaaggagatttttgatgtcataaacaaacgctttgaccacgtcaccgtccttgtcgagacaatgagccccactatggtaaagcgtatgaaagaaaagtcgatcgagggcagcaaagccaaattcacatggggcgtcaaggacggcaaagagcttgcaaagcttctcccgaacttccgccttatagaagaacatagccttgccgaaggaatggcggagtttatcccaatattcaagcttcttaaaaagataaagcctgtgagcaatatctcaaacaagatagtagtaatggaaaaataactttgacctcccacccccaccatgctataatcccaaatttagaagttccgccacgcaaaaagcccgtcaaacagcgtatcaccgccgcaattcagatataattttttatctccaacaatataaaattcttttttttgcacgggtagcggcaacattcagtcaatgtctgcgttgatgcggaatttgataaatatttttcagtcactccaaaatgttctctaagcatattcagaatgtttgaatccattgtgagtacaggctttatttgagagcgatactgcaaaaatagtcagcacctttaagctcctcaacaaacttttagtcgatttgttccttggtaagcggaagctcatttacgatattctgcactgcaccattattggagcttgcaacaacaatattattttccgtaatgatctctggaagtacgccagtagatgcgttgtcaaaatatattgtctcttttgttcccttgatcgacctgtctcttagttttgcgatatcataagcctgttttacaattttttcttatccattgccattcccctatcttccgttcatcacccaagcaaaccccttagctgtccgcaaagcaggctctttaaaatgcccgcccttgttccattcaagggcgcattcgataccctgccccgtcagcaaatcataactctcacggatacagttgcccacctttgacatgaccgcatttttcgtcctttcttccttgtcaccaaggctgagataaacagcgtcgcattttatcttattctctttcatataccccacaaaatcaggaaaccacaccgacggagaagccgccgcaacgcctgaaaatttctccgtttggaacgccgcccacaaggcaaaaagccctgccagagaatatccgccaatgtaataattcttgctcttgtccgagcaaagcgttaatatttccgccagagtgtcttccgctccattgccgaagccctcattgccaaataccgcaggggcttcccatggtgaaagctccctgttccaatcatcgaccttcaccgcaataagctgaaaatccacactcgtgagcttttttatctctgccacctcgttttctatctcaggcagatcatggtcgcccacaggctggataagaactgtgtcggcatttttgtcagcaaaataatgcagtgtcattttcttgtcctttccgttttaatggggcttatcaaaaccaatattcatgcattttcgtcaaaaattccgttgtgataggatatccgcttgattctccgataacagagtctatacagcaatatgggcatactgctgtttctgtgttatcttttatccaaaagtttatctcctttgggtcaaaaattttcaggcagtagaaacagccgcactttttgtcattttgcagtgcttccttgttgttgctggaaaacttgtgagcttctatatagtcggtcattttttactccttagatagatattttttatcattatatcacgccgcaccctgcaaagtcaaatctctcccctgactcttaaaatcttcttcaccgcttcattgtcagtgtccttaaaatactccgcccgcctgcgctttcctatcctcctgtcagaggctttcaaaatatccgttatcccaaggtcatcggcttcaaaatcatgggatagcagatccgctagcggcgtgtctatatactccctgatgatatccgatatcaggcttatctctgttacataaggataaagctcctccacagtttcattatgtgagcatgatattatcaaccctcgctcaggcagcttcttatccaaaaagtctttaggataatcaaaaattatctccttgcctaatgttatccaatatctaggcaggtcagttccgccccagcggctatccattctgtaaacactgcaatgtatctgaatccctatcctgctgtcgataagcttgtatatctctctttgcagtttgctccaatgcttcggcattttgtcctcctttacatcttatccgtcgcttctctaaatgaccatatttgtgttcatactcctgatcgaccttttctgagtaaagtaaatgaaaaagcttaaaagcgtcttcctcactcttttctgtaagcacgccgtctttgtaataaaagcccgcataaaaatttgcgtccctattatatatcatccgctcaggcaaatagcttctcctataagtcagtataacacactcaatgaccgaatcatcactcattttgctttcgatttttttcaaacatatcttccgcactgcaataataattgtcggaatacaaatgcgatacctgaaattctccgtcagccattcggcgtatacatacaaaagtaagagaatccgttgctcttttaaactcgtagctttggcagtgcttcttatattcttcttcctcaccctcaggcgtaagttttaccatatccttgtgatgtttcactagctccaacctttgctgatcgtccaaaccattaagatacccaagtgtgtcagagcatggatccttccgcactctttcttcatcttgcaataccgttatctcaacattaccctccagcgacgttttgcttgcccatggtgatctcttgcagggtctgattatttttgggagggtgcggaggatttgacggttacctttcagcgaatttatctccctctccaaagccgaccgcatggattttatcgagtttcttaaaagcttctcaatgtatgaggatatcaccataaacggcaaacgttttgtcctcacccatgcaggtcttgggggctttagcgaggataagtctcttgatgaatataccctccacgagcttatctgggaacgtgccgactattcaaaacgctatttcagcgacccgaatactttccttgtgacaggtcacacccctaccgccaatatcccaaaccacggcagtcccgaagcccacaaagccaacggacacatagccatagactgtggctgtgcctcaggtggacggctgtgcgcctactgttttgaaacagacagggagttttatgttgacaagatgtaacaaaacctttatcatcctactatattatatcacatttcacgaaaaaagcatacctttttttattaaaaggtaggcttttgcgacaggctgaccgatacagcccctctgtatcggtatttttctgccccaactcccctatccgccccacctctattgacatttccccctcaatgtgctatcataaaaaagaatgagttagtcgcaactatcttaataacaccacaggaagaaaaatggatatgaatgaaaagccaaagcttcttaaaaagataaagcctgtgagcaatatatcaaacaagatagtagtaatggaaaagtagtttgaaaaagctttcactgatacagtttttataagctgtgtcggtgttttttatgtccagatgaactttttgcaaacgagatagagttttcaaaaccaagatagaaaaataattttaagatgagccaaaatgaaaatgagatactattgattttagttaagataaatgctataatatttcataaatctaacagaggagaggataaaatgccaatattttatatatcggatatgcacattggacaccaaaacgtcctgcaccatgacaatagaccttttactgacatcaaccatatgcaggctgtcatgacggcaaattggaacagcaccgtttccgatagcgacgaagtttatatcctcggtgactttgcatggaaaaacgctcaggggcttgaaatgctctatcagcttaatggcaaaaagtatcttatcctcggcaaccacgataagcccacagaggaaatgaaagcctgctttcagtgggtaaaagactatgcagtgatacaagacgacgaaacgcaggtggtgctttctcattatcctatcgcccattggtataatcaatatcgtggcgctgttcacctctatggtcatgtccataacaccaaggactatcaggcgtttttgcagtatgcacaaatatgcaaaaaccttgccataccatttgaaagctataacgtgggctgtatgctctattatatggactacacccccagaacacttgatgatataaggaggagcgcaaaatgatacttataacaggcgatatccacggaagccacgatatccataagctcagcaacaaaggcaaccccgacttcaaggatattttcaacagcatgacaaaggatgattacattataatttgcggagatttcggacttgtatggaacaatgataaggaagatatgtggtggagaagctggcttaatgacagacctttcaccaccctctttgttgacggcaatcacgagaatttcgacctcctgaacgcttatcccgtagaaaactggcatggaggaaagatacaccgaatagccccaagcattatccaccttatgcgaggacagcttttcgatatcgagggcaaaagctttttcaccatgggcggtgcagaaagccatgacagagagtttcgcaccataggcataagcatatgggagcaggagcttcctaataacaaagaatacgcccaagcactttccacccttgaaaagtgcggatacaaagccgactatgttataactcactgcgcccctacagatatcgaatatgaggtggagcatggaaaatgcacgtccgcttataatttctaccattcagaaaacaggctcacagagttttttcgtgaccttgcagagaaaatgcaatatgaacgctggttttgcgggcattatcactgcgactatgtgagcaaactaaacccgaagtttgagatactttatgataaaatagtcacactgccgtaatagtctgacctatgagcttgtaaacaacgcacccctttgacttcccacccccgccatgctataatgataaaaaaaagaggtgaccccacatgaccaataaagcatactaccacctgccggggcttttcgagttttatgacctttacaccgctttcctgcccatattccgtgagcatagagattatttctatgactggtgcgaaataggctctgtctatggcgcacctgccgactgcatatggggcggcggacgggcaggcttcggcgaacattctccacgagaagtcctcgaccttatgaaagaatataacatctcctcacggctgaccttcagcaattccctgctaagagaagaacacctttcagacaaaaaatgcaatgacctctgcaagcttttctcccaaaatgcagaccccaaaaacggcgtgataatatattccgacttgcttctttcatatctgaaagagaattatccccacctctattttgtgtcctctaccacaaaagtcctcaccgagttttctcagcttgtaaacgagcttgataatgacgatttttcctatgtagtccccgactttcgcctaaacaaagcctttgacaaactctccgatctcaccgctgagcagaaaaacaaagttgagtttctttgcaacgagtgctgttatgtaggctgtgcagaccgaaaaaactgctatgaaaacgtcagccgcaaaaatctcggtgaaaactgccccgaccatgtttgcaaagcacccaatgcctcagagggctaccgcttttcaaaagccatggaaagccccgcctttatcggcatagaggatatccaaaacacctatctccccatgggcttttcaaacttcaaaatagagggcagaagccttggaagcgccttgatacttgaatttctgctctactatatgacaagacccgaacatcagctaaaggtcagagagcaaatttatctcgacagtatgctggatctgttctgactattcttcacattgcatatctcccatatcacaagaaatatgtcacaaagttcatgttacccatggcttacttggaaacaaaaatcaaaataagtgtaaacaatgccacttttttgttgaaacagccattataatatagtataataacacagtgctttgtcacaaaaaagttataggagaatttacatgaagaaaattatcgacatatttctgcgttctttgctcacaggcgtggcgatagccataggcggaacagtctatctttcctgccctaacaaatatctgggagtgtttcttttcggcataggactgttcgtgatactgtcctttggctttaatctcttcacaggaaaagtcggatatgcagttgaaaacaaaccctcttatctcggtgagcttggcataatatggctcggcaattttgcaggagccgttctctccgccctgcttattacccaaacacgcatatccaccataagcgacaaagccacagagctttgcaatataaagcttggggataatatcacaagcgtttttatcctatcatttttctgcggaatacttatgttcgttgccgcagacggctataaaactatccaaaaccctgtgggacagatacttgcaatatttctccccgttgtggtctttatcctcagcggctttgaacactgcgttgctaatatgtatttctttaccatagcagacttatggaacgttaaagcctttggctaccttattataatgtcccttggcaactccattggcggaatacttatcccacttctgcgaaaaggctttgtatcaaaagcatgacgcctgtttttataggcttatataacatataaaaaaagataccgcagttcaaaaagaactgcggtaaaaaaatgacttctgctctcaggaacacagtaaagggggtattatgaaaaaaacaaataaaacaaaggagtcaatagtaaacataagataacaaataaaacacaatttaaacaacttagaaggagtgtgcagaagtcataaggcaataccgcacaaggcacgcctgtcggctttgtacgcaatctgcttgcagattttccgcacaatccttgtgcggtattgccttgatccgttcctgatgtatgtattatatcacactaaaaaccatttgtggtaactttttttggacagttgcgacttttttcaaaaaaaatctgcactccgaaaatcctaaagctttcagagtgcagatttatctttttctgtagaggcgaaaagcgtttgcccctttccacgtctatctgaattgtcgcctgtctatcaaataatatcagccctgcgtttacctatctgtgcaaactctttgcgccgtatgataaaataagccaccgttaccgcagtgcctgttatcacccaggaaacagggtaaactatcataagcataagatagcttctgtgagccgcataaatcgtgttcacccacacaagcctgaacacgcaggtgccaagcacagttatgaccgcaggtgtcatagagtgacccattcccctaagacagccgcccgatatttcgtaaacgcccgtaagaagctccagcaggcaaactgaccacattcttatcattgcgtagtgtataacgttctcgtccgttgagaatatctgtataaaaaggtgtctgccaataaggaatatcagactcagcccaagacagcttgcaagcccgataaaggtgcaaagcctgtatatctttttacagcgttccttatcctgagccgcaaaattctgacttgtaaatgtggtcgccgtctgagcgaaagcgtttatcacaaaatatgccatgaactcaaaattctgttccgctgtgcttccagcgataccgtctgaaccgaagctgtttatcgccgcctgtatcacaacgtttgacagtgagaaaaccatgctctgcaaaccagccggcaagcctatctttatgataccgaggagatatttccagcgtatcctgagctttctgaaatcaagtcttagcatctcctcctcgtgggtaagaaagtaaagtatcatgcaggcactgaaaaagtttgatataacagttgccgttgcaacgcctgccacgcccattttgaacacgatcacgaacacaaggttcagaataacatttataacgcctgcggtgataagagcgtaaagaggtcgggtgctgtcgcccttgcttctaagcactgccgaaccgaaatcgtatatctcgataaaaggcattgcaaagaagaatatcctgagatacagcgttgcaagctttaaaacatcatcaggcacattcatcatgccaaggagtataggcgcaagtatctcgcctacaccaagtatgataaatccgcttatgaccgccaaaagcaccaccgtatgtacagcctcgtttgccttatcttttctcccctgacctataagtctggccaccacaacgtttgcaccgacagaaagccccagaaaaaggcttacaataaggttcaccaatgaagaattgcttccaaccgccgccatggctttgtcgctgtcaaatctgcccaccaccgcaaggtcagcggagttaaaaagctgctgcaaaatacttgacaatgcaaggggcagtgcaaaaataacgattttgcccacaagcggaccgtttaacatatctattttcttatttttcataccggatcttctctcatctttcaactaactatttctcacacctaatattatatcacaccatcaaagctatttcaatactagaatttgcacataagcacacacagagatgtgtaaaaatctaaacattacgaccatttgtacaattttttgaactctttgcctgttgacaaaggcatgaaatggtgttataataatattccacgggaggtgagcagtatggcgatagacaaaaaaggcacaaagcagattgccgacaaccgaaaggcacgtcacgattatttcgtgctggagcagatagagtgtggtatcgagcttgtgggaacagaggtcaagtctataaggaatggcggcgtcaatctgaaagacagttggtgttctatcgaggacggagagatgtgggtcaaaggtatgcacatatccccttatgaacacggcaatattttcaaccgtgatccacgccgagagagaaagcttctgctccacaaacgtgagatactgcggctgttcggaaaggtacagcaggagggtcttacgcttatcccgatgtcgctatatttcaaaggcagcagagtcaagcttgcacttgggctttgcaaaggtaaaaagctttatgacaagcgtgacgacatggcaaagaaagccgcacagcgtgacatagagcgtgccatgaaagagcgaaactaacctgggggtgtaaaggtttcgacgggggttttgaagcacgataagcgagtagaggagcgcacactctttaaacggcgtacgttttaaaattagacgacaacgataattttgaattagctgctgcttaagtcagcgctcgtcttgccttagagtaccacggctttggtaaaggcgtcgatcagtggtgaacgttacaaagcgatggctgtagccttgtgatgtatcacagcctaccaaacacacaggcgtgtctgtttgcctttgtgcaagggaacgggagttttccgcaataacagaatacactcgtagaagttcgtggggataggctttcggacaggagttcgattctcctcacctccaccagcaggggcgtgcccctgcacccaattccgctttactttatgtaaggcggtttttttattgccgctcatcaattttatctaaaacccaaccattgtttcgccgtggcggacatttcccgtcaagtttttttgtaaacacacaaagtcaccgctgtgataatttgtgtgtcacttttacaaattcaggggcgtacccctgcacccgatccgctttactttatgtaaggcggttttttattgccgctcatggatcattatttataaacccaactttgttatttcaccatggcagacgctgatataaaaaaagagtgcattaccacctcagataatgcactcttatattttaccctatttttcctccagtccgctgagcgaaagcctgctctccattttctgaacagtcttgctctcctgctttgcgatcttcgcttcaaaccagaaggtcgagcctttgccctcctccgattgaacgccgtatgcaaagccgtgggctttgagtatctcctgacaaatggaaagtccaagtcctgtgcctaccacgtcacgctttacctttgcgtcacggtagtatctgtcaaatatcttcggcaaaagctccttagaaatgccctttccgttgtctgttacttcaatacgaaccacatcagccttgtttatctgcttgatacgaatgaccttattgtcccctgtgtagtttatagcgttgtttataaagttgtaaattacctgatccagctttgcaatatccgccgttatcactctgtcctcgtctgggatatacttgatatcataaccattttgctctatgagtatctgatatcgagtcatgcagtcattgagcttgtcaactatagagaaatccgtgagtttaagctccgcattgcccgactccagctttgaaagctccagcagattatttaccagacttgaaagcctgtcagcctcgtcgataatgacttggatatgctcctgcctcttcacaggattatcccccgacaagtcccttatcatttccgcataagcctttaccatagtgagcggtgttcgcaggtcgtgagatatgttcgcaataaggtctttcctaagctccgataccttttgtatctcgtccttggcattgttaagcaccgtggaaagctcctctatctcacaatagccatgaccattgaactccaccgtataatccccttcaccgaatttcttcgccgtgttcgtaatgtcaacgataggctttgaaagtcgctttgagatatacatagttacaataaaagcaagctcaaaaagtatgatagtgatataaatgagctgttctcttataatgcttacagtggaatctatcggctctattgagctttcaatgaaaagatacgcctgcttatccgaatcatcagtgtagatagacgtgcagtaaaatatctccttgctcttgaaattctcattttgagcaattttcgtgatgtagttatcgtcagactgctttagctgagatatcatcttgaaaagtccgatgccatagcccttgtttatgatcttgttaagatgcgaataagctcccatgttgttttccatcacaataggattgcccatttcgtccgttataacaatgcaaaggctgttgtcaaaagccagcgagcggttcgttacctcctgctggtcagtgccatatgcttggattatctgatttgcagcgtctgtaatatctcttatcttcgccgactgataatatctttccaagaaaaaatactgaaaaagccaaataagaataagaataaaagccgtgaagaagataaaatacatccacacatatgaccgcagacttcttttagcctttatctccgccgtcttattactgactttttccttgacttctgcaagcttactggatcttttcaaacttatatcccattcctctcagagtaacaataagattgcggtattttccaaggctgtttctcagcatttttatgtgagtgtccacagttctgtcgtcaccgtaaaaatcaaagccccatacctcttcaagaagtttctctcttgaaagcgcaatgttcatgttcttcaccagatagaaaagcaggtcatactctttcggagtcatggaaaccttctcaccgtctatctttacctcacgggctgtaaagtttatctctaatccctcgtatcttataacgtcctcagtgcgctgagaagctgacgcgcggttaagcaccgcccttatccttgccataagctcctttggcgagaacggttttactacataatcgtcaacgcctatctcaaagccgaaaagcttgtcatactcctcgccccttgcggaaagcattataacaggtatctgctttatttttcttatctccttgcaagctgaatagccgtcaagcttcggcatcataacgtccattatgatgatatcgaaatcctgatttttcaccatttccacagcctgcataccgtcctcagcctgagctacttcatatccctcaaactcggcatactctttgattatctctcttattttaatttcgtcatcgactacaagaatttttgccatagtcattccctcctattcaggcaacaccgcacaaagaacacctatttgctttgcatacaatgcttgtgtgttgctgccttaattcatattctttgcttatataataacctattattgtgtaaaatttgtgacggtttatagaatattctaagccataccgcaccaattcacaagaaaactactgcccgccaaccaaaatggtatgacgggcagagcttatataggaatttgttgtggaaatgtcaggaaatcagcaatgtcccatcataatgagagccataagacaaaaacctgttacgatacaactcattgcgcccatgatgttgtcaattttttctgctgtaagctttttcatagtgattacctccttggggtataaaataaactattctgttctcagtgcgataacagggtctttctttgccgccactcttgacgggaacagacctgcgataagcgtcaggcaaacgcttattgcaatgagtataactgccgcactgaccggtattgaagctcttatcggcacgtctgtaagatgtgcgattatcatgtttatcggtattgtgagcagataggagataattattcccaatgcacctgccacaaatcccacgataactgtttcggcattgaacactcttgatatatccctctttgaagcacctatacttctcagtattcctatctcctttgttctttccaaaactgagatataggttataatgcctatcatgatagatgatacgacaagtgaaattgcaacaaatgcgataagaacatagctgatagcgtttattatagacgtgatagaactcatcataagaccaacatagtcagtgtattctatcttgtcttcctctccaacactgtcgttgtaatcgtcgataatatctattatcttttccttagacgcaaaatccacaggatagatatttatgctgtcagggtcttcaacaactgaatagccaagagttttcatgttgttgtcatagtttgaagtggaatattttccgctgtttgcaagctgatccgcatttgtgtcggactgttctttgagcatttgcttcataagctccatttgctcgtcagaaagtgaagctatatacttcttctgagtttcggtaagcgatgacatatcaccgccctgaattgctgacatatccattgaacccatggcattcatgcccatatctgcaagctcgcctgtatcggaagcaccgctctgctccataagagccttatactgctcctcggtcattccctcaggtatctccatagagctgtcgcctgccaccaaaccagccttcttatctgtgtcggagctgtctgctgttttatcagccttactttctgtatcggctgtgctgtcggaaacggtttctgaactgctgtctgtatctgccacattctcgtccgttttgaacttcagtcctgtgaaaacatctatgtcaggatttgctatctgctcttttactatctcgctgttatctacttcgtcgataagatatgtcataaggtcatgacgatagcctatcgcaccgcttatggaagcagaggaagcgtcctcgtcaggtcgcaggataccgactacacttatttctgtgccgtttgcaacagcctttttcatgtagctctcatcgcctgtcatatcttcccacacaccgtcttttttcttatagaaatcaggtgtaggaacggccttgaatttcaggtcaagaagctcatcataggtgtaaacgtgctgttcgctgtcaacggatatgtcctctcctgccatggcacgtcttactatgccgttaagtgagcttgggtcgagaagtccgagagaataaagcacatagtcgtttatctcgttgttcttatcgactacaagcacaacttcgttatacttttcaggcaaacgtcctgcgataacgtcatactgcttgtcgataagctcctcattatctatcatttcgctccatacatcagtacccatgccacccattgagccactcatggacattgcttccatctgagttgaggacatatatcccatatcttcaagaagcgttgacggattgacctgcattacaccgctgtcgctctccgtaaaaacgttaagtgtagtggcgtatgtgtactgaacgtcgcttgtaagatctttcaggtcgctgttatcgtcaagatatttcttgaacttctccagattgttgacctttgtttcttccatgagagtgtttatcatctcgcccatggcattttgagaatagaccttgtctttatcgtgatttgctgaatcctcatggtttttcgccatggtgttcattatctcgcctatacttgcggtggtctttgttatctgaagcggatagcttgaaagtgtatcagactgcacctgatctatataaagctgaacgccgtttgagatagaaagaataagtgcgatacctattataccaatagagcctgcaaaagaggtaagaagcgttcttgccttttttgtcataagattgtttcggctcaaagacagtgcagtaaggaagctcatggaagttttaagctttttgcgctctttcttcgccgcctttttgtcagcctttgtaggctctttttcaggctttttgataggctccacaacattcttgtcaagagggtcggaatcatctatgacctttccgtcaagaagtttgattatccttgaagaatatttcattgcaagctcaggattgtgcgttaccattataataagcttgtcctttgaaatgctcttcaaaagctccattatctgcacgcttgtctcagtatcaagcgcacctgtaggctcgtctgctagcagaatgtcaggctcattcacaagcgctcttgcaatggcaactctctgcatctgaccgcctgacatctgattaggctttttgtggagctggtcgccaagacccacctgctcgagagccttgacggctctttcacgtctttctgactttgaaacacctgagagagtcaaagcaagctcaacgtttgaaagcactgtctggtggggtataaggttatagctttggaacacgaagcctatggaatggtttctgtaggaatcccagtcgcaatccttgaaatctttggtagatttgccgttaatgttaaggtcaccgctggtatatctgtcaaggccgccgataatgttcaaaagagtggttttaccgcagcctgacgggccgaggatagaaacgaactcattctcacgaaaatcaatgctaacgcctttaagggcagaaacggtggaatcaccaacgacataatctttttttatgtcctttaaactaagcatatattttctcctatttttgttattgtaaagatattataatagggttttataaactcagtttaaacataacacagttttggggtaaaaattgtcggaggggagatttaagtgaggagtgaggagtgaggaattaggaattaggaatgaggaatgagcaaagctgcccccaagcaccgagcgaagcgaaagataaagcgcacgctcaagcccggcgctagagggcttgtggggtctaggggcaaagcccctagcggagtatgaggcagagcctcattcggcgcaagccgacaaggtgcagattgtagtatcaaaaggagatagaaataggatatcagataaaagtgatatcggagtataaaatctgcaccgcatttctagccctaagcgcaatgtagatacgcaaagagcggagcgattttgcggcaagataaactatcccaaatatctgtaggggcgaacagcgttcgtccgtgttcagaatttgttataatttcagaattgtaggggcttggcgaaatttctgctttgcagaaatccgacgtcccgaccccctcgcacgtctttgtacatctgcatgactttatggtaaattcaaacctcgtcacttcgagcgggctgtcgcatttctgtgagcttgcgaacagaaatttcgccaagcccctacaagcgtgataggatagttttttgttctgtcctacaatggttgtaatcgtgaacttgtttcttcgacgggcgaacgctgttcgcccctacagatttgttgccgtaattttgtggttttgtacgatttttattcagttttcaagcttcaaacaaggtgcaggaagtgcttttctgtgcgatcagaacctctcatcgtgttcacctaactcacgttgacaaaatgtttcctcatacactgctaccttgcaggatattcaatttgggataatacccctatacttatccccgaaaagcaccccttttgttgcataaaaaatgcaacaattgcagaaatgttgccaaattaaaatataaatcatttgtttgcacaaggcaatacccctgaaattgtgcaggatcaacatgaaattttgaactaaatgtgtcttgacatcgttaatatcacgttaataaaacggtgatataataaaaaaatgcaaagtgaacggaggggtaaaaatgtttcacatacttgtggtggaggacgatactaacactcgcaaactgacctgtgatgtgcttagcgacaacggctacacacctatcgaggctcgtgacggtatagaggctctcgaaataatggacgaaaaacacgttgaccttattataatggacgttatgatgcctcgtatggacggtttggagctttgcgaaactatccgcagggctgggtttcagacgcctatattaatggtgacggctaaggaaacggcttttgacaaaaagcagggctttataaaaggtacggacgattacatggttaagcctgtggacgaggaggaaatgcttctgcgtattcaggcacttttgcgacgttcgcagatagtgagcgaccacaagataactgtgggcgacaccactctcgactatgacgcactgactatcaagacccctgagggcataagggagcttccaccgaaagagttcatgcttctttacaagcttctttcctatcccgacaagatattcacccgccgtcagcttatggacgagctttgggatatgacctcagacactgacgagcgcactgtggacgtacacataaaccgcataagagagcatttgaagaataaccacgattttgagataatgacagtgagagggcttggctacaaggcggtcaagctgaaaggataggctcatgaaaaaacatcttatctctgctcttcgctcagagcgcaggcgaaattacaccatgaacgccagcatagtttcggcggtatttatgataatgatatgggcagggcttcttacgggatttataatgataggcataaaaagatgcctgcattttctatctcctttgcaaatgccttttgttttccttattgtgggacttgtggtatctgtaataatcggcacttgcatttctgccgctgtagcaagcaagatagtaagacctgtgcgtgaggtaaaaaaggcaatgcacagggtagaaaagggagatttctctcaaaggttagaggtaacaggctttaacggcgagatagacgagcttatagaaagctacaacaaaatggcgcaggagcttggaggcatcgagatgttcagggagaattttatcaacagcttctcccacgagttcaaaacgcctatcgtttctatccagggctttgcgaaacagctaaaaaaagaaaatctgtcagaagagaaaaagcaggaatacattgacattatcatcagcgaatcaaagcgtttgaccaatctttcatcgaacattcttatgctttcaaagcttgaaaatcagcagataatcactgacaagacaagcttttcccttgacgagcagataagaaactgcatacttcttctggaaaagcaatggacagctaaggacataagctttgacattgatatgcaggagatacaatacaccaccaatgcggaaatgctttcgcaggtgtgggtgaacataataggaaacgccataaaattctccccggagggaagctctatcagagtaaagctttttaaagagggtgatgtgataacggctgagataactgaccgtggcattggcatggatcagcagaccatatcacacattttcgagcgtttttatcaatgggacagggcgcacgcttcagagggaaacggacttggtttgccccttgttaagcgtatcgtggagctgtgcaacggcaatatccgtgtagaatcacaatacggaaagggtacaaattttattgttacgctccctcagaatggataggcatataaaaaggacgggtatttcgttggaaatatccgtccttgatttttttatctcaggtcatcaatgctgtagctgttatagccctcataataatagctttggtctatgcccttcataaacagctctcggtcatttatatccgctgtgagggcgtttttaagcaggtgctttatttcgatatcacgaatggggcttcgctccatggctaggagataatcctccttgtctatcctgctccaatctaccgccatagaaagctcttttctgaacatcatatccagccatatgcgcattgatctgccattaccctctctgaatgggtgggcgatattcatttcaacatacttttcaactatgctgtcaaagtcgctttgtggcattttttcgatattttcaagagaactttcaagatacataacaggggcaaatcgaaaaccgcctttggcaatattcacagttcttatttttcctgcgaaatcatagatatcctcaaaaagatatttgtgtatctctgcgagagcctgaaaactgcctgctttctgattatccaaaatgccatattcaaacagcttaacagccttttccttgcttagcttttcttctgttctggcaagggtcgcagagtcggttataccaagtttgttttccaaagccataagctgttctcctttcggtggattttagatagccgcaaagccctgcttcagatcgtctatgatatcctcgacattttcaagacctacggaaagtcttatcattccgccgtttatgcctgcggcaacgagctgttcgtctgaaagctgtctgtgtgttgcggaggctgggtggaggatacaagtacggatatcggcaacgtgaacttcgttggaagcaagcttaaggctgtccatgaactttgccgctgtatctcttccgcccttgataacgaacgagataacgcctgctgtgccaagagggagatacttttcagcaagcttatggtacttatcgctttcaagtccaggatatgcaacggactctaccttgtcattgctttcgaggaattttgccactgtgagcgcattctcgcaatactgcttcattcttacagggagagtttcaagtcccagattgagcaggaacgaggaatttgcggcaggatagcagccgaaatctctcataagctgcattcttgcttttacgatataaggtgcaaaagaatatttctcagtgtagatagtgccgtgatagctttcgtcaggctcggtcatgcaagggaactttccgcctgtccaatcgaacttgccgctgtcaacgataacgccgccaacctgaactgcgtggccgtccatatactttgatgtagaatggataacgatatctgcgccccactcgataggtctgcaaaggtatggagtagcgaaagtattatcaacgataagaggaacaccattcttatgggcgatatttgcaaaacgctcgatatcgaaaactgtcagcgcagggtttgcgatagtttcaccgaaaacaagctttgtattatccttgaatgccgcctgtatctcatcatctgtagcgtcggggtcaacatagatacactctatgccaagtcttttcattgttatgctgaaaaggtttatggtgccgccatagatagaagtggaagctataaagctgtcccctgcctgacagatgttcaggatagagcaaagtgtggcagcctgtccgcttgatgtacacattgcggctgcaccgccctcgagagcggcaattttcttttcaactgcgtctgtggtagggttttcaaagcgtgagtagataaggctcttggtagggtcgtcaaagacctcagctatctctcttgaggagtcatagacataggttgtactttgtacgataggcactactctcggctctccgtttttaggcgtatagccctcgtgtaaacattgtgtttcgatcttcaatcaaatcaaatcctttcaatgcggtgataccgctaaatttttaccaatataaaaagcttttcaaaaagcgtttaaaacagcagtcacctcagaccgcccaaacattataaatgcgtttattctgcatagcgaaaactcatagctgaatcgaaaatatcttctcccattgaaacatactttagtggtatcaccacattatattgtatatattcgctgtcagaaaactcgtatataccctgaacgttcacactttgatcctcacccagagccgcaataacacagccacgcttgccattgccaaggtcaagtccccgataatcaagccaaacattatcatcagagctgatatcagccgactttgcatacatatctagcatatcatcgaccgtgatcttgtcaagccgctgataataagacaatgacagatttaacccgtcatatttttcgtccactttgccgtcaataagatttgcatagacaatcttcacatctctcgtgccgtcaaaatcatctgtagttatctcatgcttttccaactttgcggcagaaaatccacctatctcaggcaactctaaagcggcagaaaaatctgaaagctctatggtcagaccgttttcaacatcataacggtctgtatccaccgaccctccgttaaacatatcataaacatagctgtctatgaccatgtaaacgccacccgtggtgatattcgcagaaatgccattttcgtcaacgaaactttcaagtttcgtgaacgtgctatcctcgtcaaactgcattataactgcactggctttctgctcgtcgcttattttgtcgctaaactcaaaacgaataaccccacccccgaaatcagcgtcagtatacttgacaggtatactaaggagcggctcgtcagaatttatcattgcgtttataccataataatcagaaagctttgctcctgcaccaaaattgccctccacggtgcatttggctgtatatggtatttcgctaaggtcacaaacaagctcagggtcacgaattatttccacctgcgaactgtcatccgtctgcgaactttcctccacactgtcgggcgtatctgacaccgcttccgcagtagtagtatctttcgcttctgaaacgctgtctgcggcttcctcaacaggtccgcaggcgcaaagtgacactgacagcaatgccgccagcaatacggctgtttttctgctatttttcatattaaggttctccctatttttttattttgtttatcttacaagtccttgaagtccacccttgcccccgtaagagcactctccattactatccttgcacattctgaaagtgaaactgcgcttttgcaggtcatcatggctttttgtatgcaaagtccgaaaactatgtgaagctctcccctgcctgctgacttctgcgctataggcagaagcggttgccaaagaagctttatatagctttggacagtttcgcctgtggtacagtttcttattttgccaaagcttgcgccccctgcgtttgccgcagtgtagcggagcatttccccaacgtccgtaaaaggctcgttatatttttgaagcactcctgcggtaaaagaccacactgagtagttattgcccacaagcttttcgtcaatgatatcaccgtagaaatactttctgcccaacttatcagtgaacactgtgaaaacgtcctcttctttcacaccctctgtcatgaaaagctttctcacgtcctgctgacaggaatagcctgcaagagaacctatacagcacaaaagggattgcgggtggacatagccctcggggcttctcatggctctgagaagtctgtcgaatatttcaaaggcactgcttttatattgttcaagttccatttttatcaccgtttctcacgttttcgctcccctttttatcttttttatcacaaatcttatgatattaacatagatcaccgcaagcccaaagccaccaagcagacctgttaccagccgacgtttattggtggactttttcacccctgtatactgcaatgaccaatccagcatggtagtttcacagcagagtacggccgtgagggtggatatgtttttctttatggctatcggaaagcctataagctgtcctgcaagcacgcctgtacatcttgcgcacacaggaaactgccagccgtgaaaaaagaagcttctgtcggggcgttggtgacagcctgccgacgcaccaagcttcataagataaagccacagcgcatatgggtcttttctcgttctcatgccctgaacttatagtcgcaatcggggcatacccaataggaacgtgtttttgacttgctttccatgccgcaaagtccgcagataagccctggcagtccgaacagtatatagccgcagcagccttttccaaagccgtatttgccgcttctgtagtctgtttcgcttataagctgacagttcctgccgccacattttggacagcgtttgcctgtacaaaaatctgccatggtgttttccgcctttcttttgtgtggtgtttatcagataaaattcaggggcttgacgatctgaaaagacctatcagcccgctgaaaaatttttatcctttgatattatacgtttatttccgcaacatcgtcagacacgccgtttgcttcgacaacaggctttacgcaattttcgataaactcgtccacctgctgtgggcatctgccgataaagttttcaggcttcattatcttatccatttcttcctttgttatcatgaacatagggtcgttaaggataagctcgcagaggttattgtcaagtccctctttcttaactcttgcgcctgctaccattgaatattctcttattctttcgtgaagttcctgtctgtttccgcccttttctacagcgtccatcataatgttctcggtagccatgaaaggaagctctgccataactcttcttctgatgatcttgtcatatactaccaagccgttgtcaggatctgtaacattgagcatgatattaagtatagcgtcaacacccaggaaagcttcggcaacggaaattctcttgtttgcagagtcgtcgagagttctctcaaaccactgtgtacctgctgtgaatgcagggttgagaacgtcgcagataacgtatctggcaagtgatgttattctctcatctctcattggatttctcttatatgccatagcggaagagcctatctgatttttctcgaacggctcttcgatctccttgaatgactgcaaaattcttatgtcattagagaacttcatagcagactgagcgataccggcgagaactgagcatacctgatagtccatttttcttgaataggtctgacctgaaactggaacgacagcatcaaagcccatttcctcggctatcattttttcaagctcttttaccttatcagtatcaccgtggaaaagctccataaatgatgcctgagtgcctgtagttccctttgagccgaggagcttgaggttagcaagtctgaaatccagatcttcaagatccataagaagctcgttgcaccaaagagtagctcttttgcccactgttgtgagctgtgcaggctggaggtgagtataagcaaggcaaggcatagccttatacttatcggcaaactttgcaagctggtcgataaccttaacaagctttctctttacgaccttaagtgcatctctcatgatgataacgtctgtgttatcgcctacatagcatgaagttgcgccaaggtgaatgatacctgctgcctttggacaaacaaggccataagcataaacgtgtgacataacgtcatgacgaacaagcttttcacgctcagcggcagcggcataatctatattatcaatgttagcttcaagctcgtctacctgctcctgagtaacattaagaccgagcttcatttcagcacgggcaagggctacccacagctttctccaagtagtaaacttcttgtcagcagagaaaataaactgcatttccttgcttgcatatctggtacaaaacgggctttcataagaatttgtcattgttcttcgacctctttcgtaatattatataatgtatacacacttattatagcatattttttgcgagtttacaataggtttaaggagaaatgtttacagcggtacgtcattggataggaaagaagcttttaaaagttaaatttctgtaaattttcaagcagaaacagagctgtgcttgacttttgggggcggatatgttatgatattaaagccgcatattcacggtcataagtgtttgtatttgcagaccaccgtgcgtagcgagtttatttaaaggtaggtgcattcgtaatgtacgcagtaattgaaacaggcggaaagcagtatcaggttaagcctggtgatgaggttttcgtagagaagctggacgtaaacgctgaggacgctgttactttcgataaggtaatggtagttggcgctgacgacggtatcaaggttggcgctccatatgttgacggcgcttccgtaacagctaaggtcatcaagaacggcaagtccaagaaggtgactgtattcacttacaagccaaagaagggcgaaaagaccaagatcggtcacagacagccttacactaaggttatgatcgaagctatcaacgcataatgatctgtgctgattttttcagaaatgagcatgacagacttgtgggatttcgtataacgggtcacgcaggttatgcagattatggcgaggacgtatgctgtgcaagtgtatcgtctgctgtaatgttgacggctaacactgtcactgaggcttttaagataaaggctgatgtcgcagtggaagaaaacgaaataatattaaggcttgaaaatgacagctcagaggagggggacaagcttcttttagggcttctcactcatttatattttctagctgaggaattttcaggcaggatcaaagtcacggtcagagataactgatcggacggattacattttatggaggtgtaatttagatgattaagatttcaatgcagtttttcgctcataaaaagggaatgggttctacaaagaacggacgtgattctgagtcaaagagacttggcgtaaagagagctgacggtcagttcgtactggctggtaacatcctcgttcgtcagagaggtactcacattcacccaggcgagaacgttaagaagggttctgacgatactctgttcgcaacaagcgatggtgttgtaagatttgaaagactcggtagagaccacaagaaggtttcggtttatcccaaggcttaattttgtaacatatgaccctgagccttaggcttggggtcttttgttgattaatgacaactaaatttacgcataatatcatttataaggaggtttgatcatgtttgtcgatcaggcgaagatctatataaaagccggtgacggcggcgacggtgcagtttcattccaccgtgagaaatacgttgcggcaggcggtccggacggcggtgacggcggtaagggcggagatattgttttcgttgttgacgacaatatctcaaaccttatagatttcagatataagagaaaatatgttgccgaaaagggacagaacggcggcggcaaaaactgctcaggcaggaatgctccagaccttgtggtgaaagttcctagaggcactgttgttaaagaaataaagagcggcaggatacttgccgacctttctaccgatgagcctgctgttatcgctcacggaggcaagggtgggcgtggaaacgctcattttgccacttccacaaggcagataccgaagtttgcaaagccgggtttccgtggtgacgaatatgaggtaatgcttgaactcaagcttattgcagacgtaggacttgtgggcttcccgaacgttggtaaatccacgctcatttctgttgtttcagcggcaaagccaaagatagccaactaccacttcactaccctgacgcctgtgcttggcgttgttaagatagaagagggaaaatcttttgttatggctgatatcccaggtcttatcgagggtgcgagcgagggcgtcggtcttggtcacgaatttctcagacacgttgagaggtgcagacttatcgttcacgttatcgacgtttcaggcagtgagggcagagatcctatcgaggatttcaaggcgataaatcacgagcttgaaaacttctcaatggagcttgcggaagctccgcagatagttgccgcaaacaagagcgatatggctacccctgagcaggtagaaagactgagaaactatgttgaggatcagggacttctcttctatgagatctctgccgctaccacaaagggtacaaaagagcttatgtatggcgtatgggagcgactttctgttctgccgcctgttaagcagtttgaagctcagccgctcacgcaggaggagcttgacgataagctcatctcaaagaaagacttccgtgttactgtggaggacggcgtttatttcgtggaagcagattggcttcttgacatactcaggacggctaatatggacgactattcttccctccagtatttccagaacgtgctcaggaccagcggcataatcgacaagctggaagaaatgggtatcgaagagggcgacactgtttctatattcgactttgagtttgaatatctcagataggagggagcgtcacgggaaagctttctgatatggacgccatgcaatactcccctctggcactggcttttattggggacggcgtttacgagataagggtaagagaaaagcttatccttgaagctaatatgcctgcggacaagctgcacaagctcactgttgagagggtgtgtgcggaatatcaggcaaaggctgttcacaagtggcttgacgaggggctgcttaacgaacaggaaatggatattttcaaaaggggcagaaatgcaaagggcataaatgctccgaaacattccactgtgggggaataccgcatggcgacaggtttggaatgtcttttcggttttttatatctcacggggcgtgaggaacgtataggtgaactgttcgaggcagcatggtctgtgggcagcatcaatgaataatattacatcaaggagtgaatcaaatgtcaggtcattcaaaatgggaaaacattaaaagaaaaaagggtgcaacagacgctgcaagagctaagatatttacaaagataggcagagagatcgctgttgtagttaagcagggcggtgctgatcctgcaggtaacgcaaagctgagagatcttatcgcaaaggctaagtcaaacaacgtgcctaacgataatatcgatagaattatcaaaaaggcagcaggcgacggcgacaagaacagctacgagtcaatggtatacgagggctacggtccaagcggtgttgctgttatcgttgagtgccttacagacaacaagaacagaacagcaggcgatatccgtcacttcttcgacaagttcggcggaaacatgggtacatcaggctgtgtatctttcatgttctctgatgttggtactgttgttatggagaacaacggtgctgacgaggacaagataatggaggactgctttgaggcaggcgctgacgatttcaacgttgatgacgatgttatcgagatatcatgcgaccctaatcaagtttcttctgtaagagaagctcttgagggaatgggttacaaggtactttctgctgaggctgagaaagttccttcaaactacacaactatcgaagacgaggacgctatcaagaagatgggtctgcttcttgagcatcttgaggacgatgacgacgttcagaacgtttaccacaactgggagaatatgccggttgaagaggaagaataatcaggaaaatttctgacactttactattgacatttacatataatgtggtataatagaattagaaggatttattcttttaataggggttgcgaatccgtctaaaatcgctttaatagaggtcacagagcctttaaaaatactgttttaataggggttgcgaatccgtctaaaatcgctttaataggtatttaaaggggctgtaaaaaaagtccccaagaaaaaaggctgcgatcttgccaaaaagcaagacagcagtctttttttgtggtatttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgccttttcgcaggagacatcttttttgtctccacattatggcgttcccgaggtgattcgaacacccgacctaccgcttaggaggcggtcgctctatccagctgagctacggaaacacattacaatcgttattatatcacagttttgcaattttgtcaaatgtttatttgacaaaaaaagttggctcgccatagcaacaagtatcgacgcacttgcagtcggaataacgttcgctttcctgaatatctttcttgagggagttggcatactcaaatagcataaaaacaagggcggaagttttcaaactatccgccctctggttatgtctgttagtcccgccgactatgatgtttacgcttttgcgtgtacatctcacgatctgacgctttcataagatcgtcgatctctttcaacgttttcggctttcccgccttgtagccacagcttatcgacacatcatatggcgacttgcttctgcgattgtactctgcaatgctgcgggataccttttcgtaaaagctgtccgcaccgtctgtttcagcgataacagctacaaattcatcaccgccgaagcgtgagcatatcccaccttctgcagtgcattttgtcatcagcgacgccactgcctttatcgccttgtcaccctcgttgtgaccatagaggtcatttatctttttaaggttgtccatgtcaatagagaatacccatacgcctacgccctgtttctcagcctttgaaataagcttttttacgttcttgtaaaagcccctgcggttatatatccccgtcatggggtcaagcatatgtatccttgcaagctccgcatttgccctttcaagccgctggcggtttttaaagctctccattatctgattggtgttgtttataaaacgtcttgtgttctggaaaagaaaatatataggactaaatgaatttgccgcatagcctatgacctcgtcctgaaaatgaagcggcgagaacattaagcagttatggcgtccaaggacttgctccatatcaggcaaaagatccttggtgtcaaaaacttcaccggtcttgtatttgttgtcaaaagtctgcatgaaaactctcatctgctttgtaaagctgttattaaagcgttctctctgcctcgtgtttgacagaaaatcagagtttgtgcatacccagctataataatctcccgaacgtgccattacctttgccatttcttctacggtgtgacattccactgattttgcaagataagagaacatatgctgttcgtgaccatcagaattgttcattctgtggtaaagctcaaggatcttgtcgcctacttctctcgggtctattttcttacaaccgcatgactgggatatcctcatggtgtagctgacctctattttttcaggaagaggcactccgttcatcatatggtctatggcgtttattatcttttcgccaagcacatcattgtctacagccgccgttgtaagacgagggctgttatactgttcaagttcgatgccgtcaaagcccgttacaataacgtcttcaggcacttttatgccgcgttctctcagtatgctgcaagctgctatcgccatagcgtcgtttgcacatattatcgcctgcggaaattccaaactgctttctaaaaatttctccaatactccttttgttggcatatcccagaagtcaccatagccaagacgctcaggctcaaattctatgccgttttccgcaagcacctttttgtatgcttctatacgctcttctgagaaagcattgccctttacgccagcaatgaaattaactcttctgcagccgtgaaattcgatcacatggcgaactatcttttcaaaaacgtcagagtaattgaatgtcacactgcagcaattatccattgtactgtcaacgcatatgacaggaacaccgtgttcatgggcacgcttgcttatctcgttggaaatgctgtctctttttattgcctcgggcattattataagtacgtcaagaatgtcataatttataagatcaaaaatgcttgcttcaccatggttgtaggaaatgttgtgataaaggtcgcaaaaggtgttaaaaagaagcaccttgtagccctcttttacaccctttcggcttatggaagatactatatctctcacatagtcagattgtacgcatgaagtgcagatacctattattttatatttcgctgtatcgcttgtaaacatagcttgctccttcgtcagggtcccgacgacccaccactatctatataaaataattgctttttgctttgatatgtgattgctattagaaaatattcacatatcgttaattttaccatatccgcactctaatgtcaatagaaaactcacaaaattcacaaaaatcttctttttgaaagcatttattctgttgcaaaaaacaaagaccgactttcagcttttttcgctggaagtcggtctttgtttatcgtaaaacatatcgagcaaggggcgaccagaggtcacccctacacaaaatagcgtattttatgggcttttttttattcagctacccactgttttaaagccgcagaaagtcgtctgtcgatatcctttcttgtctgctcgcactccttaggatagtcctttgcagccttgaaaataaatttcattacgaatttaagtcccacaggaagtgcttttctgagcattgtctcaggaagcacaaagtgcgttccatgctcgtaagtcagggcttcgtaatcgcactcgtgagggcgttctttcaagcgcttatccatacggcggacgtattttcctgcctcccagaagctgtcgtcatcagcacccaccattataagcttgcccttgatgttctcaacctttatcatttcttcctctgtatgttctcttgccttttcagagtcgataaaaaggtgcgtgcttcgtgttatatctcccgagcctttggtttcttcttctattttgtgatagtattcagggtgggcataaacgaacggcatataggcaagcggcttgccctgccatgaaagtgtggaagcgtcagggataggccattccttgcagccgtctttttcgccctgctcaaagccctgccatacaaagtcgcttggcgtaagaccgaaagtgagtgttatgtcagggaaatatgaagctgccacaagggaatccattcctgccgtactcattcccattatgcctattttcttgtttccatggcttttgagccactttatagcggtctttatcctttcaagcgggaagttcacatggctgtagttcttcacgtcaggtgacatacacataacgttcacgccatttttgtgaagccattttgctccgcactttgccataaagtcattaggatcgtcgccgaacagacctatcattgcgcagtttgcatcctttgggttttcataatatgtaccataaaaaccgtctttctcattgctaaaaaattgtttcttcataataccgacctttctaagctggttttctttataaagttaggttaagctaactatatctcaaaaaaaacagggtagattacttcgccctaagctatattatatcacacttttgattatttgtcaggtgtattaacgaaaaaagccagacgtattgtaaatttttgattttcttagtgttgcttatatattaataaaatggcggagaacgcattctttttgcagttctccgctacttttatgccttattttttgccgcatctgctgtgacagtgtgagcaacagccacagcatttaccttttttcttttgctttgatatacttattgccgccgccactgcccataaaagcagaagtatcaccactatccagtcggctgtattcataataatgctcctatctgatataccgcacagccgcaaagccatgccaccatgcactgcattatcacaacgcctactgtctgtatccttgaatcaagctctctctttatggtcgccaccgccgcaacacatggggtgtaaagcagggtgaatacgagaaagctcagtgcggaaagggtggagaatgctcccgaaagagcagtgccaagatttgcagtgcttgtgttcatcagtaccgccattgtgcttactaccgcctcttttgcagtgaagcctgatataagcgaggtggtcactctccaatctgcaaagcccaaaggcttgaatattggcgatatagcctgaccgataagagctagcaggctgtcggaggagtcttttacaacgttgagctttgcgtcaaaggtctccaaaaaccatattatgatagtcgcaaagaatataactgtgaaagctctttgtataaagtcctttgccttgtcccaaagaagaagtcctacgctttttgccgaaggaagacgatagtttggaagctccattacaaacggcacaggcttgccacggaaagctgtatttttcagtatcagcgcaattattatcccaagcactatgcccgttatgtataagcctatcatcacaagcgcctgatatttcttgaaaaatgctgcacagaaaactgcgtaaataggtatctttgccgaacagctcatgtaaggggtaagaagtatggtcatttttctgtcacggtctgatacaagcgttctcgtcgccattatagcaggcactgaacagccgaagcctatgagcataggcacaaagcttcgtcccgaaagaccgatctttctaagaagcttgtccattacgaatgccactcgtgccatgtagcccgtgtcctccagtatggaaaggaaaaagaacagcgtcactattataggcagaaagcttagaacgcttccaacgcctgcaaaaactccgtctattataaggctgtgtacaacagggtttatgccgtaggctgtaagccctttgtctgctaggtcggtgagcttgtctataccaagggaaagccaatcggaaagggtcgagccgataacattgaatgtgaggaaaaatacaagaaacattatcccgaaaaatacaggaagtgcagtgtattttcccgttaaaatgcggtctatttttacgctccgcttgtgttctcggctctcgtggcatttcacaacgcttatggcaacgactttttcgataaagtcgtatcgcatatctgcaagcgccgcatttctgtcaagctttgattcgtcctccatttctactatgcagtgttcgagaagctccagctcgttttgattaagctcaagctgatcctcgatattcttgtcaccctcaataagctttgaagcacaaaatctcggcggtatgcctgcacggtttgcgtgatccatgataagatgcacaactgcgtgtatacatctgtgcacagcggaatcgtctgagcaaaagtctgtgacaacaggctttgtcttgtttcgggcggtttctacagccttgtcgataaggtctgagataccctcgccctttgccgcacttactggtataacaggtatgccaagtgcgtcgctcatcatttttacgtctatcgttccaccgttggctcttacctcgtccatcatgtttaaggcaagcaccattggcacacgcagttcaagaagctgtaaagtgagatacagatttcgctctatattggtggcgtcaacaatgtttataatgccgtcaggcttttcatttattatgtagtcacgggtgacgatctcctcctgcgtgtaagggcgcagtgagtatattcccggcagatccaccacagtgcagtttttctgcccctttatgtcaccgaccttctgctcgactgttacaccgggaaagtttccaacgtgctgattagaccctgtaagggcgttaaaaagcgtggtctttccgcagttctgatttcctgcaagggcaaatctcatatatggtcattctcctctgttttttctatctctatgttttttgcgtcctctatcctgagcgtcagctcgtagcctctcagcactatatcaagagggtcgcccattggcgcacgctttagcattttcacctttgttttgggtataagtcccatgtcgagaaaacgcagcctaagcgcaccctcgccacctaccgcttttatcacggcagactcacccgttttaagcttatcaagagtcattgtcttttcctccacagctatattttattcttatgttctatctaaaagaacttcacaaaataagtttaccatggctaactttacttgtcaatagtatatgtcgtatattttagtcaaatgttatctaaaaattttattcaaatagataacttccaattgacaacgccaacaaatcgtgctatcataaagtaagataaagtacacttttacattacgggggtgttttatggatacccgtgtggcaatacttgcaataatcgcacacgataacggctctgcgcaggagataaacgcaattcttcatgagcatgccgagtatataataggacgaatgggtctgccataccgagaacgtggcatgaacataataagtgtagcagttgacgctccgcaggacgttataaattctcttgcaggcaagataggcaggcttgagggagtgaccgccaagaccctttattcgccacagtaaaaatctaataaatatttgtgaccctgacgccgaaaacgagttttctcctttaaggcgaaagaatacacatcaagcagaaaaagtaaaaaagcagatagaaagccctatctctactcatgtaggggcgaacagcgttcgcccgtggattaggttttttatgagcaagcatagccttttttgttatcaaagctgtatcctcaggggtatggcttattttttttgagaggagcttttgcaatgggacttaatgacgcaccaagcggagaacgtatacatataggatttttcggcagacgaaacgcaggaaaatcaagcgttgtgaatgcagtaacaaatcaggatcttgcagtggtatccgatacgaaaggcactaccaccgaccctgttacaaaggcaatggagcttttgccccttggccctgttgtgataatagatacccccggctttgacgacgagggcgagcttggagagcttcgtgtgaagaaaactaagcagattctaaacagaacggactgcgcagttcttgtaacagactgcaccttgccccttggcgactgcgaaaaacagcttatctcaatattcaaagagaaaaacataccctttatcatagccaaaaacaaagccgacctgctcactgatatcccaaaagaggagggcgcagtgtacgtcagcgcaaaagaaaaaacaggcatagaggagcttaaaaacgccgttgcaaagctcactgaaacagacaccatgacaatgaagcttgtgggcgaccttataaagcctgacgatatggtggtgcttgtcacccctatcgacagcgccgcaccaaagggcaggcttatcctgccacaacagcaggccataagagatgttcttgaagcaaacgcctgtgcagtggtggtaagagaaactgagctttcaggagtgcttggcaggatagagaagcctgcacttgttataacggatagtcaggctttcgcaagagtttcaaaggatactcccgaggatatccctctcacctcgttttctatccttatggctagatataagggctttcttgacgccgctgtaaagggcgtgaaagctatcgacgatcttaaaaacggtgacaaggtgcttatttcagagggctgtacacatcacagacagtgcggtgatataggctctgtgaagcttccgaactggctgaaagaatacacaggcaaggaacttgatataacattgtcatcaggtcacggctttccagaggagctttcagactttgcactttgcatacactgtggcggctgtatgctaggctcaaaagagcttacctacagaatgaaatgtgcttgtgacgcaggcgtgccgttcacaaattacggcattgccattgcctatatgaaaggcatactgaaaaggagcatagaagtgtttccgcatcttgtaaaggagcttgaagatcacaatggcggtcagagaacttattgataaactaaactgcgagaaaaagctttcccatgatgaatgggtgaagcttataaaagaatatgacgagggcgacagagcctatgccgcagagcttgcaaggggcatttcgcaggaaatgttcggcaaggatatctacataaggggcatagtggagttttcaaacatctgcaaaaacgattgcctttactgtggaataaggcgttcaaacggcaacgtgagcagatacaggctcaccgctgaggagatcttgcagtgctgtgacgagggctacggctatggtttccgtacctttgtgcttcaaagcggtgaggacgctttctatgacagggaaatgctctgcggtatcgtcagagagataaaaaagcgtcaccctgactgtgcggtgacattatccataggtgagaaaagccgtgaggactatgaagcctttttcaatgcaggtgtagaccggtatcttctcaggcacgaaactgccgacgaggagcattacaaaaagctccacccagccgaaatgtcttggaaaaaccgaatggagtgtctttcagatcttaaagagataggctatcagacaggctgtggaatgatgataggctcgccgtatcagacggtggagtgccttgctgaggatatggagtttatgtgcgatttcaagcccgaaatgataggcattggaccttttctcccacataaggacacgcctttcagaagctgtccacaaggctcatttgagcttactctctttctgctgagcatttgcaggataatgctccccgacgttcttttgcctgccaccacagctcttggtactataaaccccaaagggagagaacaaggggtgctgtcaggtgcgaacgttataatgccgaatttgtcccctgtggcagtgagaaaaaaatatatgctctatgacaacaagatatgcacaggtgacgagtctgcacagtgcagggcttgccttgaaagacgaatggagtccataggctataaaataaagatatcaagaggagatcacagataatgataaagcttgctttttacggaaaaggcggaataggaaaatccactgcggcatcaaacgtcagtgttgcacttgcacaaaaagggctgaaagtcatgcagataggctgtgaccctaaggctgactccaccatatttctccatgggggagagaggatacccaccgttcttgaccttgtacgaaaaggcgaaagctttgaccttgaagatatggcaagggtaggctataacggtgttgtgtgcgttgaagcaggcggtccggtcccggggcttggctgtgcaggcagaggtataatcgccgcacttgaagagcttgaaaaaaagggtgcatacgaaaaatatcagcctgacgttgttatctatgacgttctcggagacgtggtgtgcggaggtttttcaatgccaatgcgaaagggctatgccgataaggtgtttatcatcacatcaggcgagagtatgtctgtatatgccgccgcaaacatcgcaatggcggtggaaaatttcaaaagccgtggatatgcttcacttggcggttttatcctaaataaacgcaacgtaaaaaacgaggaggaaaaagcggcagagcttgcggctgattttcacagctctgtgatagccgagatagaccgaagcgaccttgtgagcgaagctgaggatatgcgcaaaactgtcatggaagcttttcctgacagcactgcggcagagcagtatagagcattggcggataagatagccgagctttgcggtatgggagaagaaaaatgataaaagagagcggcataaatataacgaaggcggcttttcctgtgccttttgaaagcggtcttgaatataatccccccacaaggggcgtgtggaatatcgtccataccggtatgcttatccctgagtcgcggcagatatttgtctgtgcacagggctgtttaaggggcgttatcctcactgcggcagagatgaatgccatggacagaatgtcatgggtgactgtttctgagcaggatctgtatgacggcacaatggagcaggacgttatagacggagtgagggatataataaacaggcttgaggaaaagccaaaatgcgttttgatttttctaagctgtgttcacctttttgcaggctgtgacttcaaaatgataatagacgagctttcgacattgtttccacaggtgcattttatagattgctacatgacgcccaccatgagaaagtctatctcccccgacagccttatgagaaaacagctttacgagccacttgaaaagtgcgaaaagaagcctaaaacggcggcaataataggctgtgacagagccacggacgaagcctccgagcttgtaaaaataataaactcagcaggctttgagcttcttgacataacaaagtgcaagacctatgaggagtatctctccatggcggaaagctctttgaatatcacctatctccccacggcaaagccgtcaggagaggaacttgaaaagcgacttggcacaaagcatttgtatctgcccttgtgctatggctatgatgagatagagaaaaattacagcagactttgcacccagcttggtgtgaaaacgcctgacttttctgctgacagagaagccgccgacaaggctcttgcaaatgcccttgaggtagtaggggatttgcctatagccgtggattataccgctctgccaaggccccttggcttttgcagacttcttgcagagaaaggcttcaatgtgaagcgttgttatgccgacagcttttcagaggaggaaagggcagactttgagtggctgaaagcccattgccacgaccttgaaattctccctactgtgaatgtgaaaatggagttttcacagtgcgaagaaaaatatcttgcagtaggtcagaaagcggcttttttctgccagacagataactttgttgatatagtcgcagggggcgggggatacggcttcgagggcataaaaaggcttgcagagcttatggctgagggagcagtaaacaaaaaggacagacgtaaggtgatacaacacaagggctgggggtgtgaaagctgtctatgaatgcaaaagtgatatccatatatgcggcggatacttcgggagtatgctcggcgctttatgagcttggtggaatgaccgtcgtccatgacgcttcgggctgtaactccacctacgccacccatgacgagccacgctggtatgaccgcaaaagcatgatatatatttctgcactaacagaagcggacgccgttatgggcaatgacggcaagttcattcgtgatgtggcaaaagcggcaggtgagctttcacccaaattcatagccatttgcggttcgccaatgcctgcaatgacaggctttgactatagtgcggcggctgaggagatagagcgtcaaacgggtctgaccacatttttcgttgataccaacggcacacattcttatctccatggagcagagggggctttccttaatattgcaaagcttttctgccgtgagggaaaagaaaagcaggcaaattcagtgaatattattggtgcaacgcctcttgacttttcggtgaatacaagcgtaagctccataaaaaagtggcttttggataacggcttttcagtgcaaagctgttttgctatggacagcagccttgatgagatctctgccgcaccacaggcggctgtaagccttgttatatcctcagacgggatagctgcggcaaagtatctttttgatacctatggagtgccatatgttgtgggcgtgcctgtgggaaaaagcttttccaaaaagctttccgctgacctgaaaagagcagtgtcagagggcgtttgtataaattcctgcggtgaaaaagctgtagagaatgctcatatgatagttgcaggggaaagcgtttttgcttcttcccttggggctgaacttggcgcaaaaactgtggcgacagttggcataagaaacagcgaggtgctgtcagggacggacattttctgcgaggaagaagcagagcttgaaaagcttttttcacagcataagaccgtcatagcagacccgcttttcagacctatatgcaaaggggcaagatttatttcactgccacacgttgctttttcgggaagatgttttcttaaagatatccccgatctgatagataaagatgtaagcaaaatacttaacctataaaaaggaggaacgtgctttcgcacggatacttttatgataaaaatagccgtttacggaaagggcggaataggaaaatccacagttacgggaaaccttgccgccgcatttgcaagtcttgggaaaagagttatacaaataggctgtgacccaaaggctgactccaccataaatcttcttgggggcgagcctgttatgcctgtgatgaattatctcagagagcatgacgatgagcctgagagcatagaggagatatcaaaagagggctatggcggagtgctttgtatagaaacaggcggtcctaccccaggacttggctgtgcaggcagaggtataatcaccacgttcagcctgcttgaagacttaaagctttttgaaaaatataagcctgacgttgtgctttatgacgttctcggagacgttgtgtgcggaggtttcgccgcacctatcagagagggctatgcttcaaaggtgcttatcgtcacctcaggcgagaaaatggcattgtatgccgcaaataatataaacagtgcggtgaaaaactttgccgacagaagctatgcaaaagtccgtggtatcgtcatgaacaggcgaaacgttgagggcgaggaagaaaaggtcagagcctttgcagaaagcgcaggacttgatatcgttgcggatataccaagaagcgacgatatcatcagatgtgaggataagggcatgaccgtcatagagggcgagcctgattgtcaggcggcaaaatgctttttgaagcttgcccagacccttatgcaggaggacaacgatgactaaagcgttttacataacggcggcggagcttgcccaaaagggaaaagataatatccctgacgagcttctttcggcaaagcaccttatctacagctcccctgcaacattggcgttcaattcaccgggagcgcagggctttggtgtaaaaagagcaggacttgcagtgccaaattcggttatgcttcttgtggctcctgcctgctgtggacgaaacaccactatgctcagtgcggaaagcggctacggcgacagatttttctacctgcttcttgacgataccgatatcgtcacaggcaggcaccttacaaagataccgaaagccgtggaggaggtatgtcaaagccttgattacactccctcggcggtgatgatatgtataacctgcgttgacgctctcctcggcactgatatggacagagtgtgcagaaaatccagcgaccgagcaggcgtgcctgttgtgccatgctatatgtatgccctcacaagggaaaagcgtctgccccctatggcttcagtgcgaaaatcggtgtattcccttttgaaaccacgcaagagaaagtctgacgaggtgaatatcctcggttatttctcacccttgcaggatgactgcgagctttacagcctgctgaaaagtgcaggcgtaaagaccataagagagctttcaaggtgtgataccttcgaggaatatgaaaaaatgtcgcaggcaaatttttctcttgtactcaatgcggaagcaagatatgccgcccagcaaatggagcaggagcttaacataccttttatagagcttgcgagagtttttcaggctgacaagatatctacgcagtatcgtctgttgggtcaggctataggagcggagctttgcgataaagagtattatgagcagaccatggctcttatagatgatttcagagaaaagcataaagggctgtgctttgcagtgggcgagttttcaaactgcgaccctatagaaatggcattggctcttataagatacggcttcaaggtggcggagatattcggcactgtgggggagcgaaatttcggctttgtgaaaaagatagcacagctttcccctgaaacgaagatatattcaaacctctcccctacaatgctcttttatgagcctgacgagagggtgaacgtttatatcggcaaggactgtgcctattatcaccctgacatagcaggagcggactttaatgacgagatacagccttttggctatgcaggagtgaaaaagctgttttgcgaccttgaaaaggcacttgacaggaaaggagcggaggataaatgaaaaatcttttgaagcttttgtcaccctttgcccctgaccaatcaggtgcgtcggcagtgctttacgagcttggaggactaatggtaatatgcgacgcaggcggctgtgcaggcaacgtctgtggctttgacgagccaaggtggtttaccaaaaagagcgcagttttcagcgcagggcttcgtgatatggacgcaattttaggacgtgacgacaggctcatcgaaaagctctccaaagcctgcgggcagataagaccagctttcaccgccataataggcacgcctgtgcctgctgtcatcgcaacagatatgagagcgttgaaacgaatggcagagaagaaaacaggacttccttgcataacagccgagtgtacaggcacgaactattatgacagtggctcagagccggtgtggatagagcttttcaagacctttgccactgagagcaagcctgttcagaaaggcaggcttggcattataggtgcaacgcctttggagcttagtatcataagccccgagaagatagtggcggaatataaggcaaagggttgggagaatgttatatgctacggcatgggaagtacccttgatgatgtgaaaaatgcggctgcgacggagaaaaatatagtatgctcatcagccgcaataaaggcggctgagtatctcaaagaaaagttcggcacgccttatgagatagaatatccacgaagctgtctgcctgaggagatagtgcaaaaagcttataactttacggataaaaacgtccttgtgatacataaccaaacagcggctgactctgtgagaaagcttatcacagaaaaaagcggcaagtgtcattgcacatcggcaacgttttttatgcagaaaaaggagctttcacagcagagtgattttttccttgcagacgaaagcgacctttgcgacaatgttggtgataactatgacgttgttatcgcagacaagaccctcagacgtgttatgaaaaatttcagcggcgagtttatagactttccgcatttcggactttcaggcagacttttgcagggagagagtgaaaagatatgacagaagaaattatagagcgtcttgaagaatatctcggctcagaggagtttgaatatgaagccgaaaactgcatggaggagcttgacgaaagcggtgagggcataaacgcagttttgcctttgcttaggtttctcgaaagacaccccatggctgatatcagcatgacaagtgccgtggtgagatatatggagcagttttacggcagaggttatgagaacattctcatggactccgttcgtcgcagacctacagtgcatactgtgagaatgttgggcagactcagaaatgccgccatagatgagggtcaggacggtgaagagtttgaggacgtgcttatagacgttctcagcagtgaagcagaggatgagataaaggataccgtcagggagcttatctgatgaaaactgagatgattcgtgtttatggtatcgttcagggcgtgggcttccgaccttttgttagccgtgaagcgtcagaccttggactttgcggcactgtggcaaacaaaggctcttatgttgagatacacgcacagggcagtgaaaaggctgtggaggacttgaaaaaagcccttgaaagccgtccccctgagcgttcggtgataatggagataatttcagcccatgccgacgaaccgccttttgacagctttgagataatcgacagcgaaaaggaaaaaggggatattttcgtatcccctgacatcgctgtgtgcgaaaaatgcaaggcggagctttttgataaaacaaacagaagatatctccacccttttataaactgtactcagtgcggtccaaggctcactattatggactctatgccctatgacagagttcgcaccacaatggctgactttccaatgtgcaaagactgcgaggaggagtacaccgaccctgccacaaggcgttatgacgcccagcctgtgtgctgtaacaaatgcggtccggaggtctatatcataggcagtgaaaagaaaggcgctgaggctatcacagccacaagagaagctgtcatggcagggaagataatcgctgtcaaaggcataggcggttttcacctttgctgtgacgcaaaaaacgagggggcggtgaaaagactcagagagcttaaaaaccgccctgcaaaaccacttgccgttatgctgaaggatatttctgccgcaaggcgtgagtgcgattttggcgaagtgcaggaaaagtttctcgcaggctggcaaaagcctatcgtgcttcttgataaaaaaaccagcggaagcctttgcgaaagcgttgcacccgataatcctacagtgggagtaatgctcccctatgcccctttgcacctgcttctttttgattacgatgacggcgtggaaatgaccgacagccttgttatgaccagcggaaacgtccgtggagcacctatttgtcgaaacgacgaggacgcactcagcgaaatagcaggcttctgcgacctgatattatcccacaacaggcgtatcttgatacgctcagacgatactgtcatggatacatttgagggcaagccttacataataaggcgttcaagaggatatgcaccattgcctattatgacttcctgcggtgataaaggtcagacccttgccataggcggtgagcttaaaaatacgttctgtatcagaaagggaagcctttattatctctcttcctatgtgggggatatggctgatatccgcaccgtaaaggcgcttgaggagtccgtgaagcgtatgtgcgaacttctggaagcaacaccgcaaaacgtagtctgcgatatgcaccccaaatacaatacagttgcatttgccgaggggcttgacctgcctctgaaaaaagtccagcaccactatgctcatatcctttcctgcatggcagaaaacgactgtagtgaaaaggtcataggcgtatcatatgacggcacaggctttggcacagacggcaccatatggggaggagagatacttctctgcgaccgcacaggctttgagcgtatgggaagcataaagcccttcatgcaggtgggcggcgacctttcctctaaagagggctggcgtattgccgcaatgataacaggctcagcctatggggaaaggggcggagagatctgtgaaaagcttggtatttgtacagcgaaagagtacaagcttctgtccgtaatggcagagaaaaaagtaaacgcagtaagctccacaagcgcaggacggctttttgacgccgcttctgcggtgcttggcataaggcgtttttccacctttgagggcgaagcttccatggcgttgcagtttgcggcagaaaaattcagccgtgagccgtttggtatttacgagcctatggaaaagctcactgccgaaaaagagggcaggataatgctctgcactcaggctcttatcaagcgtctttgccagggtatgcaaaatggtgaggataaaaaccgccttgcctatgagttccactcacttcttgcggacatgactgcacaggcgtgcaggaccataagtgagagaacaggcataaaggtctgtgccctgagcggcggagtttttcagaacaagcttctgcttaaaatggtgaagtgccgccttgaaaaaatggggcttagagtgcttatccacagccttgtgccagccaatgacggtggtatagctttgggacaagcgttttatctgaatgaggaatgaggaatgaggagtgaggaattaaggtatcgcctgcggcgatgattttcttattctgtaggggcgacctttggtcgcctgagactgttgaaaaataccaaaataacaggcgaacgctgttcgcccctacatataaacagcgtatttacgccaattgtaggggacggcgccctcgacgtcccgcttttgtcgaactttttcaataagctggggcgaccttgggtcgcctgtgtatctcatttctgattttgttatatagatttaattttttggaggtattgatatgtgtgtaggtttatctgcaaaggtagtaagtgtaaacgagggcactgctgttattgacgcaagtggtgcaaaaagagaggtatctgctgaccttatcgacgatctcgaggtaggggattatgttatggtacacgcaggggtggctatcgcaaagataacctctgacgatagcgaagaaactgacgagataatggagagtatccaatgaacactatagaaaatgcaaaggagataataagctcctacaaacgtgatgacggcaaaaagcttcgcataatggaggtctgcggtactcacacccacgagattttcaggcttggcataagaaagctccttcctgagagcgttgagcttatctcaggtcctggctgtcctgtgtgcgttacccccattggttttatcgacgaggcttgtatgctcgcccttgaaaaaggtgcggtgatatgcactttcggcgaccttataagagtacccggtacagaaatgagtcttgcaggagcaaggtcaaagggtgctgtgataaagacagtctattcgccccttgacgcagtttcatatgccgaaagtcacccagacgagcaggtggtatttctcgccgttggctttgaaactaccaccccatcagcctgccttgcagtagaaaaagcgaaaaagctggggcttgaaaacttctctattcttggtgcaaacaagaccatgccaaacgcttataaggctttggagggaagcgcagacgcatttttgtaccccggtcacgtcaacgctatcacaggcacagccgtgtgcgaggagcttgtgaaaaagggcgtttcaggcgttgttacgggcttcacggctgctgaacttcttacggctcttgctgttaccatagagctttctcagcgtggcgagccgtttttcagaaactgctatcctagagtagtaaagcccgagggcaacccagccgccataaagcttatggaaaaggtcatgacaccctgtgacagcgagtggcgtggacttggtatcataccaatgtcaggcatgatactccgtgacgaatatgctgactttgacgcacgaaagaaattctccctgccgaaaataacaggcaagccaaacccagtctgccgctgcggagatgttttgcagggcaagtgcaagccctcagactgtaaagttttcggcaaggtctgcacaccgctacaccctataggtgcgtgcatggtgtcaaacgagggcgcttgctcggcatattatcagtatggcaatttgtaaaataaactatccgaaaagaggaataattatgacagataaatttgtgacccttgcccacggcgcaggaggaaagcagacttccgagcttatcgaccgtgtttttaaggagcatttcgctaaccctgacctgaccgccgacgatgccgccgtgctttccatggaaaagggcaagatagcattcaccaccgacggctttatagtttccccatacgaatttgcaggaggaaatattggcaagctaagtatttgcggcactgtgaacgacctttcctgcatgggtgcaaagcctttgtatctctcctgtgctttcgttatcgaagagggctttccaatggataagcttgaggagatagccgccgccatggcaaagaccgccaaggaagcaggtgtcgagatatgtgcaggtgacacaaaggtggcaggaaaaggtcaggtagacggcgttttcattaccaccaccggtatcggcaggataatggacaatgccaacacctcaggaaagcttgccaaagcaggcgacgccgttatagtgtcaggtgatatcggcagacacggctgtaccatacttttagctcgtgacgagttcggcatagaggcagacgtaacaagcgattgtgcacccctctgggcaaacgtaaaagccatgttcgacgttacaaacgatatccacgttatccgtgacgcaacaagaggcggtgtaggcactgttctttacgagatagcaggtcaaagcggtgtgggaataacccttgatgctgagaaaataccggtggcagacgaggtgaaaggcgtgtgcggtatgctgggcttagaaccattgtatcttgcctgcgagggcagacttgttatattcgcaccaaaggacaaagcggaggatattgtttctgcccttagaaagtgcaaaaactcagagaacgccgctgtcataggcgaggtcacagaggataacgcaggcagagtggtaatgaaaacagagataggctcacagacccttctcccacagccgggcggagagcttctccctagaatttgctgatatcaaataatgtatgggagcagcgcaatttctgctttgcagaaatacgacgtcccgtttagcgttcgcctggtttccataaatttttgcactgttacatcgtaggggcgaacagcgttcgcccgcctgattttctcgcaaacttatgttgaaagccgcatttgggaatattgagccaaaaattgcgtggatatcatgagtttgtcaggcaaacaaaacgggcgaacactgttcgcccctacatatatggaatataaaaaacggaactgttcagcttgatttgaacagttccgcttttttatctgtaagactctatcgcctcaatagtctttgctatatcctcgttattgtgagcataggaaacgaacatcgcctcgaattgcgacggtgcagtgtaaatgccgctttgaagcatatggcggtagtatctgccgtagctttccgtgttgcaagcccttgcctcatcatagcttttcactctctcgtcattgaaaaataccgtcataagcgaaccacagcgattcacgttcagacccttttcccttatggcattctctatcatagacgactttctgtcaagctcctcatagaagtttggtatgctttctatctgcctgatagtttctattcctgccgccactgcgcatgggtttcccgacagcgtgcctgcctgataaacagagcctagcggtgcaacgcactgcattatctcaagctttcccccatagcaggcaaggggcattcctccgcccactatcttgcccaaagttgtcatgtcaggggtaactccgaaatattttgaagctcctccctctgaaagcctgaagcctgttatcacttcgtcaaatataagcacagtgccgtgctttttcgttatctctctgagaaattcaagaaaacccttctcaggcggaacaacgcccatgtttgcggcgcatggttcaacgataagtgcggctatctcgctgccgtattcctcaaaaagcttctccacagactcggtgtcattgtattttgcaagaagcgtgtcctttgtgcagccctctgtcactcctgcacccgatgggatagcctgcgtcataagtcccgagcctgcctttacaagcaatccgtccgagtgaccatgataacagccctcgaattttattatcttgtccctgcctgtgaaacctcttgcggctcttattgcgctcatgacagcttccgtgcctgagtttacgagcctgagcatttccatagacggaaagtgcttttttataagctcagccaaggttatctcgcccttgtggcaagcaccgaaggtaagccccttgtcgcaggcggctttcacagcatttatcacaggctcacagcagtgaccgagaatgttcggtccccatgagcatacatagtcgatgaactcgtttccgtcctcgtcccatatccttgaccctttcgcatggtcgataaaaagcggaacggtgcccaccgccttgcaggctctaacagggctgttcactccacccggcataaaaccgcaggcagttttgtaaagctgttcagaccttgaagtgttcattacttgtcctcctttatccattttgcggcgtcaagagcatggtatgttatgataatgtccgcacctgcacgctttatagcagtgagattttcaagaacgatacgcttttcgtctatccagccaagctgtgccgccgcttttaccatagagaactcaccgcttacgttgtatgccgcgatcggcagatcatatctgtccctggcggctctgagtatgtcaagatagcaaagagcaggcttcaccatcaccatgtcagccccctcctcgatatcgtcctctatctcacggagagcctcacgtccattacaagggtccatctgatatgactttctgtcgccaaagcatggtgcagattctgcggcgtcacggaacggagaataatatcccgaagcaaattttgcactgtatgacattataggggtatcagtaagagcattctcgtcaagcgccgcccttattgccgcaactctgccgtccatcatgtcggagggtgcgataatatcagcgccggcctttgcaaggctcaccgccattttgcacaaaagcggcaaagtgctgtcattgagtatcttgtcgccctttacaactccgcagtgtccatggctagtgtattcgcaaagacaaacgtccgcaataataagcaggtcaggataatgctctttgatgtatcttattgcctgctgtgtaacgcccttgtcattgtaagcctccgttgcaagctcgtcctttttctctggtatgccgaaaataagcaagcccgatatcccgctgtctgctatctgcggcaatatctgctccagatcgtcgatagaatactgataaactgttggcatagagtcaacaggcttcatgatgttattgccctctgccacaaaaatcgggtagataaagtctgccgcatttaatcttgtttcgcaaaccattcttctcattgctgggtttgcccttaatcttctgaatcttcgcatttttatcttcctctcacttatctgaaagtatcttttgtattattccctctgccgtgctttccgttggaagcagagggccatttataccgtattttttaagctctgccgccgtcacttcgcctatggagatacactttgtattctctgataagcttcctccgccatggaaaaagctcctcactccacctgcactggcaaacacagcgtagtcatcatctatcttctcgcctgtgctgtaaacaggctcgtaaatatgaacatcatcaaagttcagacctttttcagccaatggcttaacaagctccgctgacccctccgaggagcgtactataagaagcctgtcctcaggggtaagagtgtccgagagcatatttccaagagccacgctgttgaatttttcaggcattatgtctgcataaagcccagccttttcaagcttcgccccagtgcctttgcctatgacaggtatcttcacttcgcttagctttcttatgtcaatacggctttctctaagccttttcaaaaatatctccgcaccatttggacttgtaagagcaatatggctgtaaaagccctctgaaagccgtgagaaagctttttccgtgacctcatcgttcagctccctaagctcaaatccgccacagcggtgagcatacgccccaagggcattgagcgactttataagccgccttgaaagcccctttgtggcagtgacagccacagaaactccatacaatggaggcaggtaggtaggcgaaagatcaagcccggcggtttctccaactattatcacagcaggcgcaggcagatcctctctcttcaccttttcagcaatgtcgccaagacagccctttacagccctctgctcaggggtagcaccctttgatatcaccgccgcaggagtattttcgcccatgccgttttcaatgagcctgcctgctatctcagggagatttctaagtcccataagaaaaataagcgttccaccgcattttgcatagctttcaaaatgctcagggagcaggtcgttcgcagtgtgacctgttataacatgaaagctccttgaaagtcccctgtggctcaccggtatacctgcaagctcaggcactgccaccgaggaagtcacccccggtataaggctgtatggtatgcctgcggctttgagtgcagttatctcctcgccccctctgccgaacacaaaagggtcgccgccttttagcctgagaacaacaccgccctctgtggctttttccacaagaagcgtgtttatctcctcctgcgtggagctgtgtctgcctgcacgctttccaacgcatattttctccgcaccgtccttgcagaagtcaagcaaacggctgtctataaggctgtcatatattaccacgtcacagcttttcagagcctcataacctctcattgtgataaggtcataatctccacagcctgcccctgcaactataactctgccgctcatagcttatcagtcagctccttaacaagttcaaatcttttttctatctctttttcgccctgagcaaaatgccccctgccgtctgaaacagtgagagatatcttttctccgtttatctcgctgtatgcccccacaggcacagtgcagtccgcacccagaagtcttatcacctcacgctcggtttcaaacctgagcatagtttccttgtgtgatacctgcgaaattatctcagccgccttgctctcctttgcacattccactgcaattatagcctgacaaggtgcaggcaaaagctcccaaggctcaaactcttttacctcgtattccgaaagggaaagtcccaaacgctccgttcctgccgcacaaagtattatgccgtcataaagcccatcagaaagttttttaaggcgtgtaccaacattgcctcttatatcagcaaactttgcgttaggataaagccttgcaaagccctcacgtctacgctgacttcctgtgccaacagtgaaaacatcagaatcgttaaatgcaatgccttttttggtcacaagcatatcacgatagttcccacgagggcaaactcccgatatttccagcccctcgcccagcgtaacaggcaagtcctttgcactgtgtactgcaaagtctatttctccgctttgcaaagcctgttctatctccgtgacgaacacacccttgccgcctatcttgtcaagaggtctgtcaagctgtctgtcgccctttgtggtgaaggtgactatctcggtatcacactcaggaaatgccgcctttatcatgtcaagtaccatataagtctgcgccattgcaagtggactttttcttgtgcctgctctcagtttcatttttgctcctttatcatctctataagctgttcctctgttggaagcacgtcactttcaaggcattttttcagaacctctgccatagcctttttcctagcctgctccgtggatatattttcaagggcatagtcacggacttttcccatgacattgcatatatcaccaagcctgccctctgtctgcgattggatcgtctttctcagatgagaagcaagggtagggctttttccgcctgttgaaatgccaatgcacacgtccccttctgtaacaatggcagggaagaagaacgtacagctctcagggtcatcaactgcgttgcatggaatgtgcctttgcctgcaaagctgagaaatgtgcctgtttacacctctgtcccctgtggcagttatcacaaatgtactgccgcctatgtcgctgtccttaaaagcacgctcaaaaagtattatcatgcccctgtctgcaagttctcttatctcaccgcaagcttttgatgccaccacctttattataggcgaaaagtcaagaagcttttcgagctttctcaaagctacctgtccgccacccaccacaaggcatggcatattctcaatattcgcaaaaaaaggaaagtatggcatcgtcattctccgtattcttttattacttctataaccttgccgaaagtctgtgaatcaagctccgactttagtctgaaaaacagctctttcgccgaaacctcgcaaagtcttctgtcaaggctctcaaactgcggaagaaaatcatggaacataagttgcttttcaagctcgtcagtttcctcgtcaatgataagctttgacctctccacgctgtcaagttttttgagattgttttctttggcaagctccgtgaaaaagtccatgtctataagcctggcccctgcaagcttttccacggcagggtcaatatctctcggcactgcaaggtctataaaaagcttgctttcattatcactgagcatatccgccgtaacagtgtagtgggggcttgaagtcgccgaaattatgcagtcacattcgccaatgcgctcatatctcttttcgtatggtataagctcaagctttggatcgtctgaaatatattccagcgcatttctgtgggaacgtgccgtcgcaataacagttacgttcttgtatgaaagaagatttttcaggaccagcgagcctatctcaccgcttgctccaagaagcatcaccctggcattatccttataatgcgccgcttccttagccgcaagagtagccgtggaaacggaagtctttgaaagctccgtctccgtctttattttcttcgcacaagcgatagccccctgaaatatcatgttcacctcagaggaaagcccaatgcgctcccttgaaagatcatatgcacggcgaacctgtccaagtatctcgtcctcacctatgaccgctgattctataccgcatgatacgctgtaaagcctttttaccgccgtcttgtctgtgaatatcatgaccttgcgtttgagctttgcgatctcaactccgctttgttcgcaaagaagctttatgccctcctcaggtgttccgcaaaagtaaagctccgtcctgttgcaggtgcaaataagcacaggtgaaaggtcctttacgtcaaaaagcagcttttcacactgagcgctgtcaaatgtgaaaaggctgcgaaaggcttgtccgcaaagcttgtgatttacgcttatgcaggtgaaatttttcatttttctgtgttatctcctgacttttcgggataaagtgcgtcatagtcaagcttggtgaatctgtgatatgttatgccgcccagatcgtcctgcaaacagtatctacagccgtcaggctttccgtctgggaagtatgcaagcaggtcaaattcatcgtcaggtgcagcagttataacagcgttcttattgtactttctgaatatctcagccgctctttcaagagaatacccctcttttaccgctccgataaactccacaagaaacgggcttgcctccaccttttcgtggatagccctcacgctctcctctgataccgtaacagctatcctgccgtcctgagcaagcgaagccttgcatgaaagtatctcgcttttgtattcgtctatggcttttatcatttcctcagccgtaagctcgccccctgttatggcattgagtgagtcaagaggataaaaaagcgtcaccgcattaggggtaaacccaagctttatctgcgactcttttatggtatcggttatattctgttcaagctttataagctctgtcatgaaaattctcctttgtacataattcctataggctttgtatgtttttataatatcacatatttctcatgttgtcaaccttgtttcctcgcctatatattttttcagtgcattgatataaaattccgtcagtggattagaaagtacctttttgtgagtaactatgccaatgcgcatggacccctccgcttcaaggggaacagccacgatatcactgccgttgagcttttcgtcaataacaccgctgcaaatggtgtagccgttaagaccgataagaagattaaaaagtgtcgcacggtcacggacacggatattctttggtcgttttatggtgctgagtatctcttccgagtagtagaaagagttgtattccccctgctcaaaggataaataagggtaggggagcaggtcgtcaagggtcaccgactttttctgtgcgagggggtttgcagagcctacaaaaacgtgtggctttgcagaaaatagctccgtgaatttaagctctttggactttatctcctttgaaagcacaggctcgttgaaatcgttgagatagagtatgccaagctcgcttttcattcttgccacgtcctcgattatctcgtgggtctgcgtctcacgaatgctgaaatcatattcatctccgccaaactcttttataaggtcaacaaaagcgttcaccgcaaaggagtaatgctgagtggatatgcaaaactgccttttgccgtgttgctttccgcagtatttttcttcaagaaggctcgcctgttcaagcacctgccttgcatatcccaaaaagatttcaccctcttttgataccgttatgcccttgtttgtgcgtatgaatatagtgatattcatttccttttcaagctcacggatagcgttggtaagactaggctgagaaataaaaagcgactgcgccgcctcgctgacagtacctttctccgccgtagccaccacatatttaagctgctgtaaggtcatatctccaccccttttcagatatatccttattatatagcgtatttatgaaattttcaagtggagataaactattgctgtcctattcttccatatcttctgtgctgataaacacacttttgccaaacagctcttttcttatgcgtttttttgctgatctgtcactatcataaacgtccgtaatgtagatgtattggtcgctgacatcgtatgcaagctgaaagctagggttagggtcaacgtttatgaatgcttccttttcttctttttttgtaaattttctttttggataaagctttctgcatttttcttttgaacagctcactcttgcagcttcaatgatgtaataattgcttttctcaggataatacactgtcagctctgcacagaagaaaaacgcatttgcgcttatctttatacattcgtttggaacagctatctctttcagcttgtgacaatcgtaaaaagcatagccccttatttctctaagactaggtggcaagatcatatccgtaagacatttacactgatgaaaagcatggcttccaatgatctttagtctttcaggtaattgaacgtttacaaggctttcgcagttttcaaaagtatagtcatttatcacttccacatttgcaggaataattgtactttcaagcttctcacagccgcaaaaacacccctctcccataaaagtcaagccccaagggagcgttaccgatattaatgacacattctcataaaatgcgtattcgcctatctcacacaggcatcttggcataacaacattttctagcctacggcatttgtaaaaagcatagtcggctatcttcagcgttatgggtagtatctcgacctgctcccgttctttaggacagcttataagaacagtgcgttctctgttgtaaagaactccgtcagcagaataatatctgtcacttttcgctgaagccgttatttcttttgaaatatagttgtatttgaaaaagcccttttctataaactgaatgttttccgaaatatacaggctcctcagctttctgtcaccgaatgtgtttacgcttatatccgtcaccgccgtgccgttgatgaacgcaggcagtgaaacgtcagtctccgcaccatgatatttcataagctttatcgttccattctttgtaaatatgtattcccactctctgcttttcaatgtgatcagacctttccttttattcttatcacattatacaaatatcagtgggtataaaattggacatgaaaaagcgcataacgtacacactgcaacgttatgcgcttatgtttctatctcatcatctctatatcctcataaagcccctctatatcagctttaagccgccttatctcatgaagacgatgtcggtatttttcgccgatctctctctgctcctccatagtcggcaaaggtatctcacactctttcaacccctttgtgtgcaatatccttactacctttccgctgcgacagccgtcaagcatagcctttccctctgccgatgaaagataagccgcaatatagtaagggtcagccttctccttgtcaagtcctatccttataagcgtgggtgaaacaagaagctttctgtcccccatatcgcctgcacataccaccttgaaattcttgtccgtggtggacagtatcacatctccgtcctttatggcatatttctcaaaacgcttgctgtcataaactatctcaatgcagttttccgcaataacgccgtcgtcaatgtccacaagccttagatattcgcatggcttagtaaactcattgtccgaaatgtagctctccgccataagtccatgacttatctcttttatgatatctccaaaattaactgtatttacattcattttagtcacctctcttgatttccatacatctcagacaatgccgagatctcttcttttacaatatccacagccttctttggcgaggtcagcttcacagcttttctgttagctattgcccagcgtacagccgtctggatatttgccctgaacgtcacgtcatagatatcgtcattacctatgaccttattgcaggtgaactcattcccgaatgtatcaagcacaagacttatgtctttcttttttatgttgatatgtacacgctccacagtcccgtcaagcatatacctgttaagatttttgtattgcacaggctttagatccctcggaacattgctaagcgtctttacatctctcatagagccgtcctcttcgcagatactcgcctttaggatcttgtctatcctgaaatgacgaagatcatcataacgaacatcacttgcaaggagatagtaaaagccgtctgccataacgatgccataagggctgagcataacacgttgaagctttataccgctctgtgggtcgctcttagtgaggagcttgccgttcttgtcataatcgcttatggtaacatcaagcttcctgttggtgttcatagcctctttgatattttctatcaccaaaaaaatgctcttgttgccatagtgaaaggtctctctgagattggcttccttgctctttgtgttacccgtagataagatgtttatcttttttatcagatccctcacatagtccgcagggagcattggcgagtatatgatgctgtctgccagaaactcatattcctcagcggtgatgtcagaggcgtagtaaatatctgtgatgtattttttattgcttttatcattatcatcgttgtcattgtctgcgatgaaaacattgcagctctcatctcctattatgctcttcaaatgctgagccaccgtcttgcggttaggctttatgccaagcttttcctcaagataaccgcagatctgctgctgagtaagggggtgcttttcgtcactgtgttctttgagtatctcaatgatcttgtgcgaaagcatatctgtttttgtatatgacatttttgccctcctgttctgtgatatctttctttcaatatatcacttttgctttattttgtcaattgtgtgccgctaagtttttgtatcataaaaggatacaccacctgctttagcaccctaacaggcagcctgtgcccgaaatccgccgtcagcatattttcctcaccgaatttctccctgaacatatcggcgttgtgaagcagctcgtcattcctgccgaaaatgccgaaagtttcttttgaaaaatcgtatgacgatgagttgtatcctttgagaagaatttcaagctcatcaatgaagctccggtcaatggtgtatgatacagcgccgtcctgccttggtctgagaaaatcatgctccccaagcccgatagcgttttcaatgtctgtgggagcgttcatggcgggattgataagaaattttggtatgccctttataagcattgcataaaagccacccaaagatgtgccgacaacaaaatcaaactcattgccggcgaccagcttgcttataaaagcaaatgcttcaagtgggcgaacaggtatgtcaggagaaatgacctcgatgtcagaaaaaagctttttcagtaccgatgccgtcgctccgccccctgcagagccgatcccgtgcaagtgcagtatcttcctcattagtcatcaccttcgctgagatattcttctctgttctcttcgctctcaaattccacatcattagggtcgccctcaaatttaagcacaggcgagccgtatagtccccagaaagcgtcagtgccgatcttttttacagacttcggtatcacaataggtgtttcaagattatgacacataaagaaagcctgcgagccgatttcctccacaccctcgtgaagaataagttcttccatgccaaatatctcactgaaagcactgccacatatttttttgatgttccctggtatctccacttttttaagtgtcgattccccaaaagcaccattgctgatctccgtcatggtcgaggggaacttgacgctcgttaaaggcatcatattaaaagccagaggctcgatgtcctctattccctcaggtatctccacaataagcggagcgtacctgtccttgctgttgagaatgtagtctgcataagcctttgaagccatatcaaaagtaaaagtcttttccatatccgttacctccatatcattaacaatagaccgacttccacatcagaccctctggtctctcgtgaaattcaagctttccgtccttgtaagagaaatagtctgaaacgttcttgtcaaaaacaaaatcaggctcagcctcaagtattatcttgtaagtgccgtcatcttccttgtcgataccgccatagaacgcacccttttcaatgacctttaccgactttggtataacaacgccgcttgaatagcaatggaaaaatgcgtcctctccgataaattcaagcttgtcattgaacctgatgttctttatatattcacagcgccagaacgcacccttgccgatagacttgagttcatgaggacaaataaggttgtgaaacggtgtgttcctgaacgcataatcgcctatctctctcagggtcgacggcagacttatgttcataacaaaaagattgtcaaaagcatagtcatctatcctctctatgccctcagggacttcaatgtgaaacctctccgcatatctgttccctctgagtatctgatctgccatagccctcgccgccatttctgcggtgtatatcttgctcttatccattgtatcaagtcctttctttttgtgttgctcttatcataccacccaccatgggtaaaatttcggatattaaaaacttccgctatgtccacatttttgaacattccgggtgctataatgcagatatagacgaaaaacaagaatgagaaaagaccacggaggcggatttttatgcgttgttacagagcaagatgtatactcgaagagtctattatcagaagaacaagagataatgaagaagagtacgatacattctttgatgagaaaaaccagcttataaacgagttcaatgaaatggcacgcaccatgtccaacagaagctgcgcctttatatcaagcgccgtaaaagatcaggcgaccataggggtaatgatgacagacattgaagccgacgtgaaagcctatgtaaagaacttcttttcatttataaagcttgagtgcgtggatataagcttcgaggaaataacagtggaaacgttcaaaagaatgatccccaacggctatcacgataatttcaagttcgatgaagacctgctgaatgactatgaactggacgacctgttcagtaactatagaagatcgtacataagcgaaaatatcacaaagtccattgataaaaaagacgctctcgccgtagcaaaaaaatatctctgctcagaaacctttgagcctgagcttaaaagaattttcagaaagaacagcgtcggtgtgacaaaaggcataccggtacattatttgatccaaagcgataatgcccataggcttgccgatacccttgtaagcgccctgcattcaaataacagactaggctgtgcaagatataccgtcctcgacctttataatttatcagcccgaagctcagatatccgtgaactgttccgtgtttgcagcggctctaccatcataatgaattgttgtggtttaaagtgtaccaacagcgataattgtacagccgatgaaactatccccgatatcctctttgaactcatcaatgcctacaaaaacgagatacagtttatttttaccttttcaaatgacggaccttctctccctgacgctgtggaagaaaagcttggcgctatcacattcgtgaagcttgcggacgatactgtagaaaacgaagatgcacataaatatctcagaaagctttgcagagaagagaatacctcctgcgataaagacctcctttccctgtgcgcaaaggataccccatatagagcaagcgagcttatgggtatgtacgatacttggtattcaaatgtcctgaaaacaaaaatctatccccagtattcaaacttcaaaaagctttatgacagggaagaagccaaggagataaaaggctctgcctacagcgagcttcaggagcttatcggacttgattccgccaagagcgttatcgaaaaggcgataacatattcaaaggcgcagaaaatttttgccgataagggcatgaaagaaagccgaacagccatgcatatggtgttcacaggcaacccaggcacagcaaagaccacagttgcaaggctgtttgcaagaatattcaaagaaaatggcgtgctttccaaaggcgaccttatcgagtgcggacgttccgaccttgttggaaaatatgttggctggacagccgttcaggtgaagaatatgttcaagaaagctaaaggctcagtgctttttatcgacgaagcctattccctctgcgatgaccgctcaggctcttatggcgacgaggccataaacactatcgtgcaggaaatggagaacaaccgtgacgatatggtagttattttcgcaggctatccaaaggaaatgaacgacttcctcgaccgcaaccctggtctgagatcaaggatagcgttccatgtcaattttggggactataccgccgaggagcttcttagtatcgtccatcttatggctaaaaacaatgaacataagcttgccgacgacgttgacgaaacgctcctgccttttcttgaaagggtctgcaagaagccgaatttcggcaacggcagatttgcaagaaatcttatagagggagcattgttcggtcaggcactcaggctcacaagacagaatttcagtaccatgacaatggacgatatcgtgaccctaaaagcccgtgactttgacctcaccgaggacgatacccttgaagaagagccaaagcatattggatttaacagataaagaaaggataatatttatgacaaaagtttttacacaggatatggcaaaaagaatggtagcttatgaaataaagactccctttggctcgagttctcttggacttgctataccggagggcttcacaaggatagaaaagggcgctttcgaaaatatggatatcgacactgtgatattccctaagtcccttgaagttatcgaggataacgcctttaaaaactgcagactgagagaggtgcgttttcctgaacaggtcagatatataggcaacagtgcctttgaggattgtgtatccctccacaatgtcgagtttgagtatgaccttatagaatatataggcgatcgtgctttctataactgcataagtcttactgacattaacagcacatacagtatcgaaataccgaggagcgtaaaatatatcggcagagacgcttttgcacgttcagagagcttttatgaaaacgaacaccttgacttgactatactctcaaaccctgatataaagatcgactgctgctactcccacgagcctatagacctttctgcctttgccacgaagccaacagcacaacacttcgcagagtatggcgtaataagtgccaatgagcagtatggcggcgaaagatatgtttttactggatataatgccaaagagctttacgcagattatatccttaaccgaaaagacccatatgaagattttattgcaagaatacccgagggcgttacgtttatatgtgataatgcttttcagaatatgcctgttgacgaggtgatattaccaaattctcttcaagctatcggcgaggatagcttctcaaacactaatatttcagaaatagttatcccaccgaacgttgagcgtatcgaccgttttgcatttgcccgtaatgaatttcttgaaaaagttaccatgaacagcgacaaaatatccaaaatggatgcgtggtttgacgattgtccgagccttgaaagcataacagtttccccttgtatcagagagatcacaagctatacatttgacaactgcatcaatttaaaaaatatcgagataagcgagggcgttgagaaaatagagtggaatgcctttgacaactgcaaaagccttaaaaagctcgttctccctaccaccataaagacccttgaaaatggctggggcagaggacttaatacaggcaaaacaggagaagtgaccgaaataatattcaaaggccacgaggattggaagataccaaagggttatcatatcaaaagctataaggagggcaagcttgatataggcaagtgttttcctgagggaggcaacaaccctgcaaaaataaaatatttcaccaccgaagaaatgcttgaagaaatagaagagctttataacagagctgtaaggtatgaggaaggcaaccccgacagaaaatatgatgatgaaatgaacagatattggcatatagcagttttttataaggatatatatgtttcaagcgaccccgcaggcgaccatgtaggcgaatcttatcaccatttcaccattggcggaaacacccgaaaggagcttgaatatattctttcccaccgagagggcatactcttttcgttcatagaaacatacctgcctgatgtggatatgtactgtatttactgtgacgatgaggagttcgattgcgatcaggacgatgtagcctataatatagaggacgctttctttatgagaaaatacgcccccggccttaaagaacttccaatgaaccttatcaccagacttagactatgtgaggagcgtaaaagatgatatatgtagttggcgacctccacggagatctttcaaaaataaaaaagctccatgaggataagaagcttagtaaaagcgatacagttatcctcctcggagataccggactatcaagcacatatgaaatgttttccacaagccttaaaaaacagcttgcggctatccccacaaattttctctgcgtccgaggagaatttgacgcactgaattacacaacctatacagaatcagagcgttggcatcttcatataacagagggcaagatacacgataacagctataaacagaaaatatggaactgtggcaaaggtgattatgaagaagcctatcccaatatcctctatgccaatgacggcgagatatttgttatcgaggataaagctatcctcaccataggcggagcttgtatgcagaataaacagtggcggtcagatatctttggcatagagtttatccccgataagcctcaaaaagtggtcaaagataaagcaaaattcaatctcgaacagtatggctggaaagtggactatgttgtgacccatacctgcccctatgagtatagaccaacataccgctatatccccgatctgaacaccgccaagtgcttcaaacggcattatgataacgaaaagtttctttccaaaataagaaataagcttgtctatgaaatgtggctctgcggacatttccatttagatcgtactgtgggcaacgtgagatttctctatgacgatatctatgagataaaataaagcgcaggcactatggagcatacgctctgtagtgcctgcttccgtcatttttgaccctcacaaaatcaagctcatcaagcccgaacagccttgtaagctccgtcaacatctcctcactgttcagcgcaggattaagatatatcacagccttgccgccctttatctccactctgccacgaggataataattgtactctttcccatgtgttacgtttttcggcagtccctcccaagtcagcctgtgattgaaattatcccccgactttgagttaagtccactgccgtcaccaataacatttcccgatttgtcgcactctaacttctttgtatataattcaccctcgataagccagaatattcccttgtatatcatattattcacctcaatatgataataccgtttcctatgtcctaaattgcacacataggttgtgatattataatatcagtgaaaggggcgataccatggtaacatcaaaatcagttgaaaagaacaacgaagaatggtacaacaaaaccgagcagatatttgaacgctcgtaccgcacagacgcaagctttgtgatatctcacataaagtctgctcagaaaaagttcacctgccaaggctatcttatcacagccacaaaagggaagcccctcaaagtcttttcgggcgagagtgaagccgtagaaaagcagttgcaaaacagcaagataccatattcacagcttatcacagtgcaaaataacaggtccttgcaaactgcctatatagcctataccaaggataaacaaaagctcacagaagccctgaacaacagtggcttcaccgccatagaagatgtggacagctttatgtcagactatgacaaagtaatgataagagttgccgaaaacatctcacaacgtcatttgttcgacagcataggactatggtagggaggtgacggcatcgtgatgatcccccgcgagcgaagcccaccagatttggtgtgcttgactaaaaaatccccgcccttgactttcattttatgagtacggctgtctttaggaacattattaagtttgagatattgtcatcaatttgtacgagtgtaaagataatcttccatatttgatataagtaacaaacttctattaaatcgttatcgtcgcttcttcatatctattgctattttcggagcattcaattctgacggtcagttctgttcaccttctctactttctgcatagattcctatttttaattgcagctcttgatttgtatggcgatcgtattattgcttaaggatctaatttccaagttatttaatatcgcttttcagttcacaataagcaactttttcattattataaaacatataaaatctttctcctttattgaagtcaatattgcgatctgatataggaatggattttatattagcgtcaaaagactctgatgatataaatttaacatcttctatcgaaacacaaaaagtatgtgaaataggcttatcatttatatctacaaagcaaatagggaaaattcgtttttctgaaaacaagatttttcgtttgatcaacgaaaaatcttttatcaaagtaaaattcgcagtgccttttttcttaggtatgaaatgtttcgtttccatctccaagggcaaagctatacagataatagagtagatgatccaaaatataaatatactataaattgcaaacacatattttaaaaaaataataaaagccaaaccgacaatggctcctaacccatagatccaaccgtatttatatattttgctataattaccacagttaggacaatgataatgacctctttgaaaaaatcgaccttttatgatttctccacaccaaggacatcttttgtctaaactcataaattcaccaccgtttgttactaagttttgttataatacaacatatttccatctcttatcaataaagccgtcgaaatagttcttacatattacaatgcctactttgtccaaataattctctttaactgctgattttccataaatgctttggattgcattcattcttccggcttataaacttttacaaccttattctctttaaataaatatattctatcacatttttcacatctccatacatcatattgaggatatggaacatctaaaaaatatatccacccctttttttcaaattcagaccattcacgatcagagtacacataatactctgtatcgttagggtcaagctgatttgtgagcatattcccacatcgacatacaaatctcatattatctctcctataaattgtatatttttatttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgccctttatgcgtcttttctttataataccactgcgataaccgctagtgcgatacttaactgaatagcgtaattcacaaatccatacttcaagtactgacctactccccaagaagtcttcttaccgtcttcggcttcgatatctgcaccgtttaccttgccactcaaaatgaatcctgcggttgcagaccacataaagagacttgaaccggcacagattgctgctgcgtatgctacagcgatccaatccgactgaccaccgagaggtccctgacagatgttaatgattacaggcatcatagctgcggcagccggacctgcactaaagatacctgccacaagtgatgtaatgaccatgattaccattacaaggatcttcgggttgtcaatatgattctggagataagctgcaaggagattcagaacacctgtctgacttactacctgagcaaagaaaaggaaagaggcgatagtaagaacggatttaagatccatgatctgacgaaccttgatttttttgaccgagcagatgaccatggcgattccgtatccaagtatagcgatgatttcaggtggaataatgttctgagggacgaagctccaggcaaggaacattcccacaaaaacaaccgcaaggagtttcagaacgtcaaatcggatttcgatgttcttgtactggcttttaagattggtaactgctaattttcttaatgcgccatcatcattttccttctttacgtgaagtccccaaactgcgatcagaaccgcagaggtgattgcaaagagaggaaaagcgtgagtaaggtagctaagaaagctagtaataccgctagtcataatgacaattgctggaaaatcgccaacaggagacgcagctccgcctgtgttactaagagcaagaatagcagcaaagaacgtacatacatacttcttgtccacttcaagggttttgagaagtacgaacacgataggcagaatcatcatgactgcggtaatgttattcaagcatgagctgataaggaacatcataccgccgaacatcatgagacacaggcgtttcttacccttggacatttcagctatcttgatagctaagagctgcataatgccggtctccgcaatcaagttggtaaacaactccatgacgatcagaatggccagaacatcgtaggagtagttgctcattacactcttgatgggaatattgaaaaggagggctaccgcacttccgatgacaaacatcgcagcgataagaatcagcgaaccactctttttgagtttctccaacaaagcactctgttttctttcagtcttgaccttttccctcaaaccgccgcttgagattacagctgtattattcatgtccactcctccatttctccgttatcctatcctgtccaacctccatccagccatcatagcgagccgctgaggtaagttcgatgtaaggaataaagaccttcttgccgaggaaactgttgtaatgctctaccatcctgtaggtatctgccattaccatcgccctatctccgcccatgtatccacaagttacaagcattccgttgctaggatagagcatagcaggaaaatgaggttcttcgagcagttccactattgctccgtgaggaagattattctgcaatcgttccttgatctcagggtcaagatcacagggaatagcaattgtgacttcggctttgttgtcggtctgtctgagaagctcctcaatcaatgcgatctcaggggtaaggaacatatacttacgcttgccaaaaccggcaagccacttagctatgtcacttactttcttctcagtgtcagaatccggcaggggcattgaagcccctaccttatcctgaacatcaggactgtccatgacagcaaccaggttgatagccgtgagaaacagtccgatttctttggcagttctgtgcatatccattacgatacctccttcgtcttgtcatccagataggcgatcaatctggaaataactgcgatctcattcggcgaggagttcagaataccaacgaaacgagcacctgcatcaccgtaaagctctgcgtagaggttctgtgcagattcgtccatagtgggagacggaaatctcacctgagaatcaatgccggagtttgcagtgaggaaagtagaagaaccgttcatcttcataagctgaatagcaaggatctgaatctccggaggagcgtcctgaatgatgtaagctgctgccattgcggtgtcgggatcaccgaagatggtatccagaagagcgatgtcgtcttcaccgaactcaacgtgcatcattgctctcctctcatggggaggaatgggtctgccatgacgctcatgaggaggaagcggtcttccgaagtcgtgctcatgaggcataggggggctgccttcaaggtgcttgtccatttgcattctgttttctctgctctctgtaaatactttcatttgaaagacctccttaaaattttgacggattgttgtttactgttgagaggtgttcttctccctacaacctaatcataccacatcttgtccccctcacagggagggggatagatttcttatgctacctcctgtttctttgaatcatcagtagtattcttgcgaagcttgttattgagtgtaactattttctcacatctctttactacacacgaatcatggctgatgtacatgatacctgcgccgatgctctttgcgtaattttcgatattcgtaagtacaaagtctcttgaattttcgtctaaattagccgtgatctcatcgaagatgaacagcttagggtgacgaaggaatgctctagccaaagacagtctctgcttcataccaccggagagtctctcggacttctcattgataaaagaatcaagagcttcttttgcatctacatctataacagtatcgccatgtccagttccagtcaagtgaacacgatagagtgcatcagccagttctgcatcagatacttctctttcaataccatacatcaggttttctctaacggtgccagcaataaagaatgaactctgaggagtgtaatagatcatcgaagtgagttctttctggtcaaatgatgactgatctcgaccgaaaagacgaattgtgccctgaatatgtgggtaatatctgttcaaacactttacaagggaagacttaccacaaccatttggaccctggagtgcgattacagagttggtggggattactatatcttcgtaccaagcaatctgttcagttttagccggattagttacgataacatcattaagaacgatcttgtttccaatgcttttttcaccagaggaatcgatgttgaatacctcatcagatgggttagaggtcacttcgagcaaagccttcgctttgattacggaagaagctgtttcatccataaaacgatacacttcatcaataggcttgacaagttgctggaacagaaggcatactgtaattactgatgcaccagacatctttccgctagaaacgagaactaccgaagcaatcagcagaataatctggaatgagatcttgcagaactgctttacgcagtcaaaagatcccatatatttgtggtgccttttctcggtattactaatattcaagattgacggaacaagcctttttttctcatactcctcagcattcatgcttctgataagttcaagattcatgatggactggcagatctgaccatcaagagagttcttgtatccaactattttttcacgaataccattctgcgaacgaatctggaatactgaaatgagaattgtcagagcaaggtacagcatcatgattccaaccataatccacggcgcattcagaaaaacctgtacaagcgtgcaaaccgccgtaagaacagtggcaaatacatcgttgcacatgatttttatgagctgactgaatcctgcaaccccctgatttaactgtgctgttttttcaccgcttaagctaccagagtaaaatgatgcaggcattttaagaagcttttcaacactgttttcacgtacttccgattcgtgtgtagcaattacgcagtccagcataactctacgaagaatcgtaatgcactcggcagaaaggtaaatcaagccgaaggttgcaacggctatggctcctttagctagtgtattgatagtaccgttggaaatgtttgtgtagagtttagccagtcttacaggccaaagagaggcaaggaacgaacttacaaaagcaagaataataattcctgcacatttgatctttgtttttcgactcataatggaaagatattttttcatagcgattcctcctaattatcatttaagggttgtaattctatcagaattatgctataattatacataacattttagaggttggattgctttttctctgtatctatagtgtaacatagccctattagttataaaatagattcagaatgagatttgaaattctttcattagttatggatttgttttgaatgtacttactatgggaggcattatgtctaaattattttttgattcacataaatattttgattttgatactcaattactttataccgatgatattcctaaggaagaggcgttgacaggaatcccatttcgcattttagagtatttagctaaaaacgcacctcttcctttatcttgtgatcaaatacgccaagaatgctgggagaacgacaatggtacaggtgatgtaccatatcatataagtgtgttaagagaatatattgaggacataaagataaaaggcacgagaaaatacacttatatcgttacgagagataaaaaatactattgttccattaaattaacaagcgattttatttcagacggcacgaatagttttattactgatgagttggaatgtgataataatagtgtagattatttgatttccccattagactattgtaaacaaagaggcattaaaggttttttagatagtggtcttgctcctcaagttttaattaaaaatttaaaaaacaaaacaaacatttatattcttacaaccaccggcgcaaacttaataacagcgttgtcatcagatttcattgcagattcgcttgttcacggcacttcttttactatattactaccgaataagtattctgagtttatcaatgatgtggctgatattgaaacgccttatgataaagaattatcaagagatgcatttgcaacacaatttgaaaatataattaaaacgattaagcgagaagtgctaaaagcacagaatttgtcaaatcaaagtacagtcggatctgtgtatattggatgcgcatttacatatttgcgtcaaacaattattatgggcataaatgaaaccgaagtatgggggtatcagtcaatgacaatgccacctgcaagaactattaatggaactacttcatttgtgttctctggcaatatcaatgaaaatacgatagccaaacgaacatataatcacataaatgcattgattgatgaagctaagcatagattctctttttttgaagtgacggaattaataaatccatcaacatttaattttggcttagaaaaaacaaatgcacggacatattgggaatctttatatagaaaagcagatattaacatgaaaatacatatgcaatatgaagatgaacttattgaggttgcagctcagcatccacttaatcatggcgagccagattcagaatttaaagaaaggttaaactttgcattcgaattgtataataagctaagaaaaggcaatcgaagagttggaatatatattcctggtagtgtacatacagcaaatggcatacaagaccagtattcactaagttttgcaggggttaaatatctaacaaagcttggaatacctatcgaatccttattaggagatgaatataatcaaaagtataagggcgaaaatggtgtatataactctgctgacgaatgttatgttgcatctcagatttttttaaacggaaaatataagtacattcatgttgtttgttccccaaatcaaatgcttcgcaaacaattgttttacatttcttttggcgtaattccgctatttcatacggttccaaataataatccagctcatgatttgatttatgagttatttgaagcgataccagatgtcatatataatgaccatacgtggcaagatgacgattctcctaatgctattcgtacaagaaatgaacgtaaacccaaatagccaataaacaatggtatctatattatgtacagattgctgcgctataaaaatacagaacaggcagatacctcgtaatgaagtatctgcctgttctgtttatagcccgctgtataggtctttacataatatctgttgaaaaacttctatattagtaccgacttgagagggtacggtgataaaatattcagcacgcagataatatgccaatatacgggtgaacgctgttcacctctgcatatattaggatgaaaagactatttctttttacgctttgcacatatcgccaaacctgctccagcggctattattgcggctgtaacgcctgccgccgcacctgttgacggatttgttgacgaatcggtattataattctttgatgcctgagagcctgctgttttgtcagggatagaaatatcatttgaagtgttcttcttttctacatatgtaaagtttgctccgcccacaacgtcaccaagcttataattgtcatatgactctgcaagggtgccttcattattagggactttgttttcgcccatggtgcttattgttacagaaagctcatcatagtcgctgttaagctttgcaagatacgcctgaaactcctctgatgtggcttcctttccctcgatggtgtatgaagtcatgccttttttgctgtcatattctgcggtgcagatatcagcggtaagacattcaccaagacagctaaaaagctttctcactgcgtaatgctccttgccgtcctctgcatatctatcctctgagaggtatgttttttcgccagtctgcttgtttacataaggcttgaagccgaagcctttctcaccgtcgccatggtcgtttgacacattggtatccgccaaaaagcctgcattgcccataccgataacgtcataaagccttaaagcagtaccttcatctaagaggtctgcaataccgccgataacaaagtcaggaacgccgtcaaagtttaaatcctcaaaccaactgttatagctccaatcaacatcatcagcaatttcagaaggaacgtcaaccatcatctctttaagaagatcgttcatctcgactattacgcttgtcatatcgtcctttttgttctccgccgtcatgacaacgcagttatactcgttatacatttccagaagcttatcagcgtcagcctttgcagtttcatctgatgtcagctctgtattttccacttcaagagggataaatctgctgagggtggatttatagttataatactcgctctcgctgacctctttgccgtctgttttgtaaacagtgctgtcagtttccaaatcgtattcttccgagcaaagctccttttcagtaacgcctttttcagggtcaaaggtcatagtttttatcttatcgttacttgaaaaatatgatacctcccctgtataaagatctctgtaaggcatataatcaaagcccataaatcccggaaaatactgtccgtttgcaacagtgtcatctatctttatctccttgccgtccttggtaagaatagaataatgtttgtcgccgtcagccatttcaccgcctattataaactcaggcacaccgtcataatccagatccatgaaccatgagccatagtcgaagtaggtcttatcgccgtctgcaacactgtccatactctttaaaatatcaggcagcttgccgtctatgaaattgacgaagtcttctcctgcgtccttatcaagaacataggaagcatctgccgaaactgtagtgaacatcatgctcgctgacataatgaccgcaattgccgccgcacttatcttttttatcatacatatcaccccaaaaaatagttttcatacatatacctacttaatatttcatacatatacctacttaatatataacatatatcaaataaaaagtcaagaaaaaaactgaccaaagcacacactttggtcagtttatcactttttagggaagggtatttagcaatattgtattattgcaggtcgcctctgttaaattctgaaagctcaagaccctcgtttctttcaagcgcccagcggatattccactcgcttgtgaaaagaagcagatagttgtcacggaagtccttgacaagctttgtgtcacttgaaagcttcaatgtcttagggtcgatatccttgttatctatccagcggatataagaataaggcagaccctctttgaagaggtcaacgttgtactcatttttcattctgtattcaaaaacttcaagctgaagaacgcccacaacgcccacgataacttcttccataccgctgtcaggctcatggaatatctgtatcgcaccctcttgtgcgatctgtgttgtaccctttacgaactgctttcttttgagggtatccttctgacggactctcataaaatgctcaggtgcaaaggtcgggatagactcgaactcgaactttttctttggcgagcaaatcgtatcaccgatagcgaagatacctgggtcaaacacaccgattatatctcctgcataggcttcgtcgattatctctctttcctgagccattatctgctgaggctgagaaagtctgagctttttattgccctgaacgtggagaacttccatatccttatcgaacttgcctgagcagatacgcaggaaagtgatacggtcacggtgagctttgttcatattcgcctgaattttgaatacgaaagccgagaactcagggtcgaacggatctatgataccggcagaggaattcctcggagtaggagaagttgtcatttccaggaagttttccaaaaacggctcaacgccgaagtttgtaagagcagagccaaagaacacaggcgaaagctcaccctttctcaccttttcgatatcgaactcatagcttgcgccatcgagaagctcgatatcatcgcagagagttgagtggagatcctcgccgataaggctgtcaagtgacgggtcggagaggtcgacttctgtagctgccacctgatgctgtccaccgcttgcctcaaaagagattatatgctttttatctctgtcataaacgcccttaaactctttgcctgagccgataggccaattcacaggataggtctggataccaagctcagactctatctgctccataagatcgaaaggatttctggactcacgatccattttatttacgaaagtaaatatagggatatggcgcataacgcagaccttgaaaagctttctggtctgattttccacaccctttgaagcgtctattaccattacggctgagtctgcagccataagagtacggtaggtatcctcagagaagtcctgatgtccaggagtatccaggatatttatacaataatttttatactgaaactgcataacagaagaagtaacagagatacctctttgtttttctatttccatccagtctgaaacagcatggcgggagttctttttaccttttacagcacctgcctgagctatcgcaccaccatagagcagaaatttttccgtaagagttgttttacctgcgtcagggtgggaaattatcgcaaaagtacggcggcgtttgatctcatcttcaagcttacccaaaattattcctccatatttcattgcatttttaaacataccttattagtatagcacagtattgcggaaaatgcaagagattttttatgaagaaagcggcgtttgtagaatgaggagtgaggaatgaggaattatggtatcgcctgtcggcgataaattttttgataggggcgaacgctgttcgcctgcttcttgtttgcccatacattcctgcgatatccacacattatttatgttttcacaaaccatgtaggggacgctactttgccgtgccgcaaaatcgcttcgctctttgcggattttacgttgtgcaggaaacaacaaaagcggtgcaggtcttattcttcgatacttatttgtttagtgatttagtttgtatttcttcttttcacctctgcaccgcttaatcggcttgcgccgaatgaggctctgcctcaaactccgctagggactctgtccctagaccctgcaatgggtttcaccccttgaccctgaccaggggcgtgcccctggtccttttgctcgcttcgctcggtgttggctaccccactctgttcggcgctgtcattcctcattcctcattcctcattcagccccactcggtgcggctatgtcattcctcactcctcactcctcacttaaaccgctcctcactcctcactcctcacttaacttcgttcctcacttaaacagccgttgacattctccacaaactatgctaaaatcaaattataagcaatcaactatcaaacatacaaaggaggctgttttatgaaagatctgctcgaacttatgaaaaccagaagaagtgtacgaaaatacaagcctgacatgataccgcaggacgttctcgaccgcatcataatagcaggaacttattccgccacaggaagaaacttgcagtcacctattataattgctgtcaccaacaaggaaatgcgcgacaaaatttctgagatgaacagaaagataggcggctgggctgagggcttcgacccgttctatggtgcgcctgttattcttattgtactagctgacaaatcctgcccgacttatatttatgacggaagtcttgttatgggaaatcttatgcttgccgctcacaacgagggcgttggaagctgctggatacatcgtgcaaaggaagaatttgagtccgaagaaggcaaggagatcctccgcagccttggtatcgagggcgaatacgagggcatcggtcactgcgcactcggctacactgagggtgaatatcccgagggtcacgaaagaaaagacaattgggtatactatatcaaataatcctgacaaactatctaacaaaaaacggagcggtcaaaaccgttccgttttttttcttattaatgagctgtcacgtcagaaaattctatgccgacctgcttgccctcatatgttgcggaatactcgaacgttgtgccaacaactgtcgccttgccattgctgtctattttgagcttgcacttcggaagcttctggatataaagctgttttgtttccccaggatagttgttgtcatatatctgaaggatatattttctgtggcaatcagaatcctgaataagtccgatagcgttcactgtatgagtatcgtctatagttgtaacaaccggtatgccaaggctgagctggtcttcaagcttttcaaagcccttactgtcgttgttaaggttatactctgacgaagaatcgtcccactggagggtgttaagtctgtagagtgcctttgcgaactctgcgtcatttgaggaatagccgccccttattttgtcaatgccgtttactatatccatatcaagcagctctacctttttccagcggagattgccgcctgatattttcgtaacgtcctttacccagcccttgttcttgctgtcatacttatagtcatcattaagggtgagaatatcccctgtgcaggaatagtcaagatactttgtaacgtctgaatatgtgcccgcaaaaaggtctgaggttatcttgctaagcggcactctttcgtcatactgtttaccaaagtctgttccgcttatgtcatagcctgcggcattcacctttatgtcgctcttatctgacggagcgatatctccaagagaagtctttacatttccgagataccaatctcttgccataacagccatgccgaagtcaacgcttgcggtagttgttgttctgaaattcttgaatgagaagccgttcacctttgggtcaaagcctgtgttgtaaagtgaataacctcttacattatcatcagcgttcgtgtatgtaacgatatcatagttcagtgtagtaactatctgcttgtaaacgtcattgagggcgtttgcgtcggacgctgagtaatactttccgcctgtggaataagcaagctcctgaagccaatctctgtcaacatctctgccaagaccaactgtgagaacgattatgtccttatcctttgcagtatttgcaaggcttgaaacgcttgcaggattaaactcgtcagactcgccgtctgtgagcatcacgatgatatttctgtattttccaccggaagttgccttgaactcgtccatgcactttttaagagccgtctggctgtgagtgccgttaaatatctctttctcagactttatcttatcgagagcttccgtaagcttcgtcttatcatcagtgaagtctaccatctttttgtagcttcctgtgaacttgcaaatgccgacctgatagtggctctcaaacttgtcgataagattctttgcaaattcaagacgcttgaagtcaacatcattctcagaagaagttacacactgctcctttggatacatagagccggagttatcaacgaggaagcagatccttgttgtggcttcatcatttacagttttctcaacgcctaccacataagtgccaagctctgtaagagaagcagaaactgtctttttgctcttgtctgcctttgaatccacctttgtgtaaagggtcgagcgtgaatcaaatctcagcactgtaaggtcatcaaatgaatatcccattttactcagctttgcagagtcgatatcaaaagttatctttgccgagttgaacttatagtcagaataagcgtcataagcctttgtgacgatacttgcatttgatgagataccaaagagatcaagctcaacgagggtcgcactggcagcgtttgcgtcaccctttatttcaaggcggcagtcccctgcatttttttccactgtaagctctctttcagcgtcattggtctttccgtcagactttgactctctcggatttgtgcctgccataagctcatagccgtcaagaagaccgtcgccgtcagtatcggcttcaatagggttcgtgcctagctttgtctcatcgccgtcgcttattccgtcattgtcagtatcctcgctttgaaggttagtgccatgacgtacctcatcggcattctttatgccgtcaccgtcccagtcctgatcgtcagaaaactccgactccttgaaggtagtgcttatatcaagctttgttatgaccgattttgccatggcgatacggttattttcccttattttcagacccacgacaacacaggcagccacaaggaacgcaagcactatacacagcaccagcaacgctatcttctttttgcgctttcctctgttcatgctctgaacaaaatcattcgtatcagaaaaatttgctttcataaatattaattccccttatcagatcacatatttcacgatattaatattttagcatatatgtacctcatttgcaagcaaaataacctagaataattcacaaaataaactgttcttttttgtttacaaacagtatatcttaccaaaacattaacaagataattcttttattattaacctaaaataaattaaaaccttctttttccacaaaaaagggcagcccctctcggagctgccctttggcataacactatcactcttctgtaacagtattataaataacgttcacaacgaagtccttgtcataatctacctgcaagatagaatcaggctcaagctcgtctgcaatgatcttctttgcgataagagtttcgatacgtctttggataaacctcttgagaggtcttgcaccgaagttctgatcgtagccctgatttacgatagcttccttagcggcgtctgttacctctatgctgagcctcttgtcttccagacgcttgccaagctctgcaagcataaggtcaacgatcttgtatatctccgtcttcataagaggcttgtagtagattatatcgtcaagtctgttaaggaactcaggtctgaactgctgtttcagcagagcgtccaccttgtcccttgcctcctgagatatctcgccctcaggtgtgatgccctcaaggatataaggagaaccgaggtttgaagtgaggattatgatagtgttcttgaagtcaaccgttctgccctgtgaatctgtgatacgtccgtcgtcaagcacctgcaaaaggatattgaaaacgtcagggtgagccttttcgatctcgtcaagaagaactactgaataaggctttcttcttacagcctcggtgagctgaccgccctcctcatagcctacatatcccggaggcgctccgataagacggcttacgctgaatttctccatgtactccgacatatctatacgaacgatattgttctcatcgtcaaacaatgcctgtgcaagagtttttgcaagctctgttttaccaacgcctgtaggaccaaggaacaggaacgaacctatcggctgatttggatttgcgataccggcacgagacctcataatagcctcagacacacgctcaacggcttcgtcctgaccgataactctctcgtggaggatatcaggcaggtggagaagcttctcacgctcgccctccataagctttgcaacagggatacctgtccagcggcagattatccttgcgatctcttcctctgttaccttatctcttagcagagtgttctttgtctttgacttctctgccttttcttcttcctcggcaagctgcttctgcaagtcagccattctgccgtatttcagctctgcaagcttgttaaggtcatattcacgctctgctctctcgatatcctttgagcattgctcgatatcctcacggagcttctgcaccttagagatagcagacttctcattctcccatttagctttcatctcattgaactgctcacgcatttctgaaagctctttctgcacctcatggagatgttcaactgcaagcttatcagtttcctttttaaggacagtttcctctatctcgtgctggagtatcttacgtcttatctcatcaagctctgtaggcattgagtccatttccgttctgatgagtgcgcaggcttcgtccacaagatcgatagccttatcagggagaaatctgtctgtgatatatctgtttgaaagaacagccgccgcaataagcgcctgatcctgaatttttacgccgtggaatacttcgtatctttctttaagtccacgaagtatagagatagtgtcctcaacggtcggctcgtctaccataacaggctggaaacgtctttcaagagcggcgtccttttcgatatactgacggtactcgttaagagtcgttgcaccgatacaatggagttcgccccttgcaagcataggtttcagcaggttgcctgcgtccattgcgccgtctgacttgcctgcgccaacgatattgtgaagctcatctataaagaggattatcctgccctcagacttctttatctcctcaacgactgccttgaatctctcctcaaactcgcctctgtattttgcacctgcgataagcgcacccatatcaagtgagaaaacctgtctgtctttcaggctgtcaggaacatctccgctgacgatacgctgagcaagaccctctgcaatggcggtcttaccaacgccaggctcaccgataaggcaagggttgttctttgtctttcttgacagtatccttataacgtttcttatctcgctgtccctgccgataacagggtcgagcttattctgtcttgcaagctccacaaggtcctgaccgtactttttcagcacgtcatatgtttcctcagggttctggctcgttacctgagcatttcctcttacagcttgaagaactttcagaaactttgtttttgttacaccaaaggtcttgaatatttccttcaaagcgctgttagggctgtccattatgcccataacaagatgttcaactgaaacgtattcgtccttcattcttgaagcttccgactcggcttccgcaaaagccttgtcaaggtcgcttgaaatgtatacagagtcctgcgcacgtccgcctacctgcaccttaggtatatcgtcaactgctcttgtaagagccgcctctatattttcaggggcgatatccaattttacaaaaagctgcggcacaagaccgttttcctgtgaaagcaaagccagcataaggtgctgctggtcaacagcctgatttgagtttcttgaggcaatgctctgcgcttcctgcaaagcttccaatgatttctgtgtcaatttctgagcgttcataaaattacctcccttatcatctaaaaagatatatgctcacagcaggcggagctctccgcccaccgtttaaagaacgacaacgcctttttttagatatccttcatacatttcagatacctttcttgccgccgtttcaggttctgcggcgttgtcaaagtaaagctgaatacagctgtccatacagcttatataatcaccgatagcgttcgctatatcctcgtcggtcagctccgactgaggcggtgcgtaaaaatctcttgtaaatctgccctcggctgtttcataaggcacgccagtagtgaaaagatacgaaagatatttttcttcgagccttgcccacagcttaaaaaagctgtcaagcattgaaatgagctgtgtgctctgagttctgaaagatactttcagcctacccacctttccgtgaaaatctcggctcagctctatgctgtatcgtatggtcggcttatatttatatctcaaaggactttttatagacatcatagcgtcagagggctgattaagggtctgaaacctgctgtccataagctgttctattttagcgaatatctcacgcattcttttttcaggggtgagaagctggacacgctctgccaatatctgatttatcagatttgaacgactggtattcatggaatatgccagcctgtcgatagcctccaccacatcgtctgcaagcaccagactatacacgctcttgttcactttgctctcattcctttctttaaggcgttcccatatggcgtcgacctttatcactgtacttattataccacattctaataatttgtcaataggattatataagtttaattacgaattatatagatgcacaatagaatgtatgttctgcacctctaatttgtgcagttttattgaaaacttgtcaaaagtgtgatataataacagataccaagttggaaaggcgtgataaaaatgctcaaaggcgttatatttgatatggacggactaatgatagatacggaaaagctgctcacaaggttttggtgtgaggcggcgaatcattacggctatccaatgacaaaggaacacgttttgggcatacgctctcttgcagcgaagtatgctatcccacatctgaaaggcattttcggagaggattttgattactacaaagttcgtgcaaagcgcatcgagcttatgaacgagtttattaggcaaaacggcatagaaaagaaaaaggggcttgatgagcttcttgactatcttgacagcacagggctgaaaaaagccgttgccactgccaccgacctccagcgcaccacgctgtatctcagctctataaatatcattgacagatttgacaagcttatctgcggaaacatgatagaaaacggcaagcctgcccctgatatttatctcgccgccgcaaaggagctggggcttgaccctagcgagtgcattgcccttgaggactcaccaaacggcatacgctccgcccacaccgcaggttgcaaacctattatgatacccgacctttcacagcctgacgaggaaacaaaaaagcttctgtatgcctgctgtgatgacctttccaaggtcatagatgtgatacaaaagcttgtgtgaaaaaaattaaaatacaaaaatgcggatacctccacgatatccgcatttatttttcctatctattagtcctcaacatcagaaacagaagacgtgtcagtgtccgtcttgctgtccttgtctttattatcagaagccttgccgcccagatacttttcataaatagctatctgatcctcaacagacttcagctcgtccttagactttgttgtaacacaaatatatgtgtgtccgttatcatcaagtatagttgaaagggtgtactttgcttcgtcggtaaagcctgtctttccgccctcgatgcttatgccgtcgtcagcctcgccgtcaccgtcacaatccacatagtagccctcaattctctgtgcaacaatgcttgtaagctcgataccgtccttgtgctgttttgtctttgaagttgtgtactttgttgctgtaagcacttcacggcaagtttcgttatccatagccgcctttgtgataactgcgatatcctgcgctgtggaataatgatttttgttgtgcagaccgcttgcattcacaaactttgtgccggtaagaccaagctcctggatcttagcgttcataagctcaacgaacttctcctctgagcctgcaactgcgtttgcaagacctgttgtgccatcagcaccgctcacaaggatagctgaataaagcagatctttcattgtaacagtttccccggcttcaaagcctgctcttgatgcgttgtcctcgataagagggtcgatatcatcgcttgtgaacttatatgtagcgtccatatcctgaatattctctgcggctacaagaagcgtaagcatctttgtaagagaagcaggatatacctttttctcgtaattataacctgcaactatctcgtttgtgtcagcgtcaacaagtatagctgagtttgctgtcataccctttatatttatatcctgataatttgcagacttcacaggataattgctcacaggctcttccacaactgatgaaaggtcgtcaacctctgaaacctcctcagaagagctttcctcaggtttgctgttcaccttaacaactgcgtctgccaccttgcttgcctgaatggtatatcttcctgttaccaccaatgccgctgaaccaacagccacaagcattataactataagcacagcaactatagctgcaccgccctttttgtttgtcctcttcatttttacaacaattcctttcctagtgcttatactgcacctatctcctctttttcttccttatgaccatatttcgcttcatactcgttaagagtatcgtgacaatatttaagtatatctcttctcgtcacaatacctataaaaacttccctgtcatcaataacaggcacaaagttctgatccattgaaagaagtatcagatcctcgatagtagaataaacatagacgggtttcattctaacacgtcttgttatctcacttatcctatatttctccagctcacgcatatcctgaatgccattattgagcatgaaccacagaaagtcgccctctgcaagggtctttacatatctgccctcacggtcgataacaggcacagcggtaaagctgtgatttttcattttctcaagagcctgccttgctgtgttgtcatcatagacaaaatccacgcaagccttcggcttcaaaaactttagtatattcatttttatatatatcctcttgtaagcatacgtttttatgcggtaaagaccgcacctataattataccaaaaaaacgcatacaagtaaagcatagagagggcattttccgccctgcgttttcaacaaatctccacgctgaaattgtgcattttgacttactgctgtgcagacttgtagccgtatgtgtaaacaaggctcacaaagctgtcataggatatagtcttaagatcgtccgtctgatatccccctgcactgagatcgtctgttgtaacgcctgctttgtttaagataccctgacaatagccaagcctctgatcctctgacatactgtcaaagtccacaagacttgtcgcctgagatacgtcaaacaggctgtcgtcagcgtcccccgaaagctcgtcaacagtgtattctgaaactgtatcatctgagccttcaatggtaaaggtctgcgtgtatttttttaagcttccgtcagatttatcaaaatacaggtcgatagcagtaatgtacgtgtcgcccgtataagtgtactcctcaatatcgaaatcatcagcctcatcactgtttatatgaccataggttctcggcaggttttgcttgactatgctttcaagaacgccgtcaagctccgtcacgtctgacttgtgataaacaccggtcacgttatcgtaatcatatcctgctccgtcaacatagataaatccgctggtgcctatatccgatgtgactttcagatagatgtttccgccctttttggctcttactacctcctgctttgagccgtcggcctctgtgcaggtcgttttcagagtgtagtcaccgtcaaagatctcagcagtttttttaataagctcaccctgctcgttcaataccttactatccgcatcactctcgttacccttgctgtcctcagactttgcgctgtcggcattgtcggctgttgaaacgttcgccttgctctctgtggcagaagagctgtccttactatcctttgaacagcccgctgcacacaagcataccacgcaagcgcagagagccgcacatattttctttatgtccatatgtaaatatcctttcagaccatgtactatatttctttttcaagacaatactgctcttaacattatacaccccttaaacttttatgtcaagagataaggcagagcgtaaagatcggtgagttatttgctattttaccttatttacgcacataaaaatcacaaaaatcacctatcaatgtatactgtgagttcatgcttttttcacaaaagtctggtataatatttgggtattctgacgaaagagcacctaaagaagaaaaatatatgtgaaagaggaagtaaaaatggaagcaggtctgataatcggaaaccaaataataataatgttcattatccttattataggcgcattttgctatttaaaagggataatcacaaaggacggtacaaaacagttgtcctcattcgcactgaatataatcaatcctgtgcttatattcatgtcctatcagtcaaaatatgacaagagccttgtgcatggtctgctgtggtcttttctgttgtcagcgatatcctatgcagtgactatcttgctcacctatgttcttataagaaaaaagactcccgaccttgcggtggagcgtgtttcgtcaatatattcaaattgtgcattcatgtgcataccccttataaacggcatttacggctcagaaggcgttttgtatcttacagcgtatcttacgttcttcaacgtccttatctggacacacggacttatgacaatgaaaggcgagcgtgacttttcttctcttgtgaaagcccttatctcaccgtcagttatagccgttgtggtcggtcttatttgctatcttacaaatatcagactgccgaaagttcctgcaacagctttgcagtacatagcagatatgaacacgcctatcgccatggtgatagcaggtgcaacagccgcacagaccaacgttttgaaagcccttcaaaaccgccgtatctactacgtttcactgtgcaagctcctaatactccctgtggcaggcttctttgcaatgtggatacttgatcctcctccgatagttcttatgacagttaccatagccgccgcctgccctgctgcaaccatgtgcacaatgttcgctgtaaaccttgacaaggaccctaaaacagcctcagagatctttacagtcaccactatcctcagtgctgtaactctgccgcttataactatctttgccgacagacttacatatcatatttaaagtcagcctaagcaaacatatccatataaacaaaaagacctgtcagcatttcgctgcacaggctgtgaaaagataaataagctacgctctgcaatgctttccgaaaacctcggagagcatttttttatcactctttttgctgcaccgcaggtaattctataaaaagcctgccgcacacactgatccccttcatgacaataccgtttaaagagatttcaaacgtcttgcctttataattttttatccacccatagtatacaccttacttcatcggtgcctcggataataaaagtataacatataattaattcactgtcaatatttctttgaacaaatagcatataaattgtatatttcaataaaacaaccagaaaatttatagcgttttacacaaaattgtcagaaagcattctcaaacaagacacaatttctccgctattttacttttttctgcaaaatattatcctccgccctcataaaaaatccgtatacatctccaagagaagcaaggtcactgcatactgtgtccagcaagttcacgttgaaaagcagcttagggtcttcactgtcaaagcttacaccgatatcctttttattgagccacaaagcgtcctcacggctggcatttggaaaatggtcacgcttatactcgtcaccgaacaaaacgaacttgctgttgtctttcagcgccttgtaagcctttttatattcctgcgcccctgcaagtatcatcgccctcatttcgtccatgctttctctgtcggttttgtaatatccacaaccatagccgaaaccatgggtagaaatatagaaataaaactcaggcatggggtgatattcgcttttgtcacgctggcatttcaaagaacaccacacgctctctctgaatatcggtccgcccttgttgtaacgtgcgtctttgtaaagccttgaaatctttttcggattgcatactatcctgctgtcaatatcgttcattataggcgtgagcgcagtgataagctccgcaaaaggctcttctatgagcctgtgataatccgccttatgctccttgaaccaatccttactatctctcgtatgattttcaaacaaaaagccgatagcctcttcactaaatagcatttttctctctccttgatgtttctaaacttattatagtatatcacgatttgcatttttaatcaagaaaaaagagcctgccaaagcaagctctcttccaaatggattttatgaatgaagtcccatttcgtaagcggttttcatgtgtgcactgctctgcacttcgcccttgtcccacacgcctgtgccgtaaaggatacccttttcaactgccccgtcaagacagtcaagagtaaatccccttatgctctcaactgtcttttcaaggttagcggcattggtatcagccgcagtgagtatataatacacttctttgtttaccatttcagtgtatctcggcactgttctgtcaatgagtgtcttgagctgagcgtccatggtgtagaaataaacaggcgttgcaaaaacgataacgtcagcgttcaccattttgtccattatctccgccatatcgtctttctgcacgcacttgtgagtgctgttgcaaactccacagcctgtgcagtagttcaccttaaagttcctgagaaatattttttccgtcttgtgtcctgcctgctgtgcaccctttatgaactcatcgcaaagcacgtcggaatttccgccctttctagggcttgcggatataacaagtatatttttcatattgtcacctcaaatatcaaagagtttttataacgtcctcagctatctgctcaggagtaagatgattttctttcagcacctcgacagggtcatagcggtcatagaacttcttttcaagaccaaagcaaagggtctttacatcactgtcgccgtaaaatcttgctatcttctcgccaaagccgccctcaagaacgccgtcctcaagagtgataatggtcttgtggtcagccttaaggctttcaagcatttccttatcaatgcctgtgatgtagtatgggtttattacagtagccttgacacctgttttttcctcgataagctttgcggcttcaacgcccatgccgtagaatgaaccaagtgcgataacagcaacctgactgcccttctgtgtcatctcatacttgttgagctttgaaagatcctttgtgaaaggcttgccgtctgaaacaaggcttgcaggaactcttattgcaacagggtgttcgttctgttcaagggaccaatccagcattgcaagatattcttcctttgttacaggtgcaagataaacaagctcagggatatttgatatcatcggtatatcgtaaattccaaggtgagtaacgtcactcatgccgtaaaccgaagccgcaaaaacagctattgtaacaggacttttatttatgcaaacgtcctgagaaagctggtcgtaggtacgctgtaagaacgagctgtaaacgccgtagaaaggctttccgccgttctttgctatacctgaggcaagtgccattgcgtgttcctctgcaatgcccacgtccataaactgcttgcctgctttctttctgacatcaggagtgaagccgaaaaccgtcggagtagcggaggttatagcacacacggacttgtcagcctgcattttctcaagaagataattgcaggtaacagttccgtaatcctcgccctcagaatcgtaaagggacttgcctgtttcagggtcgaagggcatatgccagtgccatgtttccttatccttttccgcaggagcatagcccttgcccttttgtgttacaatgtgaacggcaacaggctttttgctgtcctttacgccctcaaaagcctcaataagcgaagaaatatcgttgccgtccttaacgaaaacatagtcaagacccattgccttgaaaaggttacattcagccttgccatcggtatcacgaagaagcttgagatttctgtacataccgccgtggttttctgcgatagacatatcgttatcgttcacaacgattatgaagttggtatccatttcccctgcaaagtcgataccctccagagcttcgccaccgctaagagagccgtctccgataacagcgataacattgccctcctcgcccttgagatctctggcctttgcaagaccgctcgcaagactcacagaagtggaagtatggccaaccgtaaaaaagtcatgctcgctctcctctgggtttgtgtagcctgagatatcatcgaacttgtcagcgtcaaggtaggactcctttctgcctgtgagcattttatgtggatagctttgatgtgaaacgtcaaaaactatcttgtccttaggggactcaaaaacatagtgcattgcgatagtggcttccaccatgccgaaattagggccaaagtgtccgccgtgcttgctgagcctgaaaagcaaagcctttctcatttcctcagccagcgctgtcatttcatcaacagtgagctttttaacgtcatcaggtgagtttattttttcaagatacattttcatttcctcctattttacttataatttttcttagctttagcttacttatattgtaccacctggagttagctccaagtcaacaggttttagagatattttacattttattaacaatcgacctagcaaaaaaagcacggtcatgtgccgtgcttagtatatttctcttgaaaaaaattaatgccgtgctataattatagtatcaccaatatcacaccggaaaggtcttgaaagcatgaaatacaaagttatagacataagtgaagaggattatgggtgcgagggcataccggaggacagcgaactcatgtgcagtgttttgattgaaagctctgacggcacacaaaaatggttgaaaatagctgaccgatatctcagagaaaacgacattgatataggcagtgtcatcactgcagactagcctgcctcccctggaatatcacgcattatccacgcaagctgttcttctgtaggctcttctatctcatagccgttgacatggtcgcccttgaaacagttttgatacagctccacccatgcaaatgttgacagtttgcaatcagaatagatttctttttcacctttgtacggcagatcttcaggatagcaggtcttgataataggatttccataaggggtgcagtcctcgaacttatccttattgctcccaaaagtgtctttacagcacactcccctcaatgagtatcttgccacaagatacttttcaccctcctcatcagggttctttttaaacgctatctgcgccagctcgacaatagcttctgcggcgtatatagggcaaggaattaaatatccgttgtgaagctcaaagatcttgtccttgtaatgaaaagtctttcgcttttcgatagtgccatattctgcatactgaaaaatattcagctcaggggcatcggagtaatagtcggtgacaatttcccctgccttactgcggaaatagcgttgtttctgcgcttcaagatggttcgattccacattttcatcagaaaaataattgtgttcaaattcgtcgatatcctcagtaaaaaacgaagctgtaccgcttgtgcatgagggaaagttggcgtcaaacaaggttattttgtatatcatatggatttcctttcttagaagcagtgccaagcatttcggtactgcttttattatatcctattatgttcccgttttaggtaaacaaagctatttttcttttccgcagagtgttttttaaacaaaacttagctgtctattcattgaaacaaaatcaagttgtttatcaggctcggcacctgcattgtttatttctttatctgtttccagatatgacctgttactgtattccgctttacgcaatttcagttggtagatcaagtcaaagttctttgttatagagtcctgcttgagagcagaaaaacatattgtctgtagcttgaatttgttgactatcttaataaaaacatcaagcaaatgggcagatgatgtttcaccaaatggattatctatcagaaaaatagatctcacttcgtcattatcgtctatggtctggcgcctccttgcatatgatacaagtgctgtatagaccacaaaataaacaagaaaatgctcgccaccggaataacgtgactcccacctttcaagcctgctgttgcgctcatcctccagacttttccacacttttatttcaacagaattacttcctgtgatagcattaaaaagcagtctgtctgaaaagaatgaatttacctgcctaagcagatcatcaccttttatttcctctgattcaaacctttttctcagtctgataagtgtatcatcaataacattgctaactctgtcctgatatcctctgtcaagcttatctggtatactgatctgcattatccttttgtttttgccatctattttaatataggcatgatctgcaatagacttgacctgttcatacaaaaactcagcgtgctttttcatatgtatgattatatggtttttgtcattttcgatctgctgaagctgtgatgacaaaactttgatactatcgtcaagcagtttcctttgctcacaaagctgttcatatatcttgaaacaatcaagataacttttattgttgtcaatatcgataaatgaaagcatttgagatatccactctgcattttcagcatagcagtcaagtatttttttatactcatttgctaaattatttcgctttacagtgacagcatagttagaattattcagatcattacgaagcttttcaatatctatcttgtcatcgatcggcttgatagagccggcattgaatatcgtatcaagatcaatgagtttttctaacttattgaacattgaattcaactcatttatctttagatttgcctttttttctgcttcctcggcgttgttcttattctcatcatttttaatttgactcgcataataattgcctgttatctgagataatccaaggataacatcaaagccgcttctgtgtatttctttctctttattttccaaagctactttatttttctcgtattctttctcctcgcttttcttgttgtttctacactccacaagtttttcataagtcatacgctctgcattttctaaatctttacgcttgtctacatcaaatgtgatatcatagtcctctatagtcaggtttgcaaaggactcctttaacctgttttgattctcatttttttctttttcagcatcactgcatatacgttgctgttcacttacactaccttcatgcaaggtttgaagttctttaaattctatttcaagactgacgatatctccgtctatctgttcattatctgaatatatagcgaattcagccaccttgtcttctgatgaacttattttaggtttgatagtttctatattaatctctaatttatttttactttctgataacagatgtactttttctttattatccttgatagaattgctaaccgcttcgatatcactcaatgcttttaaaagagcaactctattttcagcgtcctttgccgccgccttaagatactcatgatacttatcatctcttctttggcaggtaataagtaatttttcattctcacttattgcatcgtttgtatcttcaagttcgtttgcaaggtgatccttgtttcctctaagagtttctctacgactttcaagcttcttcagatcagccttagcatcatctaaagacttttctatttctctgctatccgattttgaatatccaaatgactctatgccccgcatatcatcagatattttactaagcccatttttcctctgagatatcttctcgtcgagttcagatatcttatcttcaaggttatttttatacctttctcttgtcattgggtgcagactgtctttgttataaaagctgtaaaacttgatctcaccgatctcagcggaacgttctgaagcttccaagttcatgtccaatgattttctgcgaataacaggacacactctgtcaactccaaagtcctgagatatctccaaagtcctatcataatctttatcatttacgataaaacaaaacggcagaagcggatttttgttaagcagtgtatcaaaataatcgccctcctgtcgcttcaaatagctctcaccagtctgaaattcaatgtcgtattgaataagaaggtctgcaaattcaggagatgtatgcagctttccgtgaacaaggtcatcaaaagtatcttttaggcgatctctctcctttatgtccttttgataaatggcttcaatattatcatatttctcttttaaagatgcaagattttcttcactttcatataaatgagtgcctgaaatatcgtatctgctcaaaatttcagcaactactgcttctgcatttttcagcgcatcatatttgttttgtgcgtcatatacttgctgacccttcttgcttatgtcagacgagatctgttctagttcctgagcgtttgcattacgcttattttcaagatcattctttatatcgtaaagcctttcctgttctgtttctgcacttttaatagctgaaacaatatgatttcctaactcgtcgatactctcagccaccaaattacccgtaagatctctgtcaggaagttcaccgatctgctctctatattcctgctcagctgaattaaagttgtcacagcgctcctgtaatctgcctttatcaatattcaattttgaaagcttactatcaaattcaccgagcctgttattaagtacatttatctcattacctttactttcaaactccctttttaagcgttcttgttctgatttcagactgtttgccaacaacgaataatgatgataaatagttgcgccaagacagttttttctaacagcgatctcaccttttcccaatgtagctatagtatttcgggctgcaactagcttactttctgcggctttgaccttttcataatattcagcggcatgcatacaatctcttttatattcagcctctttatggatttttgaaaggtcaggcaaaatagtatcatattcttttagcttatcctctgattcatcaagtgatcttttaatgccatgatactgttctgaaagctcctcatgttttatctttttctctatttctttgcatttctttatgatctcagcagcctcggccgatttacgttcttctgcttctatacagctttttaagttaattagtgttcctgctatatatttttctttctcctcttttttgtcaagttcttcggtatattctttaaacatatcgctaaacgtttcaagatcacccgacacattttctaagagctctttctccgcaagagccttgccaccttctatcataggttttataagtgacgcagtttctttgataaggctttgacgctgatccttattcatatcactcactgtctttagtatccattgatcaaataattcatcggaagtcttgcacttatcaaacagtccggctaatcccttatcgccttcatcctgattaacttttgcaagcaatgcccattcattctcataaatatgatgtttcttaagatattcacgataatcttgctttttttcttttctatacacattaaatttgtcatgactttttttatattttttgagcctttcataaaactcattataggtataaaatacattctttccgtcacgttcttctgaaacattgatatttttgatatcaaattcgttgccctgatcatagtcatgaacaaaagtaaaatatttcagcaccttgatatttttatcatcatcacccctaacgttagttttgctcaaacaaatgcctgtcataaaataggacggcttctttgttccatcaagcatccattctatcatcacatatgagggtttctgatctcctgtaagatagtcagttatcttccaaccatcgatatccatacctggaatgatcggctgaaatatcgtctcgatcatgacggttttaccgccaccattattaagattcatcaaggcgtttcttccgccataataatcaaagatactgtcctttattattcgtccgtcataaaaaatattaactattcttatacgattgatcgttggcattttcgtcctccttttcaaagagcctgtttatttcacttattcttttatcactcagataataatttttcataaggtctgacaacctttttctgcatcttatctcatcttcatcatcagcaaagatcacaagttcgtttctcacaagtatcctgcaagctgtcttaacaagctcgatcttgctttgctttcgaccttcacctttatacacattcccgttccacttatcagctatcttatgaaaatcgatctgtgcttcctccttttttgcagccttttgttcatcagaaaatctttcatcaagcttcaaaacaatatctcttatacgaagcgaatttgtcaactgtggatcactatttctacctccaaaaaacatccaaagaataaccatgataatataacattgcaaataagcctctacctttttggcatttgttgcaatactttctctgaaatccctaaaacgcatattgaacatttcattatctggcagtggaacgatataaatatcatggaatgtcctgacaagggtgaaatcccactcttcactcattacatcaagttcttctcttatatcctcacgagatgccagatcaaacaactcagcatcatcacgatcatttatagaattgtttattataaggtgttttaaaattctcatgctttcacgcatatcacataacctccgctgcaaaacacatattgtcgatctgaacggtttccttacatctcagtcccgtttcttcgtctgtatattcacatttcaattctgtcctctcacctgaacgggttataaggatacgctttaccccatagaaattttcgttatgagaacttatcttgagcaaacaataggacaggtcaaattcgccttggctatcctccgttttgttctcttcattttcccatttttcagtatcaatcatttcagttgaataaaggtccagcatgataagaaaaaagcacttatccctggcaataagacttatatccgcattttcaagacagtattcccaaaggtctgacaggctgaatacttttctttgtgatgcaaactcaaacataagccttattatctcggtattagctttattcttcctttcaacttcctttgtgtaaggtgaaacttcttcaagactatcctcatcctcttcgatctctccgtttacttcttcacttgattgctgtggctcataaacaagtcttagatcgaacatagctggaagttttggcagcacaagaggttcgatcaacttagcacatagttcttctatatccagcttattattgcctttatacttctccagaagctttaaaataacatcttctatctcataacaatgcgtcctgtgcattgttatggttttcaagagcatttctctgtacaactgtcctagttctctgctgtgacttaaaagttcacgttgttttacaagtattttttcagtattatttgagatcataaaaatattacgcttcttgtccgctaactcattttttactctatccgagaaagcattactatccgaaaagctttctatcgcttttccaatagttttcttaatgtcactcataacggcatactcgtcatcgagcatctgctctatttcatgaataagagtatcatattcttctcctgaagtttcactaagatcatttttcattcttcgttcaaaaagagtaaggtctatctccttttgattaagcattgctaaaagccgtttgctttgcgaagaagcatctgaaaagttgcctcgctcaataagcttatgcaatcggacctcctccaattgaaaaccaaggtcatcgacctctttggtacgaaatagcatatcaaatccctgcttttcaagcacataatagataacgccgtcatcgtcctctatgtcccttataagtctaacagaatatgatttgatcgtaagatcactatgatccattattttgaatttaaagctttcccctttgttttgaagtatgtccttgacaatgtatcttgtcaactctcgcaattcactttcatttatttccctattatagtccttaaataattctgcaagaaaatcttctatatcttcaagtgtacaacgaacgtttgtggtaagtgatcgttccataatatgaacaagcactgcaaatataatattatcaagttcattatcaccaaagcttgcttctatagcaagatttctatttcttctacaaatcacggaagctatctctgagatatgttccatacggctagcaaaatcagcaagatatgatatcatttttcaccctcacaatatacataatctttcagcactttatgattaataatttcctgcggtatataatactcatcataaagcaatagttttattctttcagctaccttgtggtctatttttttatagaattcagaaatgttttctgaatgtttctgattagtgtgacctttaaggcgagagttgttatttcctgataacaaagtctcaaataattctatcattttctcatatgccgctgaaaatggtaaaatatcaagctgtggagaaacgtttacaaacgataggaaaatatcaattccttcattatcgatatcaccccaataccacacttttcctttaaaatgcgaatcaatgttaagatagtcctgtagcgaattgtttctttttgtgacctttctaccctcaccatatataacacagtctatcttagtgtcaaacagccctataaaattaggattatgaagcattatttttctgacggtaaaccatgtatctttattttcaataactaaaacatttttaatgttttttcttattctgtagtcaagaaatggctctggggttgagtacgtattcaaaatatcaaaagcattacaattcttcaataagataatattgtctttaccgtcctttttgtccaaagctttttcgtcattccagatttgatatgccctctcgttttctgacaatggatacaaaagatcgtcgctgtgtgctttcaaaaaggcatctaatgtgagaataaaatcacgatttttaatatatttttccatattctttttaaaagcatcagcatctattaaataatgaagagaattcaactcatcaataagcattttatctgtgataaagtttttaatgatatgatattttaagaacaagctgggatttaaaccatttttaccgctcttatttactggtttaataacgcctctgctgatcaaactatttatggtctcgaccagatctgaatattcattaagtttaatgagcttttttaattcgtcaagctctatttttttgtaaggatattcataaatacttttaacgatctcattcattttaaaacctcataatataaaaaaattactactatgtatattatatcacataattttagttttgtggtaacaatttttggacagctaaaaatattttcaaaaaaataagcagtagccgtacaagcgaaaaaaagacttttacacccaaaatgagcaaactgcgcaaatacgcagtttgctcattttttctttgttattgcaaatttgatgcttttcagatatttgtttagattttcctgtttgacgttcacgtgaacgaactgaccaccgaaaatgttttgaatcttaatgagatccccaacagtttcataattttcagagatcaataatgaactgtactcgttgcctttttcatctttttttatgatatattcattgttacatgttgacatgttcagcctaatattacccttggcgatttcttcacacccgaatgaagcaagtgcacgctgaatacgttcaactgacatttggtcatcacctaattttagttctattagccgtattatcagcaaggctacgaagcatatcataaaatgtgctatgatatgttcatcagtgtgcacaaacataggtcttgcattcaggtcgcttttacatatcctgaaactttcctcgattttagataattctccgtacacctcgtggattttgtttctgtcataatcaagttcagatgtcacgatgcagaagaatccgtcaaactttgcgtcattttctgctttctcagtgtcaactgctttgaccactttatcagataccgctcctgtacttgaatcgatatgctcttctattacataatccgttgcatcatgttttaaaccatatgcgttatttgcaacgtatttttctgcttttttcagtttcagttcacgcttgtgtgcttcccggtctgcaattgattttttccagtaaataagaaacttggttttatcaatatcacttgacacattttattcgaacaagaattatgcaacgagaaagatatgatcatagtagagctttcttcgggctgccggaggcagcccaccgttgtttctcaaaatatatgcattcgagattatcagcaaatagacatgttctttcttcattattcagttttcaagatgcagttttgacacatttttacactaaaacagcatagcaagtttattcatgagctttctttcatgaacataatcagggtggacatacctgtttagtgtgatatttaccgttttatggccgagaatcatagaaagtgttttcacatcaaacccgttctgaatgcaatttgttgcgaaggtatgtcgaagcccatggtatgtgtgatcaccggaatttgattccgacagaacccttttataccgatactggtaggcacgaggttcaactatcttttcacttcccgaaagaacgtagtagttatcatcgcctttaaatgccatgaaatattctgctaggaactccggtattgcgatctctctgaatgatgtatcgcttttggggacggagataataattttcgtttttttaccgtccgaattgcaggtgcagattcgctgaactgtacggtgtacatataatacccgattctctatgtctatatcagcccatgtcagaccgcataattcgccgattctcagacccatataaagtgagatcaaaatccccagacctgtaagggtcatatgttccttaatgtgtgagataaggactttctggtcattatcactgaatttttctactttcttcttttctattttgggaagtatgacatttttcagagaaaggctgaaaccatactcttcctgtgcatatataagcatcgacttaaaaacggttataatatcttttatataacttgcggagaacccctctgaaagttttttgtttatgaaattgttgagcttaactgcgtttatatccacacagggaatgtcgccaaattcaggaataatatgcttttcaaacttgttgcagtaattgacaaatgaggattctttgacacggttggcgattgcagtgatccattcccgatatacttccaaaacgctgatacactttccactctgaaatcttaattctacttccattccaatttgcacctttttataagcatcatcataggtgtttccgtaaacatattgataaacagctttgccggattcatctctgtcgatgataaagcgtcccatgaatcttccgtcttttcttttggtaatacaaatatccaacttactcgccttcactttctattgttgttatcacacaatatttattgttcaaactatacagaattaacaaaattaacaaatgcacaaaaatacattgaaaaaaatcgccgattatggtataatatgaataattataacataacggaaagtcatgaattaatcattaagaatgtattttttgactgtttctcgaatgcatatattttgagaaacgactatacagtcaaaatgctcatttgttgcttgatattcaagactcgtatttatccaataatacattagttttcctctatcatcaaagccgtgataatatcgagcataatatcgctgtcgctgataacactgcacaaagccttttcgccacgaataatatttgcataggtgtgaaatcacccctggctgttttgcccacgatgaaagtctatctgatattgctttgaacgtttgctccccttgtcaagccgtgccaacacttttcgggggatattttctttttgtattaaaattgatttttcctcctctttctaaagttcgccattaacattttagcgaaaatgtcacaaactaatattagcgaaaatgtttggaggtgttattatgatcactgcaacagtaaccgatgttcagaacaattttggtcattatctgcaagctgttcagcagggtaacgagatcattattcttaaaaacggtaaataagtagtcaggcttgttttccatgaatcaagtatatcttttcttaccgattcactcacaagtgttcttaaacatgattatgatgataaaacaatccttatagaaaagaaaaagcacttcttggtgaccgtcagatgacagccaccaaaaagtgctttattaagtattcaattttagacacgaaaatagtggacagcacttcaaaaatttatgaaacactgtccgctaatgaagactatttatttgttgtcaacaggctttctatcagcgtttttggatttcccaagttttcaggttttttatcgtttcaaccacgaaaatccttgatccttcgggctttaaatgctccttaaagcctaccaattaccactattgccggatagggtcaacaatatcgtatttctcaaatttgtcaacataacaaaaccgccgcagccaaactcggttgcggcggtaattttatctgctatgaattattgttcttgctgtaatactctgtctgcttatcgtagaccactttcggcgtataacgctttatagccttgttgttcaccttgatgtcaagcttttctacccagcttgttaatttcttctgaaattcatcgctcttcatttcttttagaagatcttcatgattgtccttggcatattctgtatctctgtccttaacatcgcccttgataagaatgtaatatgcgttatcatcctcataagctgttgcaacgtctgtgctcataccgcttacttctttgagtatcttgccgtttgtagtgtctttctgtgaatcgtccatttcaccatagttcgccattttctcatttgcatacgggtcaggtgcagaagaactgtctgcggaagaatctgtgtctgacgctgctgtgcttgaatctgctgtgctgtcagaaactgaagatgtgtcatcgcttgctgtggagcttgtgtcgctctctgctacagaagaagtgtcgtcagaagtcgtgctgctgtctgaggctgatgaatcgctgtcagtggcggagcttgaatctgcggctttctttgaagcaacatagtcgttgtactcgtctataatgctgtcgaaatcgtcaaacgaaacgccctgagccttttcaaggaactcatctctttttgccttggcttcctcatttacagcgtctgctgagtctgtagaagaatcggtggctgatgatgaagaatcagttgatgctttagtttttgcaaaggaaatggatttatatctcaggtagttatcatcaagatacttcaccatttcatcgtctgaaacggcttcctcgccgccctctgcatagtagtgatcaaaaagctcttctctcattttagagcctttgagtgcaagctttacagattcctttgagataccctctgactcgtaaaactcgccctgagaatcccatgtgctgcttatgctgtcattaatggactttatatcctcatctgaaagagtaagtccaagctcgttgaacttgtcaactacagccgcatactccttagttgcagtgagagcataatctgaaagatactcgtcaaatgcctttccgtctaccttctgatcgaaatagtcctttttgatgcctttctgataatacatcatcgtcatttgatatgacatttctgtaagctcattataaatgtagattcctgcgtttatcttgctgtcacctgctgtcatcacatagcttgtgtccgagcaagcggtgagactcgcagtacaaagcaatgcggcagtaagagcagccgttatttttttagctttagccattttattatccatttcctttccgagaaaatcgtcttactaacaggcagaaaaccgccttaacttttacattatactacatttgagcctataagtcaagtggatatgtgtctctcacacgcaaaaacggacgatcactgaccgtccgttgtaatacactgatattttatctattgctatttcctgtttttatgtctttccaatttacttgcgtacattatcttatccgcctgtgtaaacatatcttcaagctcgtggatgtctgttatatgtttacaaataccgcctatactaacgctgacctcaaactcgttacctgcaaacttgttatataccctaagacggtcgttgacccttgcagaaaatcgttcaggatagttgtcgttatagtcgttacagcctatcaccacaaactcatcgccgcctatccttgcgcatatctcgttattttttgtcgatgccaaaactgcgtctgcgatcgcttttattgcaatatcaccgcagttatggccaaaattatcatttatctttttaagacagtccagatcgcagacagcgataaaagccttatttttcggatttgacattctgtcaacaacaaactggatatttttctcaatgcctattctcgaataaacacctgtcatagcgtcacggactgcaagattagctatagagtttcgtatccgcattgattccagagcattgcttacatgatttgtccaattacgataagtgatatctatcgattttatttcgtcaccgtaagacaatacagcatagccatagcaccgatctataaaatgtaccggggtgataaagaatgcacaagggctttctcgttcttcatccagatcaggaaatatctctttgagttcaaaaggatcatgaagagttctgcttttgccgtcaacgtttcttatataaagcaccatattttctgtatattcctttggaacagtggagatctcaccgactatctcatgctctccaaggcaatcctcattaaggcagagataatatctcttctgaccaatgataagatagagaaaatattgtatcctggccatcagatcatcgggatctttagagcaagccattatatcggtcatattgctgtccaaaaagtcatgataattcatcttgttctgagatgataaaagatcacgctttgtatagctgtaatcctcatgacagccgcaggaagcacctatctccaccttgccgccgtcctctataatgccctgcggttcaacgcctttgatccttgcctcaatggtcattactgcgttcacgccagtttcaaagatcggcggtgagcaagaggttatagctggcacgcaatggatagcctcgtctattgcgtcataacctgcaactatcatatcctcaggcacgctcaaaccgtttttctgatattcatgtacaacgcctatagccatataatctccacagcaaacgatagcgtcaggctttttacgtctgccatagatgatattatttgccacctctgccgctttgtgataccagaagcctccgtcaaagcagacaaagtccggatcatactctatgccatgcttttcaagggcacgcttatatcccgcaagccgttcacgagtggtggcagtctccagcggaccgctcaaaaaaagtatcttcctgcatccatggacctcgataagatgttctgtcaattgcataaagggtttttcgtcacgggtataaatactttcatagtccttatagcttccatctataaaaaccacaggaacatgacatttctcatctatatccctgcatattttgtcaaaaagcccaggcatttttaatgtatctgccaaaacgataacgccatcgagcttatcataatttataacgtcatatatctgcatttctccaacagaaactgcttttaagaatgactctttgacaaagcttgtgaagataagcacatcatagtcaagctgaaaagcctttgtcattacgcctctcagcaatctttcctgataatagctttctgcctcagacaatatcactccaatgcgttttcttcccaaaatgtctcaccttctctataatgtcgcatttagacgcactgcaccctacagtcatttaaacattataccacatttgcctcgagttgtcaaaggcattttgtgaattttcgtaaactttttaacgacttttttatttttgtggtaaaaatattaagctgttttcaatattaccaatacatatatttgattaaatttgttataaatcaactaaatgattcacttaatcgttttcgagattgcgaaaattttcggtaacatgttcatatagaaaataaaatgaaaacttttcagaatattgttaataaagcatcgcagagaaaacttttttacacagtacttctaaataagaaaagaacaaaaaagtttcaaaaatgtcttgacaagtaaaagatcatatggtataatattaaagtcgcttagatagtgtgacacatataaaaaaatgataaactggagaagtcgcctagcccggtttatggcgcacgactggaactcgtgtatgggttaatagctcatcgagggttcgaatccctccttctccgccaaaaagtctcgtaaacacgttgtttgcgagactttttattatatgcagaaggtaggataaaatactctggaaaaagcgaattggcgacggaaaggcgacgtaataggataaataaaatataggcaggatacactaaaatacggcaggaagtaaaatactccctgccgtatttcgtttttaggctgaaatatcaggaacataacacgattgtcatagcagaaatgcggcgattttgtcaaatcgccgcatttgctctatgctgctcgtccaaattggactcgcagagaaatatggaaaggagcagccttgtcaagcaagtctgctccactcgtacaagcagtccaacgtgtccgttgaactgctcaccgagatgttctatctactgaatgtaattctttatatagttgcttattaaaaaagtgaggaaaaaaggaatttgggaattcaatcatctacatcacaacgttcatctaaattttcaaaaaagcacttcacaatattctgagcagactcaatctccttagtcgaacgtccctgcataagtttcttccattcattaaaaagaacaagctcattctttggcaattcgccaaacagcaaatggtctgaactcacttgtaatatctctgcaattcttataacaacgtcagtacttggatttcttttgtccaactcaataagtgccatatagctttcacttataaaagcacgttcggcaagctgagcttgtgtaagtcctgcctgctttcgagcatttcgtattctgcttcctatactatccatatatgcaccacctatctactatataattttaacattatttcttaaagtatttcttttcttatagtaatatagagcttgacaaatagtaaataaagtggtataattaatcacataaagtaagtttgtgatagaactggtattagtataaaataaataacaaaaacaaggtggtgatatcaatgagtttttggtctactctagaaaatcttctgaatacaggctatgataagtacaccattgtcaaagataaggcgatgatagcctatgataagaaaatggctaactatgacagatggtacagatcatttcaatcctattccaaagatagcttaataaaagctataaaggatacaactaacccatatgaaatgagaaaagcggctcatgatgtatatgaagaaaaatacggaggggataattaatatgggcgtaaatacttatgaggtttcacaagacggaaaatgcaaatgtagtgtatgcaggaagaattttgacctatctcagattgagtgctgtgcttattgtcaaaaatgggtttgcaatgcacataaaaagaaaaatccagatggagagggatatgtttgtcctaagtgctatagtttcctgatgaaaatgaagaaaagaaagtagaggttgataacaatgacacgatttgacaatgcaataataggcaatgaccacccatattccgacacacctaaaggaaagagtaaaggcaaaggaactccttttccaaagccccagaagccaaagggtaaataaagaagaggtgattattatgaaatataatggtccagaatacgaagacgataatgattactacaacgattcaaattttgctgataatgaatacttagaagattacctaagttcagaagcaagagatgaaggtgtttcattttctgattatgagtacaacagaagagttgatgactatggctggtcatcagatgatgtagacaacggcgatgatgattaaataacaaagatttccctatcttacagcaatgtgagatagggatttttttatttaggagcaaacatatgataatactaacaaaaatcaatcaactagataatatcgacacaataacagacaaactaaaagcagatatatctcagtcaatatcaattctgaatacagcatacggagttgacagagatgtatataacgatctcggcggcttctgctgcatagtctcaaatgaagatgatataaaatttctgcttgataggtggaacgttgatatactcaacgatataagcgaagtgaccttggaaatagacggatacataaaaaagcttttcatcataagttccgactatgctattgttgcatacataaaagcaagcttgatagacaaactcaaataaataatgagctggtctttttctttgaaaggaggttttctaatgggctattttgtggcaggctttttcgctactctcacagttcttgttgttgtcgatacagtactgtaaaaaaaatttcattgcgattggaggtgagataatgatacttggacttataagctccattgctgcaactgaaagcgttgcaatgctcatagaaggttctgcacttgcaataactacattctatgctgccaaaaagggcaaatcagtaagaagaaaataaatccaaaacataggggcttgcttatgtgagtccctttatatgttccgaaaagaggtatacagatgataacagaaaacagtaaaatcgagaatactgtaatattctcagatgataatacacatagatatttactatcaagaatatggaacacttcaaaggaagtcccgttgttcataactaaaacagcaggacaagctaatggagttttgctagacttaactacaaatataatctcatcaaatttgtataagcttggatatggcgttttctatgcggtcaacctatgctctgccatagatagtaaagctgaacaactctatgataaagatacagacataataatcaagaaatatttgaagtctgtcaatgaagtgattattgcttggggtacactaaccaacaagactttgaaaaagcgagaagagtatgttcttgatatgctacacaagtccaataaaaaattgttttgtgtaactgataatctaggacatatgaacgtacaccctttgaccccttcggtaagaaaagatttctatattgctgagttcaaataatctactacatacagttgttcttttctgctgagtccgtggcgagtttttcaaaacttgccgcaactactcagcagaatttttttgaatcataaagatagaactttcctatgcggcaagtggggaaaaacgagctttgaggactcagcagagcaaaattacatctccttgatacaaaaagtttctttttcaagtttgcaaaagaacaatactatatggactaaaaatccaattttttgagaaaggaggtggatattttatggactcgtataaaattgaaaggataactcaagagaaatacaattcctaccaagagcactctttctttcctgccataattgaaaatgattccttgtggcttgtaaaaaggtctgataaagacaacagccgttatataaagatctggatatccgtacagcttgaagtaacacaatacttaaaagacgaggataccaatgaaaagtttcttaatataacagctaaaacaccattcggcttagaagaggaagtaatatctgcagactgtctgaataaaaaagatattaccgaacttcaaaagaagtggttcttcaatgaagcatattcagacatcttgataagatatctgatacaagcttctgaacaagctccccgtgtaatactctacaagagcataggctggtttcaatataagaataacctctattttagaacaaatagggttcttcataacaaggaacttgcaagccaatttcaatatgcaggagatttgaaacttgacaataaaatatcctcaaaatcaatctacctgaacgcactaaataatttgctgacaacagacggaagtatgttcgcagtagtcgcaggtctatcatcagctctcttgagctacttaaagctcacatactcaatggagaacatcttgatacacatctatggagacagttcaagcggaaaaagcacctttttgaagcttgcactttcaatgtggggcaatccaaacgagccaccgctcttcaacgagtggaactcgacaacgaacgccatatatgctgcattgtccaacaatcaaggcataacagttggctttgatgaagcaagctgctccgcactcgactattccacgctgatatacaacctctcacacggaagagacaaggcaaggtgcaacaaagactcaagtctaagagagtccaagacgtggtcaacaacgatcatctcaacggcagaggaatctctgctcacgaaaaccaaaaagaacaatgggattcgtgcgagatgtttggagttcgacaacttgcacataactcagacagctgaacacgcagagaaaatcgacagactcatctcacataaaaatgggatagtaggagaagattttgttagctatctttatagtaaacaacctcgcatcgtgttcaatgacttcaagctatgtcaaaaatatttgtcgaggaaacttcaagacaaagcttgtcagataacagacagagtaataaaacactatgctgttcttctacaaacggctctatacgcattgagaataggcttgtatattgatactcattcaatagtcaatgttcttatgaaacagcacgaatacttgcgtgatgaaaccaagacagccgaaagcctacacaatgcgatatgtgagtatatagtcacacataaaaagctatttccagaagcagaggaattaagatacgacaaatctagtccttgcgagggtataacgactgagacatcagtactcttaattgaatctgtcttgcaaaaaataatctatgcaaataacttcaccgatatgaaaatggctgtaaagtggctgtgcaaagaaggctatcttaaaaagcagtctgggaagtactatctgaaaagaacaatatcaggcgtatccgtaaaagtatacgagatattgcaaattgatgacaatcccgaacctaaaataagagaaccacctaagttcccaggaagaagagtacaaaaaaagaatgaaatcaacgaaacaaaaaatttgaaaggaaatgaataataatggttataccaaacaaagataatcttacagtaattgactcatcaaacaatagctcgcacggtaaaggtacatacagtatatctatcgtgaacacaaagactaatggcaaaaggataaagctttcccctgcactttggcaggcacttgactgtccaacgaacattaacattctgatagatgacaagaacgcttattttgttccagatgagaatggaataaaaatatgtgacggaggtattatatacaatacaaattcagtcctcacaataacagaaaagttcaagatcgactactcaggagtttcctcaaagagcttttcggcaaaattggaaactgatgataacacgaacgagaagtttgcttatgtgaacttcatagcctaacttcaaaattcaaagggcagaattttttgttctaccctttgcttaaaaatcacttactaaaaacgtagtaaaaactctttcagatatatattataatattgcgtggtgaaagacgtactactttatataaaaggagcaaattattatgacgaacaaaattgaaaatctatgtgatatactcacacctcaagaaatctcagagttcttaggtatttcctatagctcatccctcaaacttataaaatataatatggtctatttaaaactaggctctagatacagagtcacaaaggagaacttcctcaaatttctacaaacatcaacaccgtcacaggcaacaatcaataaataacaaacataaataaagactattccgacctaagcaaaatcattttgcttgggtcgttttcaattataatgaggtgacaatcaatgagtataagaacaagaagaaacaaagaaggaaaaataactggctatcaagcaatagttgagagaggtgagagttccacaggcaaaagactaagagacaccaaaacattcaagacgaagaaagaagccgaagcctacatcaatcagacaaagagccacatactcaacggcacatacatagagcctaataaaatgactgtctcacaggcacttgacgagtggctcgaaacacaggtcaaacctacactagcccctgcaacagtaaaatcgtatcaatataatatcaaaaatcacattcgtccagcattgggaaatattcagctccaaaagctcacagcaatgcagatacagaactttttgaatgctcttgataaggagaagaacttgtctcataggtctatgaagtatatttgcgataacctgcatagctgtttgaaatacttcactttcaagaaaatgttgtcaacaaacgagtgcgattttgttaaagtacctaaaaagaagcaaaagcctataagcagtttctattccatagatgagataaaaacacttatgcaggctgttcagaatgatagattaagaccagttgtctatctaggcttaatgtcactcagacggtctgaaatgtgtgctttgacttggagcgatattgactttcaaaataatgtgatctcggtgaataaaaatcttgtctacataaatggcgagtatataatcggagactgtaaaacagaatcatcaaaaaggcaaatacaagtaccacccacaataataaatctactgggcgaatacagaagataccaaatcaaagagagaatgtattgcaaagaggaatatatagacagagatctgatagtctgcaaatacaatggcgactatttgaatcctgccacactttcagcaaaattttcacagctattaaagaaacataatctaagacatattcgtctgcacgacctaagacattcctactgctcaatactcttgaacgacctgaatattccagtcacaatagtgtctaaaagtgcaggacacgctaacacacaagtaacgctgaacacatattcccacgttgattcaaaaatgcagaagaaatctgctgacgcacttgaagagaacgtattttcagacataaataaaaagctaggctaataacaaaggaacagtccacaatgaactgttcctttgttctaactcttaaaaaggcttatgtaattcgttcgaccattgactattctgtaaatcagaacattgttcacagttgtctgaaccttataaagaatgatataatcttctgcaacaagctttcgcagacctttctttgaaaggaattcatcattgataagaggtgcaataaaaggctgtgtagaaagattgctgatagattggtctatcatcttcataatacgagtagccgcttgtggagcgtacaattcacttgcaatgtaggaaaaaatcctatcaaggtctttccttgcgtgggcggtgaacttaatgctgtatatatcagtagccatattttgccctcatttcagaaaggacttcctcaccgtcaaatacattgccctcttctacatcctgttcggcttctgcaacgagctgatagagatgaatttgctcaataagtttgtcataagcttgattggacataactaccatatcactataaccattcttagtgataaaaacaggttcgtcagtactgtgacaaagctcagatattccgcttgtgtttttcaaatctttgataggaatgatttttggcatatatgacatctccttacatcttactatggcttaattataccataataatttcaaaaagtcaagttctgctgtgcgacctgcggcgacggaataaaatgaattctgaatcagaacgatcaagacaccataagaacacaaaaaataattgacaggcaacattaaataaggtaaaataaatctaaataataataaaacatcttcaaactgctgtcgagtgactggaactcgtgtatgggttaatagctcatcgagggttcgaatccctccttctccgccaaaaagtctcgtaaacacgttgtttgcgagactttttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagctcatcgagggttcgaatccctccttctccgccaaaaagtctcgtaaacacgttgtttgcgagactttttattttctaaagatataacacgcagaaaaacttaataagcaaaaaaatcggacagcccgaagactgtccgattgaatgtttttgtgattattctatggtcgtgatgtcgcttccgaaccaagatgttgatatctcagcgagcttgccgtcctgcttcatttcgtgaaggatctcctcaatcttgtcgcaaagtgcctgatcaccaagtctgaagccgatagcgtactcctctgggtcaaggccgtcaggaagcaccttgtaatccttgcctgatgtggatatctcgtagtttgcaactactgagtcaaggaacgctgcgtctaccatgttaagctccaactgctggagggcttcaacatttgtcgcaagctctgttgttgtcgcaccatttgctacaacgtcagatgcaagaagtgtttcctgtgctgttgaaccgttctgtacggcaatgttcttgcctgcaagatcagcctgtgaagcaacgtcgcttgagccgtttacaacaaacaccatttcattcttcatgtaaggctcgctcatgagcattactttctttctctcatcgctgacagaaaggccgttccagatgcaatctattgtgcctgcattaaggtcctgctcctttgtatcccagtttacagagtaagtttcaagctctacaccaagtcttgagcaaacttcctttgcaacgtcgatatcaaagcctacgatgttgtcgttctcgtctgtgtagcccattggcttgaatgttgggtcaagaccaagcacaagcttgcctgaatcaagaactttctgaagtgagttatcctcgcctgttgcagcggctgtgctgtttgtgcctgctgctgatgaagaatcagatgtgcttccgcagcctacagccaaaagcatcatggcagcagcggaaagtgatgcgatagtcttaaaaatagatcttttcattattaacttcctttcgggtatcatcaaaataccatttcatacgttttaacactttaatataataacatattataacgtcactgtcaattatcattattgcccaaacctttgcaggctgtgggtgctttttcatagaaaatgaccgcagacaggcgaaaatcagcaattaccaagctttttggctctttccatgaaccttgcatacttgcctattaccgctttcccctgtgtgatacctgcatttttcagtatctccaaaggcttttcgggatagtcggctgtatattcaagctccagctcatagtctgtcaagccaagatattcgcttttgtcaaggcatatctcaacatggtcaaaatcggtgcagagcttgcgctgagtatgcaaagagcctgcaaggtcagcggcagggaaatctctccccacaagctgtgaaagctcctgtgcggtgagcttttcaggcaggctgtcaagctgttgttcatactcttttttcacatgaagtgcaccgttttcggagataggtgctttaagctgcaaaaaatatttttcgcctatctgcctgacacggatacttgtcatgcctgaatctctttgcgggatataataaaaattggtctgctcgattattttgttccactgaaaaagcttttcggcgatgttatattgttcttttgtgagagaaatttttatctcacgctctatattttcgctcatgatatcctcctgctttaatactttattatattataacaatatcacaatacaatgtcaacacgaatatggttgacaaaatcccataaaaatagtagaatttaagtatatgattttaaggagagtttgagatgtcaagaatattgacgccacagcagaagatagagcggagcatcgttactgattttcgcagagatatatggaacaagttcgtaatgggatatgagcgttacgatatgataaagccgggggacaaaatagcggtgtgcatatcaggtggcaaggactcaatgcttcttgctaagtgtatgcagcatttgcagaaatatcagggcatggacatagggctagaatttattgtaatgaacccaggctacagcgacgcaaacaggcagagaataatcgacaatgcggcgcttatgggaatacccataaaaatgtttgaaacaaaggtctttgacattgcatacaacacaaaacgcaacccatgctatctttgtgcaagaatgaggcgtggctggctttacaaatttgcgcaggatcttgggtgcaacaagatagctttgggacatcattttgatgatgttatagaaaccatactcatgagcatggtatacggaggacagattcagactatgatgccgaagctgcactcgaggaactacgcaggcatggagcttatcagaccactgtacatggtgaaagaggcggacattatccgctgggtggagcagaacgatctgcattttatccgctgtgcctgccgtttcactgagagctacgaggggtcagagaaaaagggtgaggtatcaaagcggcaggaaatgaaggagcttatagcaaagtttcgtgccaccaatcccaacattgaaaacaatattttcaagagcgtttataacgtcaatctgcgcactgtgatacaatacgaatacaagggcaagaagtacaattttatggacacatatgatgattacgacccaagtgttcaggcagatgacgatgatgatgagggaatagagtaaaaaagttgtgaaaagggcttgacaaagcggcagagatagtgtataatatattactgtaattggtttgctgctatggctcagtaggtagagcacgtccttggtaaggacgaggtcaccggttcaagcccggttagcagctccagcaaaacagctattaaattgcgtaaatgcgtggtttgatagctgtttttgttttgtgtgatgttctgtgatatttcttaaaaatttacgataagggactatgtagtggaacatagattatgatgtcaaagctttttcccctgccacgataccctacacacaaaaaacaccgcccgaactcctcggacggtgttatatttttatctcgtattacagatttgtatactccataaggctcttatccacctcacgggcaacatctctgccctctctgatagcccatactacaagtgactgtcctctgcgcacgtcgcctgcggcaaagacgttcttcacgttcgtctgatgtgtgccgtcggctgttgcgatattcgttctgccgtctacctcaacgccaaaagcctttgtgagatagctttcagatcccagaaagcctgccgaaataagaacaagctcagtttctaccttgtattcgctgccctcaacaggcttcattatcgttctgcctgacttagggtctttctccggagagagctttacaagcactgcgcccttaagattgccctttttgtctttgagaaactccttgacagttgtctgataaactctcgggtcatgaccgaacacaccgatagcttcctcctgaccgtaatctgtcttgcagaccattggccactgcggccatgggttgttctcggttctcgtgtcaggaagctttggcatcatttcaagctgcaaaacgctctttgcgccatgtcttacgcttgtaccaacgcagtcatttcctgtatctccgccacctattaccatgacgttcttgccctttgcggaaatgtggtttttatccgtaagaccgccgttcagcagtgccttagttgtggatttcagaaaatccactgcaaaatagataccctttgcatctctgccctcggctttgatatctctagggtttgaagcaccacaacaaagtattactctgtcgaagtccttgagaagctcagccgctgtgatatccttgcccacattaacgcctgtgcggaactcgatgccctcttctttcattatgtttatcttgcgctcgattatctgcttttcaagcttcatgttcggtatgccgtacataagcagaccgcccactctgtcctcacgctcgaaaactgttacactgtgacctctctgattgagctggtcagcggcagcaagacctgacgggcctgagcctataacagcaatagtctttcctgttcttacctttggcactcttgctgaagcatatccgcaggcataagcattttcgataatgccgtattcgttagcctttgtggtaacagcgtcgccattagctccgcaggtgcaggctttttcgcaaagtgcaggacaaactcttgatgtgaactcaggaaaattgttcgtcatatgaagtctgtaatatgcctgctcccagttgcccttgtatataaggtcgttccattcagggataagattgttaagcggacagcctgaaaatgcgttgcctatcttcattcctgcctgacagaacggcacaccgcagtccatacatcttgctccctgcttttgctgctcctcctttgaaagaggagtgtgaaattcattaaaattctttatacgttcctcaacggagaacgctgctgcgtcctcacgcttatagtccataaaaccagttggctttcccatatctcaactatacttgctttcacagcaagtatatcctcctttcgattttaaaagtacaatatctcatgtgcgcaggcttactgcttgccgttgatgatctgatagaatgcttctatctgcgcctgatcgctactcatacccttttcttccattgaagctatagcagacatcatcttcttgtaatcgtgagggattatcttcttgaacttaggcagatattcctcaaagttatcaagaatacgcttgcccttttcagagcctgttgcatcaacgtgctgctggataaggtctttgagctgaatgatatcgtacttctccttgacctcagagaaaagtaccatttccttgttgagtcttgtgtaaaggtgtctgtcctcgtcaagaacgtaagctacaccgcccgacatacctgccgcaaagtttttgcccgtcttgccgataactaccacacagccgcctgtcatatactcacagccgtggtcgccaacgccctcgacaactgccactgcgcctgagtttcttacgcagaaacgctcgcctgcaacaccgtcgatgaacgccttaccgcttgttgcgccgtaaagtgcaacgttaccgataatgatattgtcctcggctttgaaagtagaatccttaggaggatagaccacaagcttaccgcctgaaagtcccttgccaaagtagtcgttagagtcgcccacaagttccaaggtcaagccgttcgggataaatgcgccgaagctctgtccgcctgagccgttgcagactatcttgtatgtatcgtcagcaagtgtgttataatactttcttgttatctctgagccgaagatagtaccgaatgaacggtctgtgttcttgacatttactgtgatagacttcttctcaccactctcaagatttttctcgaactccttcatgagtaccttttcatcaagagtgttttcaagcttgaagtcatacttggatttcttgttgtattctaccttttctgaaacgtaatcagagttgatgatattagaaaggtcaacttgtgccgcagtgcctgtgataccagcctttggcttgataaggtcaattcttcccacaagctcgtcaactgttcttacgccaagctttgacatatattctctaagctcggaagccacgaatatcataaagttcattacatattcaggcttgccggggaacttctttctaagctccgggttctgtgttgcaacaccaaatgggcaagtatcaagattacatactctcatcattgcacagccgagtgttatcagcggagctgttgcaaagccgaactcctctgcgccaaggatcgctgcgataacaacatcacggcctgtcatgagctttccgtctgtttcgataacgaccttgtttctaagaccgttcttgataagggtctgatgtgcttctgcaagtccaagctcccatggaagtcctgcattgtagatagagtttctaggagccgcacctgtaccgccgtcatagcctgagataaggataacacctgcgcctgcctttgcaacgcctgccgcaactgtaccaacaccgcactcagaaacgagctttacagaaattcttgcgttcttgtttgcgtttttcaggtcatagataagctgagccaagtcctcgatagagtagatatcgtggtgtggcggaggtgagataagtgacacgccaggtgtggagtgtcttgttttagctatccatggataaacctttttgccagggagatgaccgccctcgccaggctttgcgccctgtgccatttttatctgtatctcatcagcagatgtgaggtatcttgaagttacaccgaaacgtcccgaagccacctgcttgatagctgaacatctgtcctcagaagtaccctttgtgagaagtctgtcaaggctctcaccgccctcgcctgagtttgacttgccgtgaagtctgttcattgcgatagcaagtgcttcatgagcttcctgcgagatagagccgtaggacatagcgcccgtcttaaatcttcttacgatagagtcaacgctctcaacttcctccagcggaacagggttttcagcaaagttgaaatccataagacctctgatgttcacagggtccatttcctcagagataagctttgaatacttcttgtatgtttcatagtcgccagtccttgcagcctgctggagcagatagatagactgaggattgtagagatgctcctccttgccgcttctgaacttgtggcttcctcttgattcaagctctgtgtctgtgccaagtccaagagggtcaaaggctgatgtatgaagtctgtcaacgttcttttcgatatcagagatagtgataccgcctattctgctgaccgtgccagtgaaatatttgtttataacgtcctgaccgataccgatagcctcgaatatctgtgagccttgatatgactgtatagtagagatacccatttttgaagctatctttacgataccatggagaacagccgcattataatcgtcaacagcggcatagtaatccttgtcgagaaggtcgtcagcaataagctcgtggatagtttcctgagcaagataagggttgatagcggaagcaccatagccaagcagtgttgcaaagtgatgaacttctctaggctcaccgctttcgaggataatagcaagagatgttctcttctttgtaacaacaaggtgctgatgaagcgctgatactgcaagcagtgacgggatagcaaggtggttctcgtcaactcccctgtctgaaaggataaggatatttgcgccctcgctgaatgccttgtctgcttctatataaagtctgtttatagccttttcaagtcttgtgttcttataataaagtatagggataacagctaccttaaagccaggaatgtgcatattctttattttaaggatatctgttgaggtaaggatagggtcgtgtatcttcattaccttgcaattttcaggcttttcttcaagaatgttgccgtcctcaccaatatagacagttgtggaggtaactatttcctctctgatagcgtctataggcggatttgttacctgtgcaaagagctgtttgaaataattgaacagtggctgaggctcttttgaaagcaccgcaagcgggctgtctgtacccatagcggcaatagactcagagccgttctttgccattggcaggatagatgtcataacgtcctcataggtatagccaaaagctttctgaagtctctgtctttcctcgtatccgtgttcctctaccttgatgtttggtatcttaaggtctttaagtctgacaaggttgctgtcaagccactcgccgtaaggctgctttgaagcatagtattccttaagctcgtcatcgtcgataactctgccctgaacagtatcaacaagaagcattttgcctgggcgaagtctttccttttcaacgatattgtctgacgggataggaagtgcgccaacctcagatgaaaggataagattgccgtcctttgtgatataatatcttgacggacgcagaccgtttctgtcaagcactgcacccatgatatctccgtcagagaaaaggatagaagcaggtccgtcccatggttccatcatagttgcgtaatactgatagaagtctttcttagcctgactcatcgtgccgttgttatcccatggctcagggatcgttatcatgacagccagcggcagatccattccactcatgaccaaaaattcaagtgtgttgtcgagcattgcagagtcagagccttctgtgttcacaacaggtgtgaccttatcaaggtcgcccttcaaatgctcagacttcatcgtttcctcacgagcgagcattttatcagcattgcctctgatagtgtttatctcaccgttgtgaacgatcattctgttaggatgcgccctctgccagcttgggtttgtgttagtagaaaatcttgaatgtaccatagcgatagcagactcgtagtccttatcctgaaggtcagggaagaactttctgagatcctgcacaaggaacattcctttatatactatagttctgcttgaaagtgatacaacgtaggtgtcctcatttgactgctcgaacacacgtcttgcaacatatagcttgcggtcaaagtcaagaccctttttaacgccctttggacgcttgatgaagcactgcattatggcaggcatacactgggcagctctcttgccaagcacctcaggctttgcaggaacgactctccagccaaggatctccagaccctctttttcggcgattatctcaaacatcttctttgcctgatttctcgcaagctcgttctgtgggaagaagaacataccaacggcatagtctctctcctcgccaagcgtgattccaagctcagcggcggcgatcttcttgaagaatttatgtgagatctgaagcaggatacctactccgtcacctgttttgccctctgcgtccttaccagcacgatgctcaagcgtttcaacgatagtcagcgcatttgcaacagtatcgtggctctttttgcccttaatgttcacaacagcacctattccgcagttatcatgctcgaatttcggtgaatacaggctttttacattagtcatatcctccatgcgttccatttttatcaccctttcctgccaaactgtaaaaaaattatagcttatcgttcagcaacgtatgttatttcacggctcatagccgatttttagctgtttttaacaaaaaaatttgcaggaagaaattaaaatcctgcaatcctgcataagtgccaacaaactcaaagcgtggtttttcgcacagatgcaagaaaatagccttttgccgtcttttttgacggcttaatcattataacacacattacagcaaaatgcaagagcgaatgataaaacttgcataaaatcattattaatttttagttaatcggtatacatatataacttatggtttcatatcgttttcctaggtaaaccttgcaaactaacgcaacaacgctcttttcagcttatttacagccattttcagcggagaatcgtactctttgtaaaaatgctgataatccttagaattgttccagtcaccaccccatttccagctgtgacgcctgaaaatgcaatagcaaaggtctgttctgtcaatcttgtgatcaaaagccttgtcacggtctgcatactctgcagcattggcaggcatgaccttattccccactatataaggatttataagggggtttatgtctatcgccctgccgtagctgtgagccgaaatagtattggtaccagccaccaccctatagttgaaagcagaggaattgttatccgccattgacctttcatcatcagcgtcatactcatccacgagcctgattttttctatctcataacagccctcgaaaagttcatagaagatatccagaacctcctgcgcaagctttctcgccacgataagctcccccgactgcaccttatgctcaaagtcataatatctcacacgcagataggcaaggtcgcccagcttcacatggggattttccttataggaaacgcctttgatacgctctatcacctcgtttggaagctcctcagccgtaaagccctctctgtataatatctttcccataaaaaacactccttacaaaaagcggtcaaggcatgataccttgaccgtctttattatttatccgcagacttgtagtacataacaacaggcgtaccataaggcacgttgtcataaacatatttggcgtcgtcatagctcatatttatacagccgtgagagccgttgtatttgtatatctcaccgccgaaatatccgcctcgccacgttgaatcgtgaagacctattccacagagagaaacgttgttccagaagttgcactttgtatcccactcgtcgccatcggcatttgtgtctttcatacgcttgttggtctcctttgaccacagcttataaacaccagggagagttgttctcgccttagatgtggtctgacctgaaactatataggtatcgagctttttcttgcccttttcataataccacaagtgctggtcggtaaggtctatctcaatataagtgtcgcctatatcatcgtctttgcttctcgcagactcaacgcctgtaaagtcataataaccggtactgtaatagatagggtctaccttgtcaacgctctcgcccttttcaagcatatccacaagatcgtcacaagtcttttcctgatctatccaccagccgtatttagcatcagagcttgtcggcacgattatgtcgccctgcaaagtggcgtggaattttctcttagtattatatgtatcatacttctttgcgagcttttccacatactccatggctttctttctgtccacagtgtagcttccgtcatctttgagctttatgatcttcataagctcctcgcccgtgagagtttctgtggtgtagtcaaaatcatatgtgacagaaagctggaaaacatcatttcgtttcttgcaatcgtcctcaaggtctgcgctcttcacctcaggaagggaataacaacctgtgtctttgtcaagctcaacgctaagctcacctgtcgccacgctttgcgtaacataagcttcaagctttttcatatcggttatcttgtttccctgcacctcaggggtgataacataagccgtcttatcctcattaagaccaagctttgcatcggcagtttcaacatcgccccagtttgctttctccacaagtttctgaagcttctcaacatcaaatgtgatgtcctcattaaaactataggtggagttctgtataaatccagagaaccatgtttttctgttcacgctgtcatagatcttctgaagctcgtccttgccgcttagtctgtaatcaaaatcagctgtcttgaaaacaacaggcgtgccgtcgatagttttgaccgtaagctcataaggcatatcgttcaccccgagcagatcgcaagcctgttcaaatgtctttccgcccacgtcaatgccattcactgttgtgccgctcagaaatctgttgctatagtaagctcttccaatgaaatatcctccgcccacaactattacgatagccgctgccgcagtgccgaagataatgccgatattgttgcgttttttctttcttttcttattctttgacgaacctttgacagagctgtttttcttcactgatgtcgcaggctttttcgttatctttgtggaattttccgtcatcaattatcctcctgtacaaaatgacgttcggcatttgccgacaatgtatcaagaataattatatcacgcttttttccttttgtctataggataggctgaaaaatttgtcacaaaaagaatgccggatattctcatttaatgtacaaataaacgtactgcaaacaaactacacgcaaacaccgtaaaaaaatatcgggcagataactccacccgatacaatatcagtcttttatatacttgttcttgacctcactgtaggtcttgcagaagcggtcatgggagatatacgctccccagctcatgttatcgtccacctgagggtccataacatatacctgaccgtttatcgttacctccacccacatatgatagccgtaaccgcctgccgccatagcggtcttgccgtcaacggtctttgcatcaaagcctatgtagttgagcattgcggcgtaaacgtaagaatattccgtgcaagtgccgtaaccgtcttcaagaacagccttgacaggatttgcccagccgccgtaatcgtagaccgtgttctttataatataatcgtagcaagccacagccttttcgtaatttgtcatatcatctgatattatcttattgagatatttcagaagtatcttttcttcctttgcgccgagcgtcgcctttggatcaagcacagcagaattaagtcgctgtgcaggggtcttgccgttgtcgacaacaggcgaagtggttgtagttgtaacaggctttttagttgttgtcaccttagcggtggtggtctttttcttggtagtagtcaccgcaggcgttgtggtcgtaacaggggcagttgttgtctttgcagtggtagtagtttttgcagtagtagttttcactgttgtagtcttttttgtagcctttgaggcaacagtatcgctgtcagtagtgctgacaggggcggaagtaacagcagaaacctttgtttcagactttgaagcctgctgagttttctttgtcacaaggcttactgatatgctaagctttgtgtcagcggaagtcacgctctgcactgcggtcactgacgctggcttccgtgatattacagaggtcgttacgctctctgatctcaaagctgtttcggaagctgactttgttgtttcgctttttgcagtttttacagcctttacagcctcggtctgagaatttttcgcagtttccttgacggctgatgttgtaagaacagttgtgatatccccgatctgctcagatgtttccttgtcagaaacagcagaaatgacctttgcattttcaggtggcatgactgcacatggctggataacatttttatcaagtgtcgcaaaagtcacagcagatactgtcacaactccgcaggcagaaagcacagccacacagcgggatattcccgacttcaaataacccaattcagaacgctcctttaaaatgtgataaactacaccatattataatgaataaggttacaaaagtcaaggggcattgtaatcaaattgtaattttcaagccgttttttcgctcgtttatgaagtttatatgaacgtcaagttacaaccattgtacattttatatcccaggaacgacaataagggttctatttttatcacttttaacaaatttcgcaaaacttttattaataataccgaaaaacggacacctgcgttacaaaagcccatattttccacgatattttacatatctatccacaaaatcacccacgcaaaaaaagaacgcagacacaagcctgcgttccctttttgaagtatatgaagtatatatggagaaaaaagtatatgtgtaaatttcatctttttgtctttctcttattgtgtttatattatattccgccattgtgacagttttatgataatgtgctgaaaactaatacacaaaaaacaagtgcaaaaaaacgcctgccatatgacagacgttttctcttagtttaagtaaattactcagcctgaggtgctcctacagggcaagtacctgcacaagaaccgcagtcgatgcactcgtcagcgttaataacacacttaccatcagcctcggagatagctcctactggacatgcgtccatgcaagcgccgcagccgatgcactcatcactaatcttataagccattttcacagacctccttgcataaattctacaagtatcatatcaaatactatacttatataataacacattttctgaaaaaatcaagaggttttcggcatttcataaaaatttcacatagattttaagtgatttttcagttagtattttctaatcagctagatgcttgccaattcctgctgtgagataagtgcaaatcctgcttcactcaaagcttccagagcggctgtaacgttctctactctaaggataagataagccgtgttttccttagtgtttatgaatgcagaatacatatactcaacgctgatgttgtcattgtagagagctttcattgcttctgaaagtccgcctgggcggtcatttatctccactgcaagcacctgagtggtggtaacggaaaagccctctgttttcaaggctgaaactgctttttcaaaatcgtcaacgataagtctgagaataccgaaatcctttgtgtcagcaagcgacattgcacggatattcacatcattatccccaagtatttttgtaacggcagacaatctgccaggtctgttttcaataaaaaccgaaagctgttttactgtcataaaattaccccctgtcttttagacaagctttctcttgtcgataactcttactgccttgccctcagaacgtggaatgctctttggctcaacaagtcttatcttcgccttgatgccaaggatattatggatatcgttggatatcttcttttcaagatcctcgatagacttgacagtatcagagaacatatcgtcattaagctcgactcttatctcaaaagtatcagaattgttcaccctgtcaacgactatctgatagttagggcttgcctttgatatcttaagaagcactgactctatctgtgatgggaacacgtttacgcccttaatgatgagcatatcatcgcttctgcccattggcttgcacattttgacgagagttctgccacatgagcatttctctcttgtaagaatacaaatatctcttgttctgtatctcagcagagggaaagcttcctttgtgatacttgtgaatacaagctcaccctttgagccttcaggaagcacctctcctgtgtcagggtcgattatctctgcgataaagttgtcctcattgatgtgcataccagactgtgcttcgcactcgaaagctacgccaggaccgcttgtttctgtcagaccatagatatcgtaagccttgataccaagaagcttctctatctcatgacgcatttcctccgtccaaggctcagcaccgaagataccagctttgagcgtaagctcctctggctttatgcccatttcctttacagtttcacctatataagcggcatatgacggagtacagcacaggatagtagaaccgagatcctgcatgaactgtatctgtctttctgtgtttcctgatgacatcggcagtgtaagacagcccaccttatgagagccgccgttaagacctgctccgcctgtaaaaagtccatagccatatgcaacgtggcaaacgtcatcttttgttccgcctgcggcaactatagctcttgcacagcaattttcccaaaggtcgatatcatgctgagtatagaaagccacaactctcttgcctgtggttccgcttgtagaatgtattctcacgcactctgaaagcggctttgcaagcagaccgtaaggataagcctcacgcagatcagcctttgaaaggaacggcagcttgtgcaggtcctcaatgccgtggatatcatcaggcgttacacccttttcttccataagcttcttgtagtatggcacattgtcccagacgtgcttgacctgcttgacaagtctttcgctctggagctttttcatgtcctcgtgcgccatgcactcgatctcttcgttccaatattttcccattggaacacacctcctgttaaaatggtttcggtcatattactcgggtatcaactttgcacaagtatcatacgccgtacatttcttcaagcatcttaatgcctgttttcgttttgaacaccttgtcacggaagctttttatgctctctttggaaaggctgtcctcgaaagcgttcacaaggaaatctgcttccaagagtatctgccagtcaagcccctgggcgccctcataggtgtgatgatgtgcgataagaaagcacaccctgtctatgatatcctcgtcaaagtcaagctctgtgagcattttccgtgcaggctcaggacctaactgttcctgaagctttccgccgcagtgacccttgccgtatctctcctccgcaggctttatgcctatatcatgcaccaccgacgcaacgtcaaggcagtgcatagcgcggatatcaagaccctctgccctgccgataacacgggcaaaggtatgcacctttataaagtgctgtatacgcttagggtcgccgctgaaaaactcggtcatttttatgataagaccgcttatctcgtccattattttacctctctgccgagagcgaacgcctttttattcagttcaaggaactttgcaggaacacagttttcaagagctttctgccaaacgtcctcgtcaaaagccattttagttgacacaacgcccatgagaacaacgtttgaagcctttgcagtaccagcctgctccgcaagtgccagtgcgtcaacagcgataacgtcaacgccctctgctttaagcttgcctatgatatcctcaggataaacagccgcacctgtgataacaggcattgggtctatctgctgagttgaagtgatgatatgtccgcccttcttgagatatgaaacatatcttgcggcttcaagctgttcaaagctgatgatgatatcagcttcgcctttttcaactactggcgagcatacctcactgccgtacttaacgtatgtaacaacagagccgccacgctggctcattccgtgtacctcgctgaccttgacatcaaagccctgtgagagaagcacgtttcctattattcttgacgcaagcagagagccctgtccgcctacgcccactatcataattgatcttgttttcattatttacacctcgaaatatatgttatcattagtcgcatatcgcacccagcttacacatttccttgcatatgccacagcctacgcactgtgtatggtcgataacgcacttgccgtcatggatagatatagcaggacagcctatcttcaagcactgcttacagccaacgcacttatccttgtttaccttgagcggtggattgtgctttacatatttaagaagtgcgcatggacgtcttgaaataataacgcttggttcttccttggcaagctcttccttgataacagcctctgtttcagccatgtgatatgggtcaacgactcttacgctcttgataccaagtgaatggcagagcatttcaaggtcaacggcataagcagggtcgcccttaaggtttttaccggttgtagggttctgctgatgacctgtcatacctgtgatagagttatcgagaatgataacagttgaatttgtggagttatatgcaacgttcacaagacctgtcataccgctgtgcatgaatgtagagtcaccgataacggcaacagacttcttttctgcctctgcacctcttgccttgttgaagccgtgaagtccgctgatagaagcacccatgcagatagttgaatccatagcacaaagcggtgctgttgcgccaagagtgtaacagccgatatcgcctgataccataacgcccagcttatgcaggcaatagaacagacctctgtgaggacatcccggacacataacaggaggtcttacaggcacgttatcctcaaatgtgatatactcattcttctcgccaagtatcttttcagcaacgatagtctgtgatatctcgcccataaggctgaacagttccttgccgataacgttcacaccgttctttttgcagtgtgtttcgataacatcgtcaagctcctcgatcacatagaccttttcgcactttgcggcaaagtcctttattatctgaattggcattggatttacgataccgagtttgagatatgaagccttgtcgcccagtgcttcctttgcatactgatatgagataccgcttgtgataactcctatctttgtatcgttcatctctaccttattgagcggtgaagtttcggcataatcagcgatagccttcattcttgcctcaacaacagggtgacggcggatagcgttaccaggcatcataacatatttctggatattcttttcatatgggatattctccctttcctctctctcgcaaagctcaacggctgactgagagtgagaaactctggtggacagtcttacgataacaggaacatcgaacttttctgaaagctcgaaagcagccttagcaaactccttgcactctcctgaatcggaaggctctatcatcattgtcttagaagcgatagcatggtgacgtgaatcctgctcgttctgtgacgagtgcataccagggtcatcggcgacagctattaccatacctgccgttacgcctgtgtagcctgctgtgtaaagagggtcagcggcaacgttaagaccaacgtgcttcattccgcagaagcttcttgcaccgcctatagaagcgccaagagccacttccattgccaccttttcattaggcgcccattcagcatatacctcgtcatattttgcaacagcttctgttatctcagttgacggagtaccagggtaagacgatacaaccttacagcctgcctcatacagacctcttgcaaacgcctcgtttccaagcattagttttttcatacaataaatctttcctttcactgcaccgaccattttttcgtggtcggtagaaataaacaataattaaaatagatacaagtaattataccacaaatttcaccaaaatgcaacaacttttttgatttaaagcaccaatagagcgttataaaaagtttgcttacggcaattttgtcagtttgcataaaatatcgatggagcttctgtgcaaaaattcacctataggcacgatttgcacactttattatatatacataatagataatttataaagggatatacaggcggtttcatccgtgcaagcgtgccaaacacacaaaaaagtgcgtaaataggtggtttgagcatttaaacgaaacgtgccgaacgcacacatgaaacgtgcagcgcacgttttgagcaacaaaaaaataaatcgccgccaggcgataccataattcctcattcctcactcctcattcctcattcttaacactcctcattcctcattcttaacactcctcatttctcattcttacctcctcacttgttaaaaaaatttgttatgttacaatagatagttgacaaaacaaattgaaaaacaacttccaaaatgatataatgttaagtaccaccaattttttggatggctatacaaagttttcgctgtcacgataatttttttcatttgtgtcttgacaagggggacattatactcagccaactctgtacttacaggtatattgttattctggatgacattttcaatatctgatcctattaatacttttatattcaattgacttgaatctctaaaacgcaataattgttcttcaagttgtggagtgaaatactgattaatcataaaaactaagctgtcggtacaattgttataggcaataatgacgttcgctgcaatatctcgtaagttaacatttttccctcggagtttgcattcgaataatacgctgtactgtttatttttatattttattgttgcatcaatatcatatcctccatcttttgatggctgcgttttttttattttattcaatgaatttcctaaaagttttttaactatttttaaacacagatcttcaaagttacttgaatttttttggaaatcagacattttatttctcctaagttgataataaagagttatccttcaataaccctcgtcacatataacaccatatcacactttcctaaaaaagtcaatcaacttttgaaaactttgtaaaaattcacaaatcgtctaaatttgtcgaactcaaacaactctgatataatataaggtaggtttaaaagcaaatttattcgtaagcattagtgctatttgtgaatgttgaccaaattgctttgcctcagtatttttaaggagctgttttgatgtttgaatatagaccttttgtagaccaatttcttgattattgccgttaccataaaaagcttagcgagaaaactgtgcgtgcatacaaaatcgacctttcgcagtatgtgctgttttccgatacgctttcaaaacaagcattgtgggattatatcgagtgcctgaataaaaagtacaagccgaaaaccgtaaagcgtaagcttgcaaccctaaaagcttttatccactttcttttgctgcaagactacatagattttaatccatttgataagcttgaaacttcgattagagaacctgtgctgctgcccaaaacgatacctctcgacgtgatcgctaagataatttctttttcttatcagcagattggttcagcccaaagtgcttaccagatgaaatgtgccgtcagaaatgccgctgtgatcgaattgcttttcgccacaggtgcaaggatagctgagatatgtactcttaaaccggaaaatgttgatcttttaggacgctccgttaagttttacggcaaaggttcaaaagaacgccttataccggtagaaaatatggctgtgctcagcatacttaaaaggtacagacttctttttgaagataagattgccgtgtcagggtacttttttgtcaataagctcggcagaagaatgacagagcagtcggtgcgaaatatgctgagttcctattgcagacaatgcggtgttgaaatgcacataacgccgcatatgttccgtcactcgtttgccactctgcttttggaagaggacgtggacattcgttacatacaaagaatgttgggccacagctcgataaccacgactcagatctatactcacgtcacatcgtcaaagcaaaaagagatcttaaagactaagcacccaagaaacaaaatggattttcagtgatatgttacaactaatagtattatatcatataagaatacatcgtgctgtgaaatgtcaaaattatttggtgaaatgtagtgaaatgtaactttgcggtgcttattatcataagggaggtgtaaaatgtcgcagcttatcgttacgagccgttatctgaaaaacggaaatcagaaaaataaaacaaaacgcagaaactatacaaagtatattgctacccgtgaaactgtcgagatacgaagtcaaaaatttgttgacagaaatgccaatgcaactaaaaatcaagagcagcttattaacgatctgataaacgactttcctgaatccaaaagataccttgagtatgatgactatgaaagagagccgaccattgagaatgccggtgaattgataagcacaatagtagaacgcaatgctgacgtggttggaaaccgacagaattttgtcgggtatatggctatgcgtccgggcgttgagaagagaggttcgcacggcttgtttaacgaaaaggacgagcctataattctgaatcaagcggcaaatgagatagctgaacataaaggcaatgtttggtcacacgttgtttcacttcgccgtgaagatgcagtaaggcttggctatgataattcggacgcttggcgtgagcttgtcaaaaggcatatctcagatattgcaaaagcacagaatatccctctttgcaatttgaagtggtacgccgcttaccacgatactactcatcatccgcatatccacctgcttgtttattcaacaaatccaaagcaaggatttctgacaaaggcgggtatagataagatacgttcagcatttgcaaatgatatttttcacgatgatctgcaaagcatttatcaggaacagacagtaagccgtgatgaattgaaagcggtttccaaaaacgaatttgaaagcattgtaaatataatcgcaagtaatgatcatacagatccacagcttgaagaacttatcagaaaactatatatccaattacagaatgtgaaaggcaaaaaagtttacggctatcttccaaaggagataaaggaaaccgtcaataaaatattttcagagcttgcaaaagatgagaacatacggcagctctatgacaaatggtgtagtcttgaacgcttgaaatacaagacatatactctgaaagaaacggaacttcctgaactgtctgctaacaaagtttttcagcctttgcggaatatgataattcgtacagtacttaatatgaaaccatttgatgcaaatactgaaattgaaggatctgaaccaaatgatgaatactttgataatacgcctcagaatatgtcacctctgtttgatgaagcagaaccgttggcagagaaagaaactgatgaatcggctgcggcaataaaaaactatatcaaatggaacgatcaatacaaaaaagcctgcaagcttatctatggcaaagacgctaagctcaatgattttaagaaagctgaacaacttttgttatctgaatcacagcgtggaaatgttttggctgtttacgatcttggaaagctttattctaccgacaagcttggcgaaaggaacgaagaaacgtctattgcaaaatacacacgggctttgcagggatttttgcaaatagaaccaaactcaaagaaattaaagccatatgttcagtatcgtataggtaaaatgttttgctatggtcttggtacggagcaggactatgaaaaagcctttgagtggtttgaaagatcggcaaaacagaaaaacaagtttgctcaatttagccttgcaaatctgtattactatggcagcggtgtggaaaaagatctgtcacaggcttttctttggtatcagagatcatcctctcagggtcagccctatgcggcttattctattgctcaaatgtacagatatggagagtatgtcaccaaagataacgatacagcacagagatattacaaacaagctttgtcgggatttttgaaaatcgaaagtgatgatatggcgaacgacgatctattttacaaattagggcaaatgtttaagtttggacttggaacagactcagacgttacaaaagcgatcgaatacttcagacgttcagctgaaatgaataacaagaacggcttgtttgagtatggcaaagcacttttgataggtgaacacattccgcaagatacagatagtgcattaaaaatccttgagaaagctgtcaaacttaaaaacagcaatgcaaaaagattcctcgcccttgaatatatttcaggagagcatttggaacaggactttgaaaaaggaatagccttgcttaccgagtgtgctgacagcggagatgttattgcttgttacagactaggcaaaatttatttggaaagcgagattatgcctcaaaatctggacaaagcagaaaagtatttgctcttggcggaagataatgagtacacgcagtatgcacttgcaaagctgtatttgcaggaagaaaaatatgatatacaaaaagctgtcaattactttgaaaaatctgctgacaaaaatcattgggcaagttatcagcttggcaggatctatcttttcggtgctaaggacattgaaagagataaggaacaagctatcgaatggtttacaaagtccgcaaacgatggcaacgagtatgcacaggctattctggacgaaatatcaaagtttgagaatgatctgcttgcgaatacgatttttagtttgtttgttagtcttagtaggtgtattcaggatagttatgacaacgatcgtaaagacttacaaagcatagttgacagaaaactgatgagggttattcggagaaagaaaatggagttgggggagaaagaagaaaatcatatggatatacaataaagaaaaacagctgatctgtgcttgtgaatgcatagatcagctgtttttctttcgcaaaatctgcacctttgcgaataagattttttataagtcgtaattttttaacccagaaggaagtcatatttgtttttttgttaaaattacgattaatattgaaaaagttagaattttgtgctaaaatataattaggggtgtttttatgagaatcgctatttgtgatgatgaaaaatcttacatagaaaagataaaaaaagatataaaatcatttcaaacgcacgaaaatgaatttgaattttcagagtttgaaagtggagaagaatttattgcagagttttcaaatgataaatatgatctgctcattcttgatattgagatgaaagatctaaatggtttacagacggcagagtttataagacaacttgataaaaatgtgatccttatttttatgaccggttatgacaaattcttttatcaaggctatgaagttaaggcgtttagatatatattaaaaaatcaacctgaacctatttattttaaacagctcagcgatacaatccaagagtattatagaaataaaaaatacataaaagtcattgacgatggtattgaaaaggaacttcttacagtcgatattttatatatagaggtttattcacatcagatcgtcatccatacctttaacaaagaatattatcagaaaggtaaattatcagattatgagaaaatgttagaagaatgtttatttgtacgttccgataaaagcgttctgataaacgttactaatattgactacattaaaaaaaatcaagtatttatgaagaacggcaaaatcttatatgtcagcagaaatcatcttgaaaaaatcacaagagcttttttgaaatttagcagaaacaggtggggataatgtccattagtgaagtaattatagaaagtctgaattgtcttgcggagagcatggttatagttttctatttgtacaatatgatgaaagaggattatagattccgaaaaaaatcattggtcccggcagtgatactctgttttatttcacttgattcggtaactttatttcttgagtatccatgggttcatttgattgctacttttatattgatgatggcaatttcaagcattatgtttgaatgtaaattcggtacaaaaatattttgttcattaatatttttaatagtaatacttgcttcagaatcacttcccatgggaattttatatatgcttaattttggaagtcctttggagcagttaacttcaggagcaggaagatatatcggcatgttttgctctaaattgttttgcttttggttttcagtttacataatagaatattccaaaaacaagcagaaagatattccaatcaaaaactggctgtcgattatactaatacctattttaagcgtgtttattctcaatggtatttttgtatcatatggtttaaatcacagacagacgataaattatttgattactgtgattggattactggcgctcaatctgttcgtatttaacttttttgatacatatgcaaaccaactgaaaatgaaagtcatggagcaaaggctaaaatcagaagaagaaaattatatgctcattgaaaacaagtacaatgagataaggcagttaaagcatgatataaataatcagatatctgtagcaaaatccatgtttagtgatggaaatccaaaagaagcaataaagcatctggataagttagcagacagcttatcagacgcgggcagaatatgctacacaggtatttcagccgttgatgctattatcaatatgaaatggcaggaggcgttgaataaaaacatacaatttacaactaaaattaatgtgttcgaatcagtgcccatagataatatgctgctttgccggatactttctaatctttttgataatgcaattgagggagctgaacgatgttcgtatgtcaataaatatatctacatttcattgatacaaattgataataaacttagaatttgcgttatgaattcatcagatgaggttgatacacaaaaccttaagtcgagtaaatcgggaaacggattacacggtataggtgtaagcagtataaaaaaggcagtgactcagcttaatggggttacatctttcgagtgggagaatggtatatttactgctgatatattaatagagtattaacgaaggtgacatttaatgtcataaaaagtactttggcgcaaaagccttgaaaaagataaatagtatacgctatactgaaaactgggaacatccagtaaaagtatagcgtatttttttatcttggagagtaattgatcgatgaagaaactgaatcaggaaacaaaacgaggacttattataacgttaattctcagtgcaatctacggcataacggcaatagtaacgggacaagcctgcagtataacatattgtcagccgaaagagcctgagaatttgcataaattttttaaaaaggaaaggcggtgaaaaatatgaaggcaattaaaaagctcatgttgaaatatggttcatcattggcggcacttgcactgatgataggcgtcagttccagttctcaggcttgctggtggtggtacaatcagccaaaagagcctgaaggtatgaagaaatttgtaaaagaagactaataaaaaagcggtaatggagcgcttcggcgctccgatactgcggaacggaggagaagttatgaaaaaaaaaaacaacttcaaacgaatactttccggcataatgagtgtagctatggcagcaactcttttgccgagtttgcctgcagttgcagaggatgcagcagaaaagtatccctatacaatgtttgccgcttctgatacagaaggagctatcaccattaatgctaataatttctgtgtgaatggaaatatagcgacaaacggcacaattgtttcaagcggaaatatgaatgtcaacggtacgaaaactgagaatgctgacgaagaaatgatctacattctcaaaaaactgaactactcgtatttcagtggcgataacgttgaaacatatgctgacgattacagctttgaggacctgaacatcaacattaataatcccatggatgttaacggcactctagaacttacgggaaatattaatctcaattcaggaattaaagctgttgaagatgttaccatcaatggagaggttaagaatacgaacaattctgttatttgctccgaaacaggagatatcaatatcgaaacaagcaacgttaatttcagcggcttgatttatgctccttacggagatatcaacatcgatacagataaccttaacctcaacaatgttatcattatcggacaaactatcaccatcgactgtcctagcattaatgctaattacagcaacagtatggctgaacttgtcggaacagaatctgacattgaggttgagctttatgctttcggagagtataacagcgatgcgaacagcatagatatggagtggtacaccaattacaaaaacagcagctatgagatatggagttcagatgataatgtcaactatacatccgtagctgtcgtttcggatgcaactacctatcagtacccgatcaccgatgactttgaaacaaaatacttcaaggtttcccttatcaccaattacggcgagagaattgaatcagtaccttttgttgtaacaaaaacagaagatggctattctgttgattttcttgacagcgacggtgacgggcttccggacatttatgagaatatgatcggtacagatttgaataatcccgatactgatggcgatggactgaccgattatcaggaagtatacataacaggaacagatcctacaaagtacgattcagtaaccgagggtgtttcggacgctgatgcagattctgacagtgacggattgaccaatgcccaggaaatagagcttggaactgatccaagaaatgatgatacggacaatgacggactttcagattacgatgaaattaatatttacggaactgatcctctcgttccggacacagacggtgatggcttaaaagatggcgatgagccgtatattggacttgacccgacaaatcctgaaacatttgacgttcccgatgcggaatatgtaagcaatcagactattgccgagaacagcgaggctcttagggagatcaatactgacgatagtccttacaaaatgtctattgaaattgaatcgacaggttatgttgagggtaatttaaaagcaaaggaaacaagctactcaaaagcaataagaaatgacgccattcttggcattgcaccggagttaacttgtggcaactcttgcaatatcagcaaggttgtgttaaaatttaatatagctgatgaatccgtagacaatgaacttaatctattccctgatgagccggatttacaaggattaaaacgtcttacaatcttcaaatactttgaagatatgaatatgcttctgcccattgaaacaaagtatgaccttgaaaacaatacaatttacacggaggttgacgaacttggcacatactgtataatggacatggagaaatggcttgccaaccttggaatcggcattaacgaagctgaacctatgttgatgtcctttgaggctgaagcggtagaagatatagctgctgaattcaatgaagagtctacacgtgtagaattttctgaagaaacactcgctgaaataaatgacgaggaagatactcttactgaagaaacttttgctcctgcaatgtttgctgctgctcagaccagaggcgctgttaccgttcagacacccgttgatattgcgttccttattcagacttccggtcagcttgaggatacatttaattcacaatgcgaaatgattggtaatttgatggattccctaattgctcaatacgggaatggtaatgtacgtttctgtcttattacttataatttgaatggagcacaagctctgaaatttacatctgacggaaatatatggtttaccaacagtgtggctgttaaaatggctcttagcgcacagcaatatgtgtacacttcaggttatactgatagaggtaatgcgtttaaactattacaaaataatgttatttttaaagaaacatcggcaaaatttatttttcaggtaatgaatggttctacgaatgttggttcaatgtattttgatcaaataaatacatgtgcgaaattaggcataaattattccgagttaatgccggcaggttacagttacattgatccttcttatggacagcaggtagataatgcgataaagagtactggcggacttaatctaacatatggtacaaattcagagagtagtgtttataatcatattgtgggtaatgttgctccacctcatgttgaatttaaagccgtattgccaacaggttgggaaactattaacctagtcaatgtgttagatcctaataatggagcaaaatcagataatgatgatttaaccgactgggaagaagttgacactgaaagtgggcttattacatgggataacgatggcaatattcagttgcctacctttgaacagtgtttgaataaagttcatgatcagggtttttcttatgtgttgaatgaatacagtgattcgattccaagttatatgcatcgatatttttatggcgttgagattcttccaattaagtcaaatccctgtgaggaggattcggatggggatggattaaatgatggttacgatcctaattcactttcagcaaataattatagttcacagatgattgctcttgacaatactgaaactgttacaattattcaaaaatgccttgagtatttgggatatcttgatatgcaaaatcaggcttacggtacttttggtggtttgtcaattgctgctacacaacttttccaattaaatcatcgtacattttcagatggtatttcgtttaaaaaagattcaaatgattcatattttattgatcttaatacatattatgctattttattagaagcaaaaaataacggattcacagatttagttgaagacatagtatggtttaatgaaaattacactccaaagacaatgccgttggaagaatttaatgcaagtttaaatcctaataatccagtgtttatatcatctgttaaacggagtgattttgataaggataatgtatataacgataaggtggatatttatgtatatgattatacgccaatattaaatggaattctcagatatggagcacaggaatttcacttccattattattcgtgtaatccttcacccgtagaaagtcttaattatccttgtcaaaaatatgataacacatccaataaatgtgctcgtttaacaggagattattcctggatgattagtcaagtgaaaaataatgctccatatgatgtaaaaacaagcggaagttggaataatttcatgaaaactgttaatgcgaatattcgtttttcgaccagttcatttccatttttatattctgacataattataaatgctgagatattcggaaacattctcttcggatatgcaggacatgctggtggctttacgaaaaaagaattagagagtggtggtagcttatattcattcgtgacaacgggagaatttgataatacagaggattcaacatacgtaagatacggatatgatctttacaataatgtgattaaagattatgattacattcatatttcacagtaagatatatccggggtaattactatgaaaaaaatatatattattgtgctgatagtattaattcctgctttgtttttcataattagttttatttacaaggaaaaagtacatcaagagtatgttaaaaactgttataagaataacaaacaatatatggaatccattgttgattattttgaaaaatataaatatgattcaatccctatgattatatattcacaagatgaccatataatcgagaagtgtttagggaaaaatagtgaatatattgattgtggagaagaaacttttgataaatatttcacttatatgcggaataaataccaaaaagacagcccttataatgtgttttcctttattcgtgtaaactatgataatcaaggaaatatgctgatgtactttatagtaaaaaacagaaaaattgagaatgataagatacgaaattattacctcgtgtatattgataatgagtataatggacatggttcagatttagctatcgacaattccacaatcaaaagcaaaccattttcaggaaattggtatctatggtctaaagatgttttaaacggataatttcagtaatttattattgcaattaaaaaaaataattgcttaattatattcaaaaccaaacaagttaaaatcgccactatatctcatatcacaataggcacactctaactgtttaacaggctctcaaaaaaacgatttgggagcctgctttttagagtgattgtatttccctcataatcattgagaacagctctctaagggcttctccgcttctctgacggctatagttaagcagaagtcggcttgcaatgccgttgcggatttcatatacacaaaggcaaatattcctttttaagcgatggatggttgatttttcggaaacgatgtggtataagtttaatgaattcgaagaatataatagttatacaacccaaaatggaaaatatactatttcattaagaaattgcagtgaagcaggtttatcaggttcaataagattaaatgtgtatttggtgcataatgacaatggatcaatcgaatatatttggaaaaaacgtcttgattattacgatgatttcactccatatattaaatttgcggaactcaataatgaggtaattgtaaaatttcataaaaatatttaaccagcgaattagaaatcaaataaatcagaaagaatctatatatgaacaaattataaaaatagatgagctttaacgtcaagaaatgtcatttgacgtaaaactattgaaaaaaataacttaaacacgctatactaaaagcgaggtgatgaaaaatgatttcaaaactcgcaaaaggtacggcgtgtttttttgtcgacaataaaataatagaagtggaagattctgaagtttatgcttatggaatagaattattgttatctacaatcttcaacttaattatagctattattattgctttaatttccaatgaatttattccttgtgttattaatttgacagcgtttgtaactataagaatgtatgccggaggataccatgctgatacgcattggggatgtatgctgacacttgtgtgtgtactttctgcttttattttaataataaagacttttagtacagctacgataaggtttttatctccgattctatgggttttatcagtattaattttatataaatttgcaccggttgaacatccaaacaaacctatatcagagaaaaagaagatgaagttaagaaaaaaatctttgatttcattttttatatggacaatattctgcattattttctattttgttaaaacagaagtatgcttttatgcagtaacaggaatatttacattaacttgtgcaatggttgcagaaaaaataaaactactcataaaatcatattcataacgttgattttcagtgcggtctacggcataacggcaatagtaacgggacaagcctgcagtataacatattgtcagccgaaagagcctgagaatttgcataaattttttaaaaaggaaaggcggtgaaaaatatgaaggcaattaaaaagctcatgttgaaatatggttcatcattggcggcacttgcactgatgataggcgtcagttccagttctcaggcttgctggtggtggtacaatcagccaaaagagcctgaaggtatgaagaaatttgtaaaagaagactaataaaaaagcggtaatggagcgcttcggcgctccgatactgcggaacggaggagaagttatgcaaggaaaaaacaacttcaaacgaatactttccggcataatgagtgtagctatggcagcaactcttttgccgagtttgcctgcagttgcagaggatgcagcagaaaagtatccctatacaatgtttgccgcttctgatacagaaggagctatcaccattaatgctaataatttctgtgtgaatggaaatatagcgacaaacggcacaattgtttcaagcggaaatatgaatgtcaacggtacgaaaactgagaatgctgacgaagaaatgatctacattctcaaaaaactgaactactcgtatttcagtggcgataacgttgaaacatatgctgacgattacagctttgaggacctgaacatcaacattaataatcccatggatgttaacggcactctagaacttacgggaaatattaatctcaattcaggaattaaagctgttgaagatgttaccatcaatggagaggttaagaatacgaacaattctgttatttgctccgaaacaggagatatcaatatcgaaacaagcaacgttaatttcagcggcttgatttatgctccttacggagatatcaacatcgatacagataaccttaacctcaacaatgttatcattatcggacaaactatcaccatcgactgtcctagcattaatgctaattacagcaacagtatggctgaacttgtcggaacagaatctgacattgaggttgagctttatgctttcggagagtataacagcgatgcgaacagcatagatatggagtggtacaccaattacaaaaacagcagctatgagatatggagttcagatgataatgtcaactatacatccgtagctgtcgtttcggatgcaactacctatcagtacccgatcaccgatgactttgaaacaaaatacttcaaggtttcccttatcaccaattacggcgagagaattgaatcagtaccttttgttgtaacaaaaacagaagatggctattctgttgattttcttgacagcgacggtgacgggcttccggacatttatgagaatatgatcggtacagatttgaataatcccgatactgatggcgatggactgaccgattatcaggaagtatacataacaggaacagatcctacaaagtacgattcagtaaccgagggtgtttcggacgctgatgcagattctgacagtgacggattgaccaatgcccaggaaatagagcttggaactgatccaagaaatgatgatacggacaatgacggactttcagattacgatgaaattaatatttacggaactgatcctctcgttccggacacagacggtgatggcttaaaagatggcgatgagccgtatattggacttgacccgacaaatcctgaaacatttgacgttcccgatgcggaatatgtaagcaatcagactattgccgagaacagcgaggctcttagggagatcaatactgacgatagtccttacaaaatgtctattgaaattgaatcgacaggttatgttgagggtaatttaaaagcaaaggaaacaagctactcaaaagcaataagaaatgacgccattcttggcattgcaccggagttaacttgtggcaactcttgcaatatcagcaaggttgtgttaaaatttaatatagctgatgaatccgtagacaatgaacttaatctattccctgatgagccggatttacaaggattaaaacgtcttacaatcttcaaatactttgaagatatgaatatgcttctgcccattgaaacaaagtatgaccttgaaaacaatacaatttacacggaggttgacgaacttggcacatactgtataatggacatggagaaatggcttgccaaccttggaatcggcattaacgaagctgaacctatgttgatgtcctttgaggctgaagcggtagaagatatagctgctgaattcaatgaagagtctacacgtgtagaattttctgaagaaacactcgctgaaataaatgacgaggaagatactcttactgaagaaacttttgctcctgcaatgtttgctgctgctcagaccagaggcgctgttaccgttcagacacccgttgatattgcgttccttattcagacttccggtcagcttgaggatacatttaattcacaatgcgaaatgattggtaatttgatggattccctaattgctcaatacgggaatggtaatgtacgtttctgtcttattacttataatttgaatggagcacaagctctgaaatttacatctgacggaaatatatggtttaccaacagtgtggctgttaaaatggctcttagcgcacagcaatatgtgtacacttcaggttatactgatagaggtaatgcgtttaaactattacaaaataatgttatttttaaagaaacatcggcaaaatttatttttcaggtaatgaatggttctacgaatgttggttcaatgtattttgatcaaataaatacatgtgcgaaattaggcataaattattccgagttaatgccggcaggttacagttacattgatccttcttatggacagcaggtagataatgcgataaagagtactggcggacttaatctaacatatggtacaaattcagagagtagtgtttataatcatattgtgggtaatgttgctccacctcatgttgaatttaaagccgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggtacaaattcagagagtagtgtttataatcatattgtgggtaatgttgctccacctcatgttgaatttaaagccgtactgccaacaaattgggaaacgataaccctaaaaaatattttagaccctaataacggagcaaactcagataatgatgatttaacagactggcaagaagttgatactgaaagtgggcttattacatgggataacgatggcaatattcagttgccaacttttaaggattgcttagagaaagcaagcaataaattttatgttagaaatgttttagagacatatttaaaatatgctccaagtacaatatggaaagtttttttaaacgctgaaatattgccgattcattccaatccttgcgatgcagatacagatggtgatggtcttttagatcacgaagaagtgatatatacaggttataccgatccattaatactatatgtatcatcaccattttctaaggattctgatggagatgatatttatgataagtatgacttagaaccttggattgtaaatgaatcatatgatagaaatgccgtatatgattacatgaagaagtggtccggagattatgacacagttggtgaaaagtacaattatagtgagtatcctaacttttcagaattaagcgataaaatgactgattgtactaattttgcttctcaatgtttatgtgcaggtggatttaaaatgaataatgattggtattttgggaaagctgaaggcttagcatcgcatattcatggattattttctcatacaggaacatgggattatggctggactaaatcatggtctgttgtagttgataattataactattttcgttctgaagaatacgcgatgtatgaggtatctataggtagagatgaatctattgaggaagctatatccaaatatgatatacgtatgggagatttgatttacttttgtaaagaaaaaggaccaacacatacagcaataatatccagtgtgcagaaagatgagattctttatgctggtcataccaaaccaagatggaacaagaaactatcagaaacatttgacgaaaatgaagattatacaaatgtcatcattgtttgcttaaacggtagggttccagcatgaagagaaaaaacataatttgtgtagcctctagcatttttattataatcttattggtatgtgtaataatcaaattaacttgtatcgttaatctagatgatggttcatcaacatcgatatctgatgctgaatatcttgaagtatcggacttaagaaaattatatatatttatagatgacgatgaaaaaaatcttttagaagaattagcaaaaaatatgattttggattcctattataataatggatttaatgatcaatatacaaccattgtttctaatgatatttttaaaagactgaatccaaataatacaggaaataagttcgattttgaattaatcagcgtggatgtgcaatgcctatgtagtgaagataaggctattgtattttttactaaggattgttctatgcaatcgagcagcaatagaattgaatgtaaaatagttacagacggatccatccttgatagactatactttgaaaaaattaatgatgagtggaaagtggtatcttttttacaatcggcatgatttttgactacctaaaaatatcatattaatatgcataatcatgggactgctgcagcgtgtgctcaacagtcccatttttctctcacttgaaactaagaatattactgcgaattttcattatttaattacaaaaagaaaatattaataaatcaagaacaagccttacagtttacgtcgaataaatttatttcgggtaaagaagttgaatatattgtcttaaaatggtatgatacaattgttagagtgtaataaaacaaaaaagtggtgatatatatgttaaaagaaattatggcacgaattgcaggaatagtggtaataattattattgcaattatagtaaattttgtattaaaaagaattccaaacgattcaaacatcaaaagatttacggaaatggggtagaataataaccaatgttgctacaacagtaataacgattttaacatttatatttccgtggatatcttctccgatatttgatgaagatactgaagaatattatgacgaaccatcatattctgaggtcgtaacaacatcaagcactactaataagactaccaccgcttcaacaacgaaaactactaccactactactaataataccactacaactgaaccccctacagaaaaaagcggtaatacttacattgatgctatatcgctgacaataggtgaaacatatgaaaaaacttttacatattcagaggataatgataattgtgtttggtatattataaatatttccgaagacggtttattatcattaacgttaaatgcttctgctggagtgtattgcaatattaatttaatatgtatcaatggaaatgatagacttaattatgattgcggacaggatcgcatactaaatcttaacacgcctatccaagcgggtgaatattatataaaaatatcctatgagcaatcaggtacatattctttaaatagtcaatttagtacaagcggatatagtaaagatgaggaaataaattcaccatatcaaaatgctaaactgattgaatccaatactttaaatggccatataggatataaaagtaaccagcctaacgaaaccgatactgatgatttttataaactaattttgaattcttttcaattatatacctttaatcttactatggattcagatttaaaagcaaagatatttgtcattgcttctgatggcgcaacagaaatatatagcgattacggcaagaataaagaaattaagcttatttgtccgctacaatcaggaacctactatattcgtatagagtgtttggaaaactatggcggctatcaattgcagatgaattctgttgaaataaaaaatttggacagtgaacctaataatacatatcaaaattcaattgaaacaaaagctgatgaaacaattaatggttctataggctttgtaaacgataaaaaagaatacgatcaatatgattggtatatgtttaatattaatgaaaggaagcatatcataataaacacaaattcaccagagccatttcaatacgaaataagattgattggtacagatggagagcaaactctatcttatactacctgtcgtggtgaaatagaaactattgagtacgatttagaacctggtaggtactatataagaatttattcttccaattatggggaatatgagtttagttataatttaaattatgattttaacgatggctaacttattggaataatataacatgaggagtataacaaaagcttttaaagccgaaagttatactcctttttcttaacagacctttttgttttaaaagcagaaaggtcttttttatgcccatttttaattattggcaatgttttattgccaaatacccataagccttcgttttgattcagaacgaaaaatcaaaacggaggtaaaaatatgagctataatcatggcttggaggaaaagaaatttaaagaacagtggcagaaaaccgctgaggagtacagaaaagcagggatgactgagaaacagatagcggaaatttatgagtttgaccgtgaggttttcaactccaatcggcgttacagagaaaaaacagttggactgtttgataattcaaacagcagaacgctgacggtttatgatgattattcgacaaacaatcgttatggctggatcgatgagattgaggacatggaagtgtattcgcagatcatgtccttgccggaaatctggcgtgaagcttttacaatgtacatatttgacgggtacactcaaaatgaaatttcgtcaattttactaagaaatcagtcgaatatatcccgcgtaattgataaaattgctgaaattttaagaagtcaattttcaaacgcataaaaagggtgttctcatcggctacaaggtgaaagggaaaaaggagcgatccaaatccctgagaatcttgacaacagaataacagcatcgggaaaacgttaatcctgcggccggtataaaatctcggcagccgcatgaaccatacgccacgacctcagttgagcgagcgatcaatatgacgttcagacctttggacagcaaccaaagcaggcgatgaaacgcaggaggataatgatacttccgcccagccacagactcaagcaatgggggcggctctatgagaaccatagtggagtgagaggctcatgagatgaataagctgttcatcgttcccgatgttccgccgtgacgggtatctaggataaatatcacggaaattcgtctgaaacttacgaatcagacgaaggcaaaacgaattaataaggcggtttgcattcttttgcagaccgcctgttacatataaaaataaaaggtcaggaggctgatatatgaaagataacgatattcctgagaaatcagatttttataaatttggagtaaacattcctgtaccaacagtcaggttatcaaacaaacacccatgttatggttgtgtgtggtatgacaagaatgctgatgttcttttctgcccgtttcataactgcgttaggaacaaaaaaggctttgaagttccgcaaaaggtggcgaaatgaaatgctgatcaaacgaggagatattttttacgcagatttagatcccgtagtcggttctgagcaaggcggtgttcgtcccgtgctggtggttcagaacaatatcggaaacaggcatagtcccacgcttgtggttctgccgctgtcaacagttaagaaaaacaagcttcctacgcatatctgcataagaaattcaaaaatactgcctaaagattcggtcattcttgccgagcagattaggacaatagaccgcagcagacttcggagctatatagactcattggacagcgggataataaataaaatcgatgaggcaatgaaaataagtataggagtggattttgatgactaaattcggacaagcagaatacggcgattttatggcaagaatgtttgccgataagcttgatgaaattcttgaaactaccgaaaaacagaatttcaaccgcagaaacacagaagatatttacaaagaatttgtatcgtcaaaagatgcagcttaaggaggtattaagatgttaggattttttattggcttgcttgtcggagcttttatcggcatgaccgcaatgtgtctttgcacagcggcagggcaagcagacaaacatgaaaactgcacagattcggacaaagaaattcattgagtttgatgataccattcctaaaaaatttgtggtatccttgttggttgaaaggagtgtgaggaaatgccgacagtaacggtaatacagccgacaatcacagaagaacaaaatacgaagatccgttgtgccgcatattgcagagtaagttcagacagcgaagatcagcttaattcctttatggctcagacaagatactacagtcagttttttgagaactccgaaacggaagaactgatcgatctgtacgccgacgagggtataacaggtacccgtgaggacaagcgtgacgagtttcagagaatgataaaagattgccgcaaagggaggatagacaggatatacaccaagtctatcagccgatttgcccgaaacactaaagattgtctgaaaaacgttcgtgaactgaaatctcttggtattacggtgtttttcgagaaagagaatatcgatacagctaatatgaccgatgaaatgatgataacaataatgggcggtctggctcaggaggaatcgacttcgatttcgcagaatatgcggtggagcataaaaaagcgaatggaaaacggcacaatgaaaatgtgcaactcggtgtttggatatgaacttgtcaacggtgaattgatcttaaatcaggatgaagcccggatagtcagaaaaatatttgattggtatctgaacggatacggaagtgaaaaaatcgctcagatgttaaatgaaatgggaattggaaaaagaggtagatcatgccactggacaggacctaccgtgagagttatgcttaaaaatgaaaaatacatcggagatcagctgtttcagaaacggtttacaacaaccgttttgcctcgtaaaaatttgccgaacagaggagaattacctcagtattattacaccggatgtcatgaagccgtcatttcaaaagatgtatttgacagagtgcaggaattaatacgtcttcggggtgaaaataagcggaatgaaagccgcggtaatatactgtccaagaaaatcaaatgcggtgaatgcggaactactttccgtatgaaaaattgcagaggaaaaatatattgggtttgcagacttcataccgatgaaatagaaaagtgctcggtaaaaccaataaatcaagataatatccactctgcttttatcagattatgcaataaactttggtacaattacaaacaaatccttgtaccttttcaaacagcgctgcatgatctgaaactccgaaaactcagcagtaaaactcaggtaatggacattcacaagcaaaccgccaagcttcgtgaacagacacacgtccttgcaagactgaaaaccaaagggtttctggacgaggtaaaatacattgagcagactacggagcttacagcaaaaatcaataagctgcaggccgaactgaaaaagcttacccgttccgatgacgaggacgaaacaattgaccaaatagaaatgctgatagacttttttgaaaaacaaagtaatccaataacagaatttgacgagtcgacgtttgagggcatagttgaaaagatcgttgtgataaatcagcatgagctggaatttcacttaatcggcggtttaaaatttaatgagaagataaaatagacaatttctacatcataaatttattgcctttggatatagctatttcaaaggctttgtggtattgttgttttcggaggtgaaattaatatgctcaaaaacagagtaatcccattcggctactgcatgaaaaacggcgaaataaccaccgagcctaaagaggtttacgcagttgcaacaattttcagcgaatatcttaatggcaaaagtcttttgcagattgcaaagcttatggagtccgaaaaaatccgatacaacagtgattccgatcattggaacaaaaacatggtcaagcggatcatagaaaatgaaaagtatctgggaactgacaaatatccgcagttgatcgatgaggatatcttcagacaagcaaatgaaaagcgagtgagaaaagcaaattcactttgcacaatttcagaagacctatcggaaatccgaaaggttacatactgcgccgaatgcggagaaaaggttttcagaaaaaccaacggcaagggtcgtgaatactggaattgtgaaaaccccgactgctttaaatttgaatatcgcatgacagatcagatgataatgggagcagtgatcactgttctgaactctgctgctgcaaacccaagtttaattgaatgcggcggagaggtcagcacatattccccgacatcagacatagtcagtcagcagaatgagataaatcggatgaccgatgtatctcagatcaattttgaaagaataaaatctgagatcttcaagcttgccgaaatgaaatacgactgctgtacctacagcgacagtccgcaaaaaacagagaaaatcaaggctgttcttaaagaccacgagcaattaaatacattagatattggcttattcaaagcgtgtatttcacgaatctggataagccatttttgtaccatagaggttgaatttatcaacggagtacacatcaaaaatatcacagaaaggaatgacaaaaatgtccacagctccgaatgtaacggtaatccctgcgaaagtgcagacaacggaaaaccgtgataaatatcaccaattaagagttgccgcatactgccgtgtcagcacagaacaagaggaacagcagaattcatatcaggtacagatcgcctattacaccgatttgatcaaccgaaaaaaggaatggacgcttgccggagtttttgccgacgaagggatcagcggaactcagacaaagaaaaggacagagtttaaccgaatgataagaatgtgcaaaaacaaaaagatcgaccttgtgataacgaaatcaatttcaagatttgcccgaaatacggtggattgccttgaatatgttcgacagcttaaagacttgggtattggcgtgatttttgaaaaggaaaacataaacacgctgacaatgacaagcgagtttatgattgctttgtacggttcattcgcacaggctgaaagtgaatccataagcaaaaatgtttcatggggaaaggaaaaagcctaccgtgagggcaaggtgtcctttcagtataaatatctgctgggttacaaaaaaggtgcagacggcaagccggagatagttcccaatgaggctgaaactgtacggttgatcttcagtctttatcttgacggatataccttacataacatcgctcagaccttaatgaatcaaaaaagaattaccgcaactggtaaaagtgagtggtctaagggtgaaattcagagaattctgaaaaatgagaagtatgtgggagatgcacttttgcaaaaaactttcacggtcgattgcattacacacaaagttgtgaaaaataacggagagcgcccgatgtatcttattacagatcatcatactcccataatcgatcgtgatacctttaaccgagtacagcaggaaattgcaaggcgaagttcaaaaagaaaaatatccgatcataccaaaacagagcaaggaaaatacagtggaaaatatgcattgtccgaattgttgatatgcggaaattgcggaactccgtacaggcgcagaatatggacaaaaaacgggaaaaagcaagtggtctggcggtgtatcagccgtctggaacacggtaaaaaatactgccccgattcgcctacgatcaaggaagaaaacctgcaccgtggaattattcgttcgataaataactactattcctgccgtgacgatattgttcggatattaaaagctaatatcggatcggtgttggagtgccaggggcaggaggaaatactttcgattgaaaagcgactgaaagagatcgaccaagcaagaacggatctggtcggactgatagtttccggcggctgtgacgaggacaagcttgacagtgagtttgcaaagctttatgccgaggaacaagagttaagcgaacgattggaaatgctcaaatcgcagaataaaacttctgccgaaactcagcaaaagcttgataagatcacggacatgatagagcatgaaaaattcgagttggaaacctttgataatgtgttgatcagaaagctcatcgaatgtgtaaaagtcttaagtaaaaccgaaatactggtgatcttcaagggcgggtatgaagtcagaacggaaattgaataatgtgaaaacagcttgcggagaaatctgcaggctgtttttttcggaaacgaggtgaaaattaaatggcgaaaaattttgagggaataaaaaaccaacgttacggagttgaaattgaatgcaccggcttaacaagatcgtcagcggcaaaggcggtggcaaaggttttgggcggttcgccggagcattacggcggcagttatgacagatatgatgttaaagacagtaaaaacagaacatggaagatcatgtccgacgcaagtatacgatgtacaacgaagaacggctcttcggcttcaaagctgtattctgtggagcttgtaactccgattctggaatacgaggatatgccgacgcttcaggaggtcgttcgttctattcgccgaagcggaggcatttgcaacgagtccacaggaattcatattcacattgatttttctccgtatgacgcgcaaaagcttagaaatcttgtaaatatttttgcaagcaaggaggatatgctgtatcaggctttacaggtagattcaaaccgtgaacggaattattgcaaaaaggtagataagcactttcttgaagaattgaacagaagaaagccgacgagtttacagaccataaaacggctttggtacggagatgacgccgattatcactcacattacgatccgtcacggtacaggtgtttaaatttacatcccgtctttacggataacaatattgaagtgagagctttcaacagctgcctgaatgcaggcgtgctcagggcgtatatttcgctggttctggcggtcagcaatcaggcgttaacgcagaaatctgcaagcccacgggtaacgcaaagtgaaaatcctcgttatacgttcagaacatggcttatccggataggactgaacggacaggaattcaagaactgccgcaaacacttgctttctcatcttgagggcaatattgcttggaaaaatcccgagcaagccatagctcagcgagaaaggctcagacaggagcgtatcgccgcccgtgagcagcgtgttgagcctgtaagcgagattcgggagttaaacgaaaatgtacccgatgagatttctgagccgacagagagcgaatgtgagggctttgaagaagatcaagatttagacatagaaatggctatgtagatcggaggtcgaagatgaaaaacaaacagttatatattgcatacggcagcaacattaatttgcaacagatggcatacagatgtccgcattcaagggttgcgggaacatctgagattaaggattttgagttggaattcagaggcgttgcgactattgttccgaaaaaaggagcaagcgttcctgttctgatctgggagcttgacgacagagatttgccagctttaaatcgctatgagggttatccgagactttacaggcaagaaaaaatgtcttttgagctggacggcaaagaagttgagggtatggcgtatctgatgaaccaaggagagatcgctcctccgagtagacagtattacaatacgattttgcaggggtatagagaaaacggtttagataaaagttatcttcagacagctttggaaaattcactgcagattgaacatatggtaaatgatgaatttgacgaagaatattgtgcggaagattatgatggatattacgacattgatgattttcagatgaaattttaaggaggtttgcggtttgaaatacaaagggtttcatgtaaaaataactcccgacagtgatctgcttcgggaggataaggatggaaatgatgtccgttgtgagggttttactattgaagtttttgcagatgagtccgaacagcttgagatagatattttttcggctactgtggattttgaactgctggaaaacagtctcgaagaagcggagcagttcgctaaggattatattgactgcgaggaaaaagagtactgcagaatgatagatgagtataacgaagattgattggcagcgtaaaattggatgtttgaactgagcatccatttggtatcagcaagacatcgcagcgtggtctgcagtttgccctccgatccatttgtatgggtcggagggtttattattatgttggctgcataggacatggggcaatgactgatataatagtacaaaaaaaaggactgctgcggtcaggcggcggtcctttttggtattattcttcgatttgtttgcccaggaacattgcggcggctttggcgagcatggactgtttatcggtacaaagctcggtatcgtcggtagccatgaaagccactgcgcctgttatatcgccgtttgtgaggataggggcgatggtgagggcgtgggtggtgataccctcgacggctctaagcggctcggctgtggtatcggtatagtcaaaggttttgcggttttccaaaagctcctccagagcaggggagaggcggcgctgtgaatactcttttttcggcacgcctgacactgccacgacgtggtccttatcgaataccacggcaggcgctccgccaagctttgagatgacctccgctgcctgagctgcgccctcggacatttcgtttatggcagaatattttttgaatatcacctcgccgtcggggttggtgtagatctcgagggggtcgccgttactgataacgttgacactaagaaccttgcctttgctgttttttatggcattggcaagttgtccggctgactttttgctctcagtgcctttattaaaattttcggcggctttttcgctgacatctgccattgctgatacgctctcaggtttgtcaagtgtaccgtatgttagcaggcagtcaatatcagctttgagctgaatatctatatgatcttcataaactgttattttgtcgattatcagatttatgtcatttttgtcaagggtaggcttattcaaaatattgtcgaaaatttcaaatacggtttttgcggttcggtttactcttactatggcattatttttatccaccgccagttgcaactggtttttcagtccctctattcgcaaggtaagctcgtcgatcatttcggtgtaggtttcctcaatgatctctgtacgctcagggtgacgcattacatctcttgtctgctgacgtgtgagcattttcatttcagcttttgcgtcctcgatctgtccttttatcagctccacgactgacttgctgtttttgctttcattctgttccttagcgatggagttttgcagacgtttgatcatatcctgagaattgtcacggactttttgaatgtactctttaagcagcttatcaagcatatcgacccttgtgtgatgtgatgtacagccttttgttcctcgtctgtgatatgttccgcaggtataagcggtggcaatatcgtttctgctcattgagaacattggtgaaccgcagtcgccgcagtagagaaatccggaataagcattctcgtattttcttacaccacgatagtgagatgtggtacgttttttgagattctcctgtgccaatgcgaacaccttgtaatccacgataggcgtgtggttgttttcaaatacaatgtggtcagtctcgtgttgcttgacttcatcgccgtttatccttttgcggcggtatttgccttgacggagggtgcctatatagaaatcgtttgacaatatttcgctgatagttaccaaactccaagtttgttttgcctcacgtttgcactcttcaccgttcgcctcttttcgcatcttctcacacatacgaggggtagggatatgtttttcagtaaggtaattcgcaatttttttgtaaccccagccctcattatacttttcaaaaatatcacgcaccacctgtgcggcaggctcgtcaacatcaaatttcattgttttgctgttggtcataacgtaaccataaggcacggcacatatccatttgccttcttcctgacggcgttttattactgacttgactttttttgaggtgtcggtaacgggcatttcgttaatgagaaatctaaattggatagctgtccaatcgtcataggtaggataatcaatgttgtcacctattgagatgatcctcataccggcatcacggagatcttcaagctctacaagacctttgctgttgcggcgtgaaaatcttgagaagtctttgacgataaggatatcatattccattcgcagcattttctttcgcagttcctgatagccctcacgctgttcaaaagtatatcccgaacggtcacgatcttcgtaaaattcaagcgtgctgtcggggaattttcgttttacaaagtcagttatgatagctttttggttctcgatagaggtgttgtccctgtccatttcctcgtcaacagaaattcggcagtagcctgctatgctgtattttgtgctcataactttcaccctttctttgatatatggtacaatgttgtcacttttgattatggatcttacccttgcggatacatacaatgttgttagttttatatattttattataaataatattgtatcacatctttgcccaaaaggcaataggcaaaggatataaaaataatggtggagtgtatgtaaagtgcaccataggtgcactcgctgtcatagagtgagattatggtggagaagattttcggtacattcgtacagatcttttgagcctgagcggaacacggcaactttgaatttttcaccgctaagctcctttatcttgcactcaaccaaattcataactctctcattttgttgttctgcattgctcagccagatctgagcgatgcctgatttttcgttctttattatctgcaaaagcaacactccttattacgatttttgccttttttgtatagtgttaatcagtttgcacattttgctttatcgcctcgtttctatatgattttattgtcctatgacacctattgcaaagttcgtatttacgccatttgagtgcgatttctgtaacttgcgacccctaattttctttgaaagccgtatcttgaccccataaaaaatatgcacaaaggcttttctaaaactgcgtatttacggcacttttgcggcgagctttgctcgtccgctgtgagtgtttcgggggctgcgaccccgaaactttaacttgcaatgaaatatttagctttggtggttatagctctagctgctgaattgtgaaaagtacataattgctcaaatcgttgagttcgacttgcacaagctaaccttatttaaaatatcgcccacatcggctcacaaatcgcttgtgttgggtttccatttggctttgctaaacttacccgactgattttttaagcccacaaatcgcccaacgttcgctgattggggttgacagtaaaacttttatttgaatcttaccgtcacactctgtgaattaagattttacaaggtttttcagactttttgaatcagcttgttgacagtaacttcgctagtgtttttactgtcactactgtcacgctcacggtcgtaatgaagaattatcagcctgccgtttctagttcgcttgtactgaaaatctatcccgtactttccgagtgtgtagccgttctgaaccagatctcttgtaactctgtttggatagacttgttcttgcgtgacttcttttagttcacttacaagttctgacgccgtacctgaaaaatcaattctctttttgatgtaaacatacaatgccgcaagaaaaatgttggccttactttttggagcggtcggctcatcggtaacgacacactttttcaaatcactatcgaactgcaaattaatttctgcgttttcaatatcacgtcctacacaataaagttttgcattacggctgccacgttttgtttcgatcagaaccatacttccgtcaacacaaccgctgattcctgtacttcctgagatcatattaaacgggtccgtatccttgcattttcttgtatgatgtacaactattattgcgatttcaagtttgtcagcaagtgctttcagaacggataggtctttgtagtctgaaccatagcttgaatcagtatcgctgcgaatcatttgcagagtgtcaatgaacacaatttttagaccgcaatgttcaattttaaaactttcgatttgttcttcaagtccgttgccgatagattcagacataacagagaagtacaaattttcagttggcacatcagttatttcatacaagcgattttgaatacgaacgtagctatcctctaaacacaaatacaatgccgtgccctgcaatgttttctgacctaaaacactttctcctttcgctattgacaagcacatatcaagtgccagccaagactttccgacctttggtgctcctgctaaaatatacagaccttgtgcaagcaagccgtctataacgaactctattggcttgtacacagttgtcattatttcttcgcaggatcgagtgatgagttttttcacgctaccagacctcctattctattttcaagttgccgttattatatatgtaatttatgcaaacaaaaaagctcgcacatatttcagattcacgatttggcaacaggatatagttatcctgttgttttaaatcgtgcctgataatatgtacgagcttacagctctaaagtagttgattatgtgtttttttatgtatgtggtaggcagattgttttattttataactttcattatatatcataacatataacaatttgtttgtcaatagatttgtttatctaaaaatgtaagaatgtgttcagttgtcaatgataggtgacacatcttctcaaaaaataatgttaagtaactaattgcagcttttcatttggatgtggcagcttattctatttagaatagtcctaattttaacctatcaatatcggctcctgatatctgtttgtacgaattcataagattttggatcatatttaatgacgagcgggtcgaatgaccagttacatagtgtactgtcggagaaaatttattataagaaaaaatggctttggttttataggcttgaccatacagaacctttcctcttagaatttcaaatgaatatccttttccgtctcttgcaatatgcttaaatggttttgttaatgataattgctggatcttgcacctaagtctgttagtcatttttgagcaaagatcaagtgtattgaatctgtcaacaaaaatacttccacagtctttacacagatgtttgtgacctcttatcttaagagctgtataatgctcatttatgttgatatccctgacaagtttagtatatcgaccgtaattgacaacattgcagctcccgcattttgtgcatatctttgtttcaattttaggcgaaacaacaaaaagataatcacactcatctgcattttcacgcagttcaagtatatcaaattcatcaagacaaagcatattttggtcgtggtttataagcatattttatcctttctttacaaattttttcgcagaggacaaagcctaattactgaagataagaggcaactatcgttcaaagtagacatcattatctgaattatctcctcactcaaacactcccccgtcaagctgtccgcagaaataaagatcattcatagtcggctcgctcataacagcgttaggggtgggctttgtctttgagatagtcttcgactttgtatcctcataataaatgttctcgataggcagcagaccaatgtccgctttcggaatatcccaaaccataccccttatgtgctcaaaaagcacatcggggctgtcatttgcaataactgagcctttattcaagatgataagattgtctgttatagtgtcgatgtcggaaacgatgtgtgttgagattattataatgcttgtttctttgagcttcaccattatcctcttgaattgctcacgttcgaatgggtcaagaccagcagaaggctcgtcaaaaatcagtatctcgggggagttaaggatagtctgtgcaatggcaaggcgctgtttcattccgccagaaaatgactttatcttgtcatcaagattttcagacagattcacaagccccagcacacgtcttatctcgtcctcaataagcggctcaggcattccttttaacagagccgaaaatctgagaaattcatgggcggtgtagcttggataaaatggctgatactgaaactgaaagctcagcttttcacgatatttctcgcccatttcaaaaacgtcctgcccgtcaagggtcacgctgccgcccgacttttttatcacgcccgatatgcagttcattatggtggtcttgcctgcgccgtttggtccaagcaaagcgtttatgcccgtatgaaattcgcaggttatgcccttgagcacctgctttttgccgtatcttttggataagttttctactcttaaaacgctcatatcatcaccactccttatcggtcaaagcttttttcataatatccgctgtatctccatgcagtcagtccgctcaaaatcgctgcaagatatatgaatacagctaccgcttccgaacaatcaaaagccctcatatagtcaaggttgttaagctgcccatttacgcttgtgacagccgcaaacatataaggcgaaagtgctcccacataatgtgcggcggcggacatgaccgctatcagcccagaggtcagcataacatattttttcacagagcgcacttgctttgccacaagcacgaaaatgccgtaggttataaaaagcgacataagccttgtgacatatagccatattattgtacctctaacagttagcattaaaggcgcaaggtcaaattgccacacgctttgtaaagatgaggtgctgtactcgctctgatgtaatgttccgcttataataaggtctgcaaaaaagctcagtgtgaacattataaatatcgccactgataaaattatctcccgtgacttaaaaaacgctgacgaatttttagatatccttatctgctgatccattctcttttcataactatctgcaacaaaaacacccacaagcaacagcacaaatatcggcataatatctaccgcctgcaattcaagaaacttcaaaaacggctcgtcatttatcacctgtggagttggaaaggcagcgtaaagtcggctgtttttcacaaggtcagagggaatattagcgtctgttagacctcttcccgtgcgtgcatagcttctgatgctttcgaccatgaaacaactgcgaagctcggtcttatacttgttcacggcggctgtgatgttaccgttataaccgcctgcgtaactcctcagctcatagtccgttatgtattcatcacattgatcaagtgtcttgtctgctgaattttctataagttcattgtatatctccgccgtttctttgttcatataggtaagattatttgaagaatcaaagctccgatacactgtgaattttgcggaagctgaaaaaattatcactatgacaaaaagcagccagaatttctttatgagccgtgaagtctgataactatacatacttttcattatcccacctgcctttcagcaaggagatatgtccctgcgacaaaaaatgcggtcatgatgaatatgatagcaaaataaacaacgtattctcgtgcaggtattccccagaaattcatataacctgtgtcattgagcatattggtgtaattgcctgttaaaatgtcaacggcaggattggaaagacttgtggttttcagatataatggtacaaatattggcacaagacagacagctcctgcaagtatggtctttctgcaaagcattgaaagaaacataacaatacttgcggtgaaaagcgcataaacaagttttgcggcaaatactgcaactagatatccgccaaagctcatattcgccgaacttagttcaaaaccgctcagatattgcaatggcatatcaagtttaaagccgtttgtatcgtaaataaaaagagttataatatccacagtgtaaattatcaaaacaagaattattacagcaacaaagccggtacaaagcttgaaaagtgagaatttcctcacgcccgttttggttattccaaagctttttatcctgccgctttgtatctctgatgaaaaaatgctgaaaagaagcaaataaacgccgaacggtatcaaaatttccgatgacatatagttttcaaagccgtcagcggctctggtgtcaatgatatcgtccgacttttttaggtctgttatcacggcgttgtaatcgctgatgagcttgtcggaaagcttcaaagaatactcatccgtaacgccacgtcttgcatttcggctgtaacctcgcacacgctcggaaatgagcttcaaagcattttgctgggaatatagctctccctcaataagagaaaacatactgtcaagtcctgcgcctgcttgtgaatttttctgagagaaatctattatcttttcctcaagttccacaggcaattcagcctgctttacaccgcctgtgttgtggttattctgatagtcgtttatctcgttgttaagagcgttttgctcatcagcaagcttttgagcgtcttggcttacagtttccgagccgcctttaagataggtcatgtatttttcgccataagcataagaaggtctgagtacagatatcaaaaaggcgcaggaaagcaaagccagcaataagcttatcaaagctgacttcgccatatcttttcttatcataaatctgagaagtttcaaatcgtcacacctcaaatatcaagctcttacatttctgactgtatctctgcatatgtatcataatcccattcgccgtttgaaataaacttgtgcagtttaaaatctttatccacaagataagcggctgtatcagcgtcgggattataggtcgaaagaaggaaataatcctcacagttattgaatatcgtcatatagtcgatatactcatagccgtaaaaatacttttcattgagcttagcatcatcaattatcttctgcggtttattatcgttatcaagataataaagcacatactgatacattttgccattatcatttggctcacgaacaagcactatcatagtgttattgaaatactgaaaatatcttacaaaagatttgtctttaaaagtgcaaactgtgtcacttttttcattatcctcattatacctatacagcttgtttttgccattagagtaatacacatctccgtcggccggataatacatatacggcgtattttcgcttatctgagagccaacatcaatgcctgtatccttgacgttctgagggtctgaaagtggagctataaataggcggactgtatccgtctttgggcaaagccttgtaaaataaagcttgccgtcgcttatgtaataggtattggcttttgttatctcgcttttgtcagagtttttgagagcgtatttatatagcgaatagcctgtgctgaatccgttctcgtcggtctcgctctttttgtatttgccctcaacaaaatagatatctccgtctttgtccatagacatacagcctaatatgctgtcctttggtgcagaatacacttccgtgacttcaccgctgttgtaatccactgtgacaatgctgtaatcttctttttgcgtagcagaattatacactgaccttacagcgtatataacgccgtcatatatggtatagcaggacaagtttgaatactcttgaagcttgacctttatcattgcaaggctgtcggattcgatatcatattctgcaatgccgtcataggttttgtaatacacaaaattgtttgcaaatgcagtagaagaagcttcaggacacaaaaggtttgtgggagaagcagaaagttcttgttgacccttttcagaagaaaccgccttatcggattttgtgccaagagaaatgaaaagtgtaactgcaactgcggcaattataactgcggctgttgcgataataattttagttttcataattcacactcaagttctattattgactatcaacggaaagcgttgtgctgtaattgccatgtaccttatcattataaatatgtacagtttttactaactttgaagatgtacaaccttttaacccaaacgaatgctcaattttacctgtgtcagaatgagatgatccacaaccagtaccaccaacagaggcacttgcataaacataaccgctgtatttacaatttggattgtaaacattgttattgttacttgatgtcctagtccaagcttgaccagctacagttgaatttgttcttattcctgttacaaaacatgaaatataagcatttgagccagaaccaccaactgctctgccgtattttatggcttcatacgcactagccccaatagccatagagctcatcatcataacagcagcacccatagctgcgatcctttttacgatctttttcatattaaacgtcctttcttattataacatccaaatatttgaatgtcaatgttttgttttttgattttggattatataaattttattactgcattggaatcacctgtcctttctgtacacagcctattattttagcaggacgctgttttgctgtaaatagttatggtctcataatcagaaccgttatagacctttgcgattgttttaagacggtatgtaccgctgcttaaagactctttggaatttgaataaatcgcataccaactgttgaatgtttttgcccaactactgtatttattccatgaagattcattttttcttcttaagtgtttgagttataacgattttagtagttgtacctgaaataccacgtacagtggatttacaagttgcagtcttgttggagattgacaatgtacctgatattttatctgtgtataaataacaaacagaaatgtcatcgtcagaaggcgtttgcagtttggattcggcaaaagctgtaagtgacaggcatagcataataacaaccgatataattgtagatatcacttttttcatatatgtaagttcctcctttcacaaaaaataggtgcaagagatttattttctcctacacctactatgataatgaaaattgtttgtttgtgatatgtttttattaatttactttatttttgtggattcacacaattccaacacagatcgtttgtctaagttgctgcatatttcaaaaatatatttaccattgtcccatataaatgtatgatcatgatctgtattatgaactagatactcttgtccgttttcatctttatatgattcaaatgttgactgttcattatcataattactaagatatgcatcttttgtgtattgttcaaaaaagatataatcatcatccttgaagtatgttattataattgaattttccattttatcatagtcgacttgtttaaatccatttggaagtgaagatatatgatattcctcgtcaatcgaatgcggatatgaattctcaatttcactgtctgctataatctccgtatggtctgaaaaaatattcataaagaaatcacaaactgcctctctcacagcttttacgctaagcgaagaaaatgataggatcaacaatgctgcaacacaacaagcaacacgtctgccggtcgtgcatatcagagtaaaatagggcttttctctgtgttttataagtttgtttatttttttattgtacttttccgaaaattcatatcgtttgtctacttcaagagtttcaacataatcatccaatctggcatctacgacttcatcgagagcttttgaaaaatatgaaaaattattcatgttataaatcacccttttcaagtaatatcttcaatctgtttttggcatactgcagacgttttcttgctgtggcagatgtaatgccaagcgtttttgagatttcagaatattcaagtccacacgaaaactttaaataaagaatctcttgatcgtcaactttcagtttctttatgcaacctttcaaaaattcaaattcgtaacatgacatattttcatttacaaaataagaatcatcatcgtaggaaaccgtcattaaattttctttttcctttttagatatattctttgccatgttcctactagttatgacaatgtaataatccaatttgtgatattctaaatgtttaattttttgaaaacatttagccaacgataaaaaagtgtcagaagttgattcctcagcaagttgttcattttttaatatattcaaggatattgcatgaactttatttttgtatttattatacagcttttcaaaagcctttttatctttttcatcatcgatcaatgccatacacacgccaagcatttcatcacatcctatatactttataatgtatcaagtataacattatttatgtataaattcaagggggatgttttgtagaagtaaaaccttgttgattgtgaaatgtttgttaacatcaacacggaagttgaaatagccttttagtgacaagacttgacatttaccattgaattgattataatagtattgagaagatctatccgtagcttttcttagtgtggctgacacttgagggacgcattagaaatggtgacgtgtatccgaaactgtgaagttcattgctgcttgaaagtatagtatgcactgtgcaaaggcaaaacgccctctgcatgaaagttggtcgaccgcagcgactataaaaatcagccttgctatgaaaaagaccgccctgaattatcagagcggttttttgatatgtgcttgacattgtcgaaaaaattggatataatgatatcagcaacgaaacgttgtcagaaaacaggagttttcggtcagaactgacgtaaacttgatagtcgtggcagttctgttaagcgatgataccaaggggcgtgccaagagcgttgcttggttgagctttcgggaggggttgcacagtgaaacctcaacttggcttaggtgtttgccgaaagaaaatgtgaatgataagacgctgtctttttgacggcgtcttttttgcccaatctctagtagaaaaagcccaaagccgtgtcccctaaccaatcgccaatgctttcaaaaaggtcagccgccgcactgcttaaatagaacatcatgctgaaagccatggatatgagccataaaaagcctatcaatacaccgccttgcaagcctgtaagagagccattctgaatgtttctgacaagtacgatagtacctccgatagccaccaatacaaagacacttccaagtatgtattgcaaagcgactaagacctcagaaataaagttcagaataaacgcaagcaagtatagaacgccctttagtataaacgcaactatcaggaaaactatcttgaacggcaataaaagtatcgacatttttctcccccttgcataattgtcatgttgtttttgtaacttatcttcaatattttatcataaaatgccctataagtcaattacagtgcagcaaaatttccataaaatgcgttcaggtgttgaacggtgttttatggaactttttggtgtctgtatacacattaataatgtggacccccaaaagttagttcaggtaggaaaacgggcgaacactgttcgcccctacagtggatattatacaaaattcatgtggtcaatttgtgcaaacaaatgatttatgatttaatttggcaataatccattaattgttgcattttttatgcaacaaaaagagcatttttcagggataagtagaaggcgtcttagatacttgcgggcacgtacaagccctgtgacttagtgaatacgatgagagattctggaacaggctgtagagtacttgtatcaggacgtgggcgtgcattgtgatattttgtgtatacaaaacctagggcataatacccagtgtcatactccgaatgcaacttgaaaattgaataaaaaaggctaaaacccacggcaacaaaatcgtaggggcgaacaccgttcgcccgcttgttttgtcgtttcgctcactatatcatttgcattatccgcacaaaaaaacaggaacgaacaaagtccgtccctgtctgcgtttcaattatgtaagcgatgtgaaatcatatttcgctgtcattatagcactcgaacaccttttcagcatgagccttgtcagcgtcgctctgccttgtgataaggctaacgataggtacaagaacaagtccgaaaagcatcgcaaatgcgcctgcgttgataggtgaggcaaggtttatgccccaaagtgtgcctgtgtgacctgcaagggtgtagtatgccatgtgtacgaccgttatgcctactcctgcgataaagcttgccatgcaagccgcctttgttacgcccttccagaaaagtccgtacataaacggcgcaagaaatgctcctgcaagtgcgccccatgagatagacatgagagttgaaattactgtctgtggatttttaagagtgattattgcaagcacaactgagatgataagaaatacggcaatgaaaattctcattgtgataagctgttttttctcgtccattttttctttcattataggcttgataaggtcgatagtcaaagtggagcttgatgtaagcacaagcgatgaaagtgttgacattgacgccgaaagcacaagaacgataacaagtccgaaaagcagtgaagggagtttttccatcatagtcggaactattccgtcaaaaccgccctcaggaagtccgtcagcgctcttgacaaaaagtctgccgaagccaccaaggaagtaacagccgcctgctaccactactgcaaagaatgtggatacgatggtgcctgttttgatagccttgtcgtcttttattgcatagaatttctgcaccatttgcggaagtccccatgtgccgagagaggtaagaataacaacgcctgcaaggtttatagggtcaggaccgaatagtgacgaatatgcacccttgtcgccatttgcgtcagaaatatcaccaagcaggtcaaaagaatttccaaggccgccgttttcgccaagcactgcaagaactaccgccgcaatgcctacaagcattactattccctgaataaaatcgttcagtgctgtagctttgtagccacccatgataacatacaccgcagtgaaaactgccatgccgattatacaatatttgtaaggaatgccaaagcccttctcaaaaagtcttgacaagccgttgtagaccgaagccgtataagggataaggaatacgaacacgataagtgccgaaactatcttcaaaggcttgctgttgtatctcttttcaaaatactcaggcatggtctttgcctcaaggtgttttgacattatccttgtacgtctgcccaaaactttccatgcaagccatgagcctatgacggcgtttccgattcctacccatgtggaagctacaccgtaattccagccgaattttcctgcgtagcctacaaaaattactgccgagaagtatgaagttccgtatgcaaaggctgtgaaccatgctccaagacctcttcctcccagtacaaaatcattgacgcttgccgattttctgcggtaataaacacctatgcctatcataagtgcaaggtataataccaatactatccaccttgctgtcaatccaatacactccttttacttcatgtgtcgctttaaagcttttatgcttttgcgtttttacttgctaaagtacaatgatactattatagtacaaagcggagtatttgtcaatacggacaggcataaaaaaagccaccgcaaagggagattttgcggcagcttttttggtaaaaatcacgaagtttacctgtgtaaaacatcatcgttcatcatgacggtcgctttcgcctgcggtgatacaaaggcacattgtcacaacgcccacaaaaccgcctaccagcgttcctgcaaaaaattcaagcataaaaacacctcctgctgatagtgtgggcatttagcgaaaatgttatgcagataaagtgggcagggtatagaaaacttatttcagtatgcgatctttacagtcagagccattacagcgagaaaagcgatatttgcggctgtgaaatatgcgaaatatctgcctttgatatgggggtggctgcggcatatctgcttgtaggatataaggcttgccatggaggcgataagagtgccaaggccgcctatgttcgttcctattataagtgcgttcagcttgttggtgaagcctgaaaggagtatagcgcatggaacgttgcttattatctgacttgcgacaacggcaataaaaagctcgtgaccgtttattatgctgctgagtacactgcggaaaatctctactctgcccatatttccgataaagatgaaaaatccgcagaaagtaagaagcagtgagtaatcaactgttttaagcacgtttctgtcagcaatggcagagaaagcaagtgcgcagagggctgttatctgccatgggacaagccttgcaactgtaagcaggcaaaggacaaaaagcaggacgtatcctgaaagctttgtcttgtctttagtcgaatatgtatcgaagttttcagcagttatatctgtcttgacagacagctttcctgactttttacacactgcaagcgtccacagaaaaagcatcgctcctgcaacaatagtaaagggaagcataagtacaagaaaatctttcagcttcatatccgatacaccaaaaaggtatagattctgaggattgcctataggcgtgagcatactgccaagatttgcggcaatggtctgcagaacgacaatgggtatgagaagcttgttgcctgcttcaccgagagttgagagggcggtgagagtgaggggaacaaaggtcagaagtgaaacgtcatttgttatgaacatacttgaaaagaagcaaagccccacaagcactatggaaagctgaaatgcggtattgactttgcttatgataaattttgcactgcgttcaaaaatgccaagacctttgcaaccctcggtcactgtcatgagagagaacagaagtccaagtgttcggaagtcgatataacttgcatatgctttgtcaggtgtgacgaaaaatgcagatataacggctaagagcattgccactatcaggacggtttctttttttgcaaaagtgatcgctttgtttatgtttttcattttatcatttcctgtcgtttattcatatgataaaattatatcatgaaaatgatattattacaagattttgagctgctttaagaaaaaacttgacaagtttaaataaccatgttataataacaatgttattataacatggttattttcaggcaggtgcaaaatgagaacggaaacagcaggagttacagaaactcttatagagagtgcaaaaaaagaatttcttgaacacggctttcaaaatgcaaatcttcgcaggatctcttctgagagcggagtaagtacggggtctatatatacacgctttggggacaaggctggacttttttcggcagtggtaaagccggctgcagacggacttatggagttgtatcttgaaagcataaccgctgcaagggagagcggcgaccctgcggaggcgacaagtcagggcaatgagggaactgagcttgtgctgaaatatatttatgaaaactttgacgttttcaagcttatcttctgccgctcagcaggaacggagtatgagcattattttgacgagcttgctgagatagaggaaaagtattacagggagtttgtaaagcagttttcaaggcgtgaaaacatggtgagtgacttctttatacacgttatctgccgaacaggctggtcttatatttacgaggtggtctctcatgatctttcttatgacgaggcgcagatctttatgaaaagcataagagagttctgcttcgcaggctgggggaaagttctggggcagaattatgaggacctgggcttgtagggtcttggtgttgttagggtttttagtagaactttgagcagggagcgggacgtcgtatttctgcaaagcagaaattgcgccgctcccctacagaaaagatgtcaaaatcatttgacttttttaacattttcagcaaccccttatagggtgttgctttttaaatggtaataagttagttaaacctaactttataaacaaacaggaggtattgttgtgaaaaagaaagagaaaaagaaaagttcctttgcagttcttatgcactatgcaggcggacataagtattattcctacgcttctgctgttcttgctgtaataagtgcatggatagcactgataccgttttatgatgtttggcgcatcataaaagagatactcagggtaagacctgatttttcaaaggcggagaacataagccgatacggctgggaggctgtgggctttgcacttcttggaatggttatatatatcgctgcgctaatgtgttctcacaaggcagcgttcagggtgcaggctaacatgagagtgagcatgatgaagcatattatgaagcttccgcttggttatgttgaagctgagggaacaggaaagataagaaagatagttatggattcaagtgcgtcaacggaaacctatcttgcccacaattttcccgacaaggctgtttcaatggcgacccctgtgggtctgcttgttatgatgttcatattcgactggcgacttggacttattagccttatccctgcgttcatcgcatttgtgcttatgggcacgcttatgatgggtcctaaaatggcggaggatatgaagcagtatcagaatgcacttgaaaaaatgtcctctgaggcggtggagtatgttcgtggaatacctgttgtaaaaacctttggtcagacgatattttctttcaagcgtttcaagcttgctattgacgaatatgaaaagtggactcttggatacacaaagaacatgatgcttccgatgatatgcttcaccactgcggcaaacggcatttttgcggcgcttataattgcggctttcaaactcacttcccatggagttacggacgagtttgttcttaatcttttcttctatgtgataataacttctattcttactgtaacgcttatgaagatagcatatgcaggagagtcacagatgttggtggacgacgctgtgaacagaatgtattctattcttgaaactgagccgcttgctgagacaaagagcggtgaaactccaaaggactcatctatccagcttgacaatgcggtgtttgcttatgacaatgcagagagcaacgctgttgacggaataacgatgaacataaaggcaggagagcatattgcggtagtaggtccttcaggaggaggaaagaccaccctttgttcgcttatcgcacgtttctgggacgtaaagagcggctctataaagataggaggggcagacgtgagaaacattccgtcagaggagcttatgaagtatgtttcatatgttttccaggacagcaagcttcttaaaatgagcattcttgaaaacgtgcgcatgggcagacctgacaccacggacgaggtggttatgcaggcgcttcgtgacgcacagtgcatggatataatcgagaagttccctgagggtgttgatactatgatcggctcaaagggcatatacgtttcggggggcgagtgtcagaggctttctattgcaagggcgtttttgaaaaatgcgcctgtgcttatacttgatgaggcgacggcttttgccgaccctgacaacgagaggtctgttcagcaggcttttgagaggctttcaaaagacaagacagttataatgatagcacacaggctttcaacggtaacaaatgcagaccgcatttacgttctttctgagggcaggatagcagagagcggaaagcatgaggagcttatagagcaggacgggatctacagccgtatgtggaacgaatacaacaggtctgtaagctggcaggtcagaaaggcaggagtttgattatgagcttcacggaaaaattaaaacacaaatatgccctttcagacaagggtgcaaaaggcatgataagggcgtttattgctgttacgcttgctaacctggtgcttatgctccctgtggggcttttatatgtgctttcctcatatcttcttgagggagagcttccaagagataagttctggctttttatgggggcgatagtgggcgtgcttttgcttattgcccttacaacgctgtttcagtataagtccacgttttactctacatatgttgaaagcggtgtaagacgaaggacgcttgcggaaaagctcaggaagatacccctttcatactttggcaagaaagatcttgccgaccttacgaacactatcatgacggactgtgcaatgatagaaacaggctcttcgcattggatacctgagcttgtgggcggtatcgtctccactactatcattgttataagcttgtttttctttgactggagaatggctcttgcttcagtttgggtaatgccggtagcatttatgatagttatttcttcaaagaaggttatgtcaaggatacacgaaaagacgatgaaatatcgtatagattgcattgacggcattcaggaggggcttgaaactctccgtgacctgcgttcatacaacatgacagagaaatactctgaggggcttgaaaagaagataaaggctgtggaaaagcacgctatcgtggcggagtttgcaaatgcggtatttgtatgctcagcgcagatgatactaaagctcggtattggaactgtggctgttgtgggaagctcgcttcttgtaaagggtgagataacggtgctgacgttctttatgttcctgctggtggtaacaagaatgtatgagccgcttcagatagcgcttcagaatttggctgctataataagccttgacgcaaactgcaatcgtatggacgagatactttcgcacgaggagcagtcgggcagtgataagcttgacaacaagggttatgatatcacattcgaccatgttgctttctcatacaagagtgaagagcaggtgctttctgatgtaagcttcactgcaaagcagggggagataacagcgcttatcggtccgtctggcggaggaaagaccactgttgcaaggcttgcggcaagattttgggataatgacaagggcaagataactgttggcggaatgaatgttgcagacgttgaccctgagaagcttttgtcactttactctatcgttttccaagatgtaacgctgtttaacaacactgttatggagaatatcaggataggcagaaaggacgcaacggacgaggaggttatggcggcggcaaggcttgcacactgcgaggattttgttgagaagatgcctgacaagtggaacagcatgataggagagaacggctcggagctttcgggcggtgaaagacagcgtatatccatagcgagggcatttctaaaggacgctcctatcattcttatggacgaggctacggcttctctggacgttgacaacgagtcgcttatacaggagtctattgcaaagcttatacagaacaagactgtgcttataatagcacacagaatgagaactgttgacggtgtggacaagatagttgtgcttaaagacggcaaggtggctgagacaggctcgcctgaggcgcttaaaaaggctaacggtatctacaagcacatggttgagatgcagctttgctcggagaaatggaaatactgatatgaatagaaaccaccgctgggaggaaagctctcggcggtggttttggtttgtttgcgtattattttgcggagatgtttccgctttctgattttttgataagacctgcggtgagagcttttttcagggtgtagcttattacgctctccgttatgcccacagctcttgtgtagccgaatttcttggctgtttctcttacgaggtcggtttctgaaaggcttatctgctggcaaagcacttctttcacggcgtttattatctcctcggaggggatatcctccatgcttcgcttgttggtatcatcgcttgtgcgatagatagaatagctttcaggggattgcccctctttccaaaggaaaactctgttttcatcggctgtggcgaatggtgaaacgccttgtgcggcatcggcaaagatgctttccactcttgagccgcttcgtgttatgccccatgcggtgaaaacttttctcatgaaaagcttctcgcttattggtgcttcgacagcgatcatcttttcggctgtttcccttattttctgcttgttttcgggtttataaaagtcatcagatgtacccattatgccaatatctgcggtcacataaggctgtgcaaagtctgatgtgatggcggaagcctcttctctttcaaactgcgatgtggaatagactgcaggctttgaggggggagcggtttcggcttcatgctttggtgcgctgtctatggcggcttttatgtttcccagaactcggtccttatcgtcaaaccaatcgagcgtccacactctcaggatattccagccaagaccgttaagcacgcttggctgtaggataaatctatcctgtgcggttgagctgtggagagtgttttcaccatcaaggagtatgcccaggagatactccttttcgttgtcagggtcgattatgccgatatcaactttgaactcggagcttccgatgttgcatttcaccccatagccaagctcttttatggcttttgcgatacactctgttacagtgctgtcgcttgtgctttttgtggtgctgtgggctgttacggcaagctttccacgctcggcaaactccagaaagcctttaagtcctgcaacgccctcggaacgtgttcttgaaaggtctatctgctcaggacggaggacagagtagactatcatggcttttcttgcacgggatattgctacattaagtcttcgccagccgccgtcacggttgagagggccgaagttcattgaaacttgtcccttttcgtcaggaccatagccgatggagaagagtataacgtcacgttcgtcgccctgaacgttttcaaggtttttgatgaagaccggctctggtgactttctgtcaagctcttcaagctcagggtggtttgcccactcttcgcagagcatatcgtcaatgagattttgctgaacggagctgaatgttacaacacctatgctgtcattgcggagcgtttcgtcgctcatgcgtcttattatctcgtcaacaacggctcttgcttccgccttgttctgctttgttctgcccttgtcatagtgaccctcggggtggataatgctcacctttgaaatgaggtcgttatgggacgggaatgtgagaagcttattgtcatagtatttcatgttgctgtaggcaataaggctctcgtggcgtgaacgataatgccatttgagatactgctgcggcatggagatagcaaggcaatcgtcaaggaggctttcaaggtcttctttttcgctgttttcttcgtctatccgatttgaggagaagaagtttgttggtgggagctgtttagggtcgcccacaataacaacgttctcgccccttgcgatagtgcctgcggcttcggctgttggcagctgtgaagcttcgtcaaagataacaaggtcgaatttcgggaatgacgggtctatatactgtgcaactgatatggggctcatgagcatacaagggcagagcttgcggagaagatttggtatcttatcgaaaaggcttctaagtgacatcattctgccgttgctctttatggcacgtttgagtatgcccatttcagaggtggaagcacaggctgagccttgggcaggtatttttgcagaaagacgagccaaaagctcctgtatagtcaggcgtgagaatttatcgagagtgtctttgaactgtgtgataaggtcgtttgcactgttactgctgaactggctaagacgtttatcgctgtttattatcataagtgcaagctgatagtttagcgtgcaggagaatgctttttctacgttttcgctgtcaacattgcctgtgcggtagctttcgctgacacctgaaagtccgttgtctgaaagctctttgtcaacactgttgaactgggcagcgtatctaagcttatctgcgttttcggcataggtattaagcttttctgcagataagccaagccaatctgcacttgcttctatggcggtcatgttggctgagaagctgtcctcaaaggctgaaagcttttcaaggaacgaggagagagcctgtccttcagatgtgcagtttgcttttccgatagtctgagccatttgtgcagggtcagcacccgctttctgtttaatggcattcataatgctgtcggtttttgaaacggctttttcaagggcattccaatcggtctgctcgttcatgtaaatacctgtgagaagcgctgttacatctgacggcaggcttcgcagaaagtctttcttttcgcttatggtgcaaagcttatcgagaatttcaccaaggtttgcttttgtaacggaagcagggtctttggcgtggagctttattccctttgtgagctttccaagcttcatggcttttggtaaaaaccagctttgctctgcctgcttatagagcattttcgattctgacgcaggaaggtcaaaaatgcttttttcaaaatggctgagaatatcggtgcagagagcggtatactcttttcctacggcaagagtatctttgatcttttgcagggtgatatcatagtgaggtgcgcagagaagtccgtcaagaagttcaccgtcagcggtggaaacgttgtatatgtcagaaagcatttttactgctgtcttgtcaaggtcaccgctgtagctataagcctgtgcgagagtttgtgcgcactgagaggaagcggtggctttttgggcaaggtcggcggcttcagtgtggaacttgtcacgctgttccatagaatatgatgtaatgccgatatctttaagtgggaagtcggcaaagtcgcctgtttcggctatggctatggaatatctatgcacaaggtcgctgaagcggtcgagagtttcttttgccaggtttgcgaagatattttttgaaactgatattttgtctttttcggatatactgcgctcataggctgatatagcttcataaagggtcacaccacagttacgcttttcgtgaagtgcggttatggtatcgttgagctgggctttctgagttttgagccttgcggcttcggctgaatactcctcgggagattttattttgcccacttcaagggctttgtcaagctctgcaaggacagtggtcttgtttgttttatttgagtggagttcaaggcagaacgggtcaagccctaggtttgcaagacgtttctgcaccacgttgagggctgccattttttcggcaacgaacagcacagacttgtcattgtagagggcgtttgctatcatatttgtgatagtctgagattttcctgttcccggaggaccgtgaagaacaaagctttgtccgcttcctgctgcggcaatggcggcaagctgtgaggagtctgcactcattggcactgccatgttttcaaggtcaaggtcggaatctatattctcaggggttatgcttatatcctcgggggcataggtgagagagccagccataaggctggacaccaccttgttttggcttatctcctctgagcggttgcgaaggtcgttccacattacgaactggctgaacgagaacagaccgataaaggcatattcctcgatgttccaacgctttttgcccatgaccgcctgacggatagtattgaaaacaagtggcaggtctatgccatgttcgtcaagtgggagggggtcaagacctgtgatactgatgccgtggtcttggcggagatattcaagaagcgtgacgtttatctgagtttcttcctgtctgctccttattatatagcccttattgcgtgtgttgcggacgatatctatagggataagcaccaaaggggcatagcgtggcttttcggaaaggtcgctttcataccagcggagaagtcccagagcgaggaaaagggtgttgctgccgttttcctccatgctcacctttgcggagcggtagaggtttttaagggcggtgtcaaggtcggcttcattaaggaacgttcttatgcggttgtttttgaactcgttctcggcgatatttgtcacaaggtccttttcgttctcgatagcaaatatttttgcgtcacgagtggaaactgtccactcggtaggtatttccatgatacggaagtcacttccgcttgcaagctcgtcctcaagctttccaaggtcggcggtcataagctgcatggtgttctttgtgacacggaagttcaaaagagaatttcgcaggctgaaatcaaggagctttctttcccatatgcgcatttttgtgacgggtttatcgttgtcctctgccactttgccaagaagcgagctgttaagctcggagggggcgagcatctcttttggcttgtcggattcttctgcaagctgcagacctgaataggtttgctcgggacgcagtgggataggtcttatgccacttccacgggtgcggataatgtctatgacgcactgaaattccatgttgcttatatggtctttgccgtgtttcatggcatggtcgaaacgctcgatatcgtgaacgttgctgtcaacaaagtctgtacactccacaaggagcatttcttcggcattttctgcaatgcgcttttcaatagcggaaacatcgtcaacgcaacaatctgcgaaagtttcgttttcaagccaacagccgcaaaatgcgtgacctgtcatgaaaaacagcagagggtgaagtcccaccgcttcaaggcaggcggcataaagcaccgcaaggtcaagacaagtgcccattttttgctccaagaccttatgcggcaggcgtatcctctgacctatgacttcatagcttgcagggggatcgttgtagactattttctgctggacaagggcggcaaaaattgctgccatttgaagcttcacgttgtttgggttgttggtctgatagcctgtgaaagaggggtcgcctttccactttttcaggaacgtggaagcgtcatggataactggggagagcgcagggtgatttggcgtaacaaatgcggctatcatctcaggcattatgttcaaaccgctccactgatcgcaggcgagaagctctatagtgttctgataggtgaagatattttcgccattttgaagcacctcaatggtgatattgcccaccattttttctgtaagagagaaaagaagatctgtgttggtagatatcctcacgggggatatctcggcagaactttttgcggggatagagccgatatgatatgtaaattcctttgcaaactcaggctcaaaggttattttaaggctgatattctcaagggcttcctctgagttgttgtttactacaaggcttcttatgacagggacatagttttgctgcatggcaaagtttatagatgcgtttatgtgtccgccgacagtgacgatattatccacttttacccctccgacaataatttttttaataaggaacaccgaacaaggagtgtgcggtgcagtcatatatactcattatagcacaaataaacacattgtgcaatatttttcctgaggacaggatatgctatataaaaagtaaacccattgttcatagtatctttattgaataggtgggagggttgtgctataatacactttgaaattcaatagaaaatttggaaaggtgaaagctatggaaagaatacttgattggaacaaatatcttgatactgcggcgaaaatggtttctgagggaatcgttatgctcaaaaatgaaaataatgctctgccacttgatacagacaaagaggtggctgttttcggacgcatacagtttcattattataaaagcggaacaggctcgggaggaatggtgaacgttactaaggtagtgaacattctggacgggcttattgataacggcgtaaaggtcaatgagaagcttcttgacacatacagaaaatgggacaaggaaaacccattcgacttaggcgagggctggggcggagagccttggtcgcagaaagagatgccacttgacgaggggcttgtcaaagaaactgcaaaaagctgtgaaactgccattgtgataataggcaggacggcaggcgaggagcaggacaacaggctggaggcaggctcttatttgctaagcgatgacgagatagctatgctcacggtggtgagggagaatttcaagaaagttgttttgcttcttaacgtgggaaatatcatcgatatgaccgacataaacagaattgcccctgacgctgtgctttatgtttggcaggggggaatgacaggcggaaagggtacagcggacgttttgacaggaaaggtcagcccaagcggaaagcttcctgacactatcgcatacaaggcgtcggactacccttcggacgctaatttcggcagggaggaaaacagggatatttacgctgaggatatttatgtgggatatcgctattttgagacttttgctaaagaaaaggtgctttatccgttcggatttggtctttcatacactgcgtttgagataaagacggaaaaggctgagataacagagggggctgtgaagctttctgtatcggtgaaaaatatcggttcttacaagggcgaagaggtaatagaggtctactgcgaagctccgcagggaaggctcggcaaggcggctagagtgctttgcggctttgaaaagaccagggagcttgtaccacaggaagagcaggtgtttgagatagcagtggatatcgcaaagcttgcttcttatgacgattcgggtgtgacgggcaacaagtcatgctatgtgcttgaagcaggggaatataaattctatgtgggcagtgacgtgagaagtgctgaatatgcttgcagttttgagcagggtgaggatctggtaacagaaaggctcactcagtcgcttgctcctgtggagagttttgagaggataaagcctgtttgcgagggcggggctttcagcattggcagagaggctgtgcctgtatctgaggtagacgaaagtgcaaggcgtttggagaagcttccgaaagagatagcatacactggtgacaagggcataaagctttgggacgttaagaacggcaagaacacaatggacgaatttattgcacagctttcagactatgatctttcctgcattataaggggcgagggcatgggaagccctagggtaactgccggtacggcttcggcgttcggaggagtgtcggaaaatctcaatggctttggcatacctgctggctgctgttcggacggtccgtcgggcatgagacttgactgcggcacaaaggctttcagcctgccgaacggcactatgatagcttcctcgttcaacaaggagcttacaagcgagcttttcacttttatggggcttgaaatggcggctaacaaggtggactgtctgcttggccctggaatgaacattcacagacaccctttgaacggcagaaactttgagtatttctcggaagatccttttcttacgggcaaaatggcggcggctgagttaaagggcatggctggtgcaggggtgacaggtacgataaagcacttctgtgcgaacaatcgtgagacaaacaggcattttatcgactcagtggtatcggaaagagcgctcagggagatatatctaaagggttttgagatagcggtaaaagagggaggagcttcctctgttatgaccacatatggcagagtaaacggcttgtggacggcaggaaactttgaccttaacacagtgatacttcgtgaggaatggggcttcaagggcttcaccatgacggactggtgggcgaacataaacgttcgtggaaaagagcctgacaagacggatcttgcagctatggctagggcgcagaacgatgtttacatggtttgtcctgacggagaaaagaatgacgataacacgcttgttgcccttgaaaatggcggtatagagaggtgtgagcttcagagaaatgcggcgaacatatgcggatttctacttcacactaatgctcttaagcgtgcggagggtataggagatactgtcaaggtgataaaccgagaggacgaggagcaggaggatgacaagcctgtacagttttacaaggtagaccgtgacataactcttgaccttagtgatgttgacacaaagaaaggcacttcttacagctttgctcttgacctgtcaaacttcggtatttacagggtgatagttacggcaagctctacgcagagtgagcttgcacagatacctatgacgctgttcagcatgggaactgcggtgggtacgttcacgttcaacggcactggcggcaaggctgtttcaatggaaaaggaaacgcctatgttctcacgcttcacaactttcaggatatactttgcgcagaatgggcttgacctgcacagtatcaggtttgagctgacggacaaggaacgttgatttaaggctggcgttatgttttgtgcaagtgaataaacagcaagatcggtcagtagatcccaaatgggattactggtcgatctttttgtggtatttgtgggtgatctgggcatgaaaaaaggactatcaaacgatagtcctgaaattggttgcgggagctggatttgaaccaacgaccttcgggttatgagcccgacgagctaccgaactgctccatcccgcgatatttttttgtgctctctcttgagtgcttatttattatatcacaaatgaatgtgaatgtcaataccttttttgcaatttttttattttgactgaaaactcttgactattgtatccaaatcgggtataatatatacgatatcggggtgtggcgcagattggtagcgcgctaccttggggtggtagaggtcgtcggttcaaatccggtcactccgaccaatatgtaaaaacggctttccgctattgtggagagccgttttagttgtcaaaatattctaatacaaaaaagctccgaaatgatcggagcttttggttttatattacatcttcgcaagctttgcaaattctactttcagtgcaggatagatctctgtgtaaagcttgtagtatttctcatactcaggtactcgctctgcttcaggctgctgtaccttgtcggtctttactactgccttacaagcttccggtactgatgagtaaatgcctgcgcctgttgctgcaagaagtgctacgccaagggctgggccttcctttgatgaggctgttttaacagggcagttgtaaagatctgcgagcattgatctccacagcggtgagcttccgccgcctccgcatgccatcatgtcggatacgttgatatccatttctctgaatacctcaacacaatctctcagggagtatgatacgccctccattactgctctcagcatatcacgcttagtgtgcattgcggaaagtccgaagaatactcctcttgcgtcagggtcaagatgcggtgttctttcgcccatgagatatggcagatagagaagtctgtttgcaccaacaggcactttctctgcttccttatccatgagataatattcgtcaacgcccatgcactttgctgtttctttctctgcattgcagaaattatccctgaaccatttcagcgaaagtcctgcgccttgtgtaacacccataacgtgccatgcgttcggtactgctgcacagcaggtgtgaactctgccctttgggtcgatagagatagaagaagtgtgtgcaaatacgacgcctgatgttccgatagttgtgaacgccttaccgtcctctgcaacgcctgttccgatagccgcagcggcattgtcgcctgctccgcctactactatagtaccctctttaagtcctgtaagctcagccattttctttgtgaccttgcctgttacctcgcatgactcgtacaccttgcccagcattgacatatcaatgccaagcgtatcgcagacttcctttgaccagcagcggtttggcacgtcaagaagctgcataccgcttgcgtcggaaacctctgttgcatattcgcctgtgaggataaatctcagatagtcctttggaagaagaatgtgtctgcacttttcatatatatcaggctcgttgttctttacccaaaggattttcgcagccgtccagcctgtgagggcagggtttgctgttatcttgatgagcttttctctgcctagcttttcgttcatttcttcaacttctgcggcagttctctgatcgcaccatattatggactttctaagcacgttgttgtccttatccagcataacaagtccgtgcatctgtccagagataccaacgcctgcaacgtcctctttatttacgccgcttttggtcataacagccttgatagtgtttatcattgcgtttgcccagtcagcagggtcttgctctgcatagccgtttttaggctgatacattggatattcgatagttacagaagagataacagtgcccttttcgtcaaaaagcaccgtcttagtgccgcttgtgccgcagtctacgccgattacataagccatatttttttactcctttataatatgtatagtatcatttgtgctcattaaaacgattacattaattatacaatatttctctctgaaatgcaatacccataaaacgttttcgcaaaatttatctgcacataaaaaaaggacggtggggctgccgtcctgtaaatttgttgaaaaagctggtgagtgggcgggacgtcgagggcgccgtcccctacaaaacaacgtgtctgtgttattgacaggatacggctcgatatcgtccatttaaagtctagtctgctttctcaagcacaaagaatgtgctgttgttttcgcttttcatttcctttatagcccagcctgccgcgatcagactgttgagcttttcaactcgctgaaatctgtccatatccggggcttttccatcatgggctttgtcctcatttcttgaaacataaaatatcttttgcatatatatcctctttccctgagagtgacaattgttccccgatttttttacaactgtcgcattttattgattacattatactacacaaatatggagatttcaaggaataccaaaaattttaacctctttttaacgctttagtattattctgatttttcatgcttttcagtgcttattatatataacggcataggtaaggtgtaaaaatgcacgtttttagggctgctttatgtgctgatatgtacaaaaacttatgacaagtgagtatttttatatgacagcccttgacttttttttataaaaggcatataataatattattaatttatatatttatagtctttataaataatgaaactaagaaactaatttatatggagggtttaacaatgggtagagtatataacttcagcgcaggtcctgctgtactccctgaggaagtgcttaaggaagctgccgatgaaatgctcgattacaagggcactggtatgagcgtaatggagatgagccaccgttccaaggcgttcgatgacatcatcaaggaagctgaaaaggacatcagagagcttatgggtatccctgataactataaggtgctgttccttcagggcggtgcttctcagcagttctcagccgttcctatgaaccttatgaagaacaagaaagcggcttacataatcacaggtcagtgggctaagaaggcttatcaggaggctcagaaatacggcgaggctgttgctgtggcttcttctgctgacaagactttctcttatatccctgattgttcagatctggatatcccagaggacgctgactatgtttatatctgcgaaaacaatactatctatggtacaaagtacaagactctgcctaacacaaagggtcacacacttgttgcagacgtttcttcctgcttcctgtctgagcctgttgacgtaacaaagtacggcgttatttacggcggcgttcagaagaacgttggtcctgccggcgttgttattgctatcatcagagaagatcttatcactgacgacgttctcgagggcacacctacaatgctcaagtggaaaactcaggctgacgctgactctctttacaatacacctccttgctatggcatctacatctgcggcaaggtattcaagtggataaagaaaatgggcggccttgaggctatgaaggctcacaacgagaaaaaggctaagatactctatgattatcttgaccagagcaagcttttcaagggcactgttgttcctgaggacagatctcttatgaacgttccattcgtaacaggcgacgctgagcttgacaagaagttcgttgctgaggctacagcagcaggctttgtaaacctcaagggtcacagaactgttggcggtatgagagcctctatctacaacgcaatgcctatcgagggcgttgaaaagcttgttgagttcatgaagaagttcgaggctgagaacgcataagcgtaaccttattataagagagggtaatttacaatgtatgagataaagacattaaataagatcgctacctgcggtactgatatctttgacaaggctaagtacacagtaagcgacaatgctgaaaatcctaccgctataatggtacgttcagcaaagatgcacgatatggaaatgcctgagagcctgcttgctattgcaagagcaggtgctggcgtaaacaatattccagttgagaagtgcgcagagcagggaatcgttgtattcaacacacctggcgcaaactcaaacgctgttaaggagcttgctatttgtgcacttcttcttgcttcaagaaagataacagaggctgctgcatgggctgcttcacttaagggcactcctgacgctccaaagacagttgagggcggcaagtctaagttctcaggtcctgagatactgggcaagacacttggcgttatcggtcttggtgctatcggcggaaagatcgcaaacgcagccgttgcacttggcatggacgttatcggctatgacccattcctttcagtaaacgcagctatccagctcgagcctgctgtaaaggtaacagctgatatcaacgatatttacaagaacagtgactatatcactatccacgttccttatacacctgacacaaagaacactatcgacgaagctcagatagcaatgatgaaggacggcgttcgtcttatcaaccttgcaagaggcgagcttatcaacagtgcggctgttgtaaaggctatcaaggacggcaaggttgcaaagtatgtaacagactttgcagatgatgttgttcttggcgaggagaatgttatcgttcttccacaccttggcgcttccacacctgagtctgaggacaactgtgcaacaatggcagctcacgagcttatcgactatatagagaagggaactatcaagaattctgtaaacttccctaatgcagagcttgctaaaacaggcgaccaccttgtttgcgtgcttcacaagaacgttcctgctcttatcgcacagatcacatctgttgtatctgacaagggcgcaaatatcgagaaccttgtaaacaagtctaagaaagactgggcttacacaatgctcgatgttacaggcgacgttgacgctgacgctttcaagtctatcgagggcgttgttggcgtaagagttctttaattgttgataaaagaaattttatatgcagcaatgaggctgcccacggacgaactgcgtcttgggcagccttttttgatacaaaaaaagctatgatttaagtgaaaaatggaggaatttaaaatggacaaacttataacagcaattttatttatcggaataccaatggcactgactcagcttatttacaggataattgaccacaagggtaacaagaccgcaaagcttgctgagcgttttcctgtgcttgtgaaaagaaagtttcttgtgcagataggcggagcaatggcgttcgttatcgtgttcgggcttatctcgcttctgcttgacctgcctatcaaggtgtttttcattgtgtgcggagttgtagtgggcgtgataaacggcatggcggtcacgcttatgtacagagattagtcggttgcaacgtggcaactggggcaaaataaaggggctgtaaaaaaagtccccaagaaaaaaggctgcgatcttgccaaaaagcaagacagcagtctttttttgtggtagcatacttatcaatctcgcagtacccgacgcactcaaagcctcctgctttttcaagtcccgaacggaatccgccgatgcctgcaaagatatcgaaatactttatcatttatcacgttcctttctgcaataaaaaacggccaagctttcttaacttgaccgttacattgacatattcatttcttcttcctcagtttgttccgattcttctctgataacgtgaaaatcgtccacgcctggtataactccgagcgttcttccgttatcaaaaacgcaatgcacagtgccgatatcatcgacgtgatcgaccttgccaagagtaccggactcaacagggaacgggtcatcattcattctgtcaaggcagatgcgagttccttcgggatatcgttctttcagccattctactttcttttcgtaatacatcataaatcacctcacaatgtcatttcaggttcttcggtcagctctttggattgagtgcgatccatttcctccgtcgtttgcaatgaccagctgtcatcaaaactccaaaagctgacatagatctcgccgtcaggagtttttatcggtctttgttccagactctctcctgcaccgtcgctgagctgaccgataaaatattcacggagatcttcaagttcatctttcgtaagctgaccgtaaacgcttgctgtaacaactcccacaagttcttcgtcattttcttcgacagacataaatgccgaaaacaccttttggtcaacagaatttcctctattgtaccaatgcatcagacctcgctctttttcctcaggcagattaaaatcgctgataaaataatttatctccgattcgtaagcagaagcctcattgggtgagatttcattgtattcatcatcgtcccatctgctgatctcaagagggcagtaaaatttcatttcctgcaaatgcatttgcatatgattttcgtaaagcagttttgcatttggaatatactgagcatatcgtgcataaggtgcgccctctgattcgatcagcagtccgtcgccctgatcgtcatcgtatatgagcaggcaatgatactgattatttacgtcgcagaacataaggtctgtgttttcagcgatcagatcattgtcctgcatcggatgccttttcaggcgttcaaatttgtcatgggtgactgcttctgccttttccaccacgcaaactcttgtaccgaactctggctctttgcggagcagatttgcattgatcacaagtttttcattcattgtcattcctccgttcgtatagttttttgttttttaatagtatagctgccacattggtatcacaacctttccttagaaatgaaaaaaggctgttttatcatcgtcacttaaattcgtgacaatagacaaaacagcctttaaaactttgtgattattttttcataacaaatcggcaggctcagagcgaaatctgctcaaagtctgccgttatgttcgatattttttgttgtgtagggttcgactcccttttttcgtgaaaaccggtgaaaagcatccacggttttacactaaaattttccgctttctaaacatcaaaaaagcccgtaaatacgggctttttcaggtgaatatccatttggtatcaccaatatggagctggaaacgtgacttgaacacgcgacctgctcattacgaatgagctgctctaccaactgagctattccagcatatattaaatttttctgttagcttatttgatccgccgccgtgtcgctttatcaacaacccacgacctgctcatatacggtcagaaatatagtcgccttgctcggctgtcgctgtcgcaattctccttatttcttcccttcgcaagctcccttcatctgcctctggcagcggtcgcttgctcagcaaatgagctgctctaccaactgagccatatcagcatataagacttaaatattatacaccaaaaccacacatttgtcaacatcaattcaagatttttctcaaagtaaattcaagatttttttcaaagctttgcaaaatccctatcaaatagtcatatcatatgtaccttgtaagtataatgtatgaaataaatacgttttctttccacatcgttattttgcacaataaaaaaacgctgaaatatgcttaaacgtttcaaaatatcttcgcaaacaccgaatattccaacttctccgatcaaatgactatcatattttcatatcaagataatattttaacaatatcatatgtcacaacacacttttcaacaattattatccgaaaacgtttaacgaataaagttgcttaatggtttttgtaatttcacataacataattgtatacaaaagaaatgtttatatacatttttcacataccacacagcctggtttcatatacccctcagaaaatgcagtgcattttcgcagctttttgattagcctgtcagtttctttgtaacaaatcgattacaattgtccaaatagcattgttaaaatgcacaaaagtaaagttgaaaaattggctaaacctccataatttattacagagggcataaaaatgtgaaaaaagacttgaaattatgccgagaatattgtatatttttattaacggaaacgtttgagataagttttcacggaaaacgtcaagcgtaaacgtttaaaatctacggaaaggcggaaatatcattggtttccttaaaagacatttccgttcgttgcggagtatccgtcgcaaccgtaagcaaagccctcaacggccataaggacgtaagcgaggcaacaagagaaagacttatgaaagccgccaaagaaatgggttacttcccaaattctcaggcaagagctttaaagaccaacaggacctataatctcggggtcatgtatctcgacgaagcaggaagcggtcttacccatgagtttttcgcaaaggtgcttgacagctttaagactacggctgaagcagcaggatatgatataacctttataaatagagatgtgggcaagcagaaaatgtctacatacgaacattgcaaataccgcaatgttgacggtgttatcattgcctgtacggattttacgtcgcaggacgtgtacgaggtgataaacggagatataccagtggtcacgatcgaccacatcttcgattgcagaacagcgatcatgtccaataatgaaaaaggtatggaagagcttatcaactatgtgacgaggatggggcataggaagatcgcttttatccagggcaacaaatcggcagtagccgaaagacgtctggcaggcttctataaggcttgtatgacaagaggaatttcagttgatcccgattggatacttaacggtgattatcacaaccctgatctgacttataagctgacaaaagagcttcttagcagagagaacaaaccgacctgcgttttcatgcccgatgattattcagctatgggagctttcaatgcagtcaaggaaatgggtctttcagtaccggaggatatctcgatagtgggctacgacggaatagcttattcacagcttctctctccaaagcttacgacttatcttcaggacacagaccttatcggtgtaacagccgcaaaacagctggtatcactgatagaaaacccacagaccacctttaaagaggtgataacagtcgacggaaagctgctggaaggcggctcggtaagcgacatcaactaattcaaggcattaattttccgcagaaatgctgcggagcaaatcaaataaactaatgcgattttaaggaggaaaattattatggcaaatcttaagaaagtacttgcaggttcattgagtctctgtctggcagcttcaatgttcacagcttgcggcagcacagattcatcttcaacatctgacaagaatggcggcagcacatcaaaggctggcgacggcacaggtatcaacaaggacgcagacagagtaaacacagctgaactccacggtgtagattcatcagaggattcaaagaagactcttacaatttactgctggaacacagagttcaagtcaagacttgataagtactatccacagggcacatcaaacgagcttacatacaacgagcttactgatggttctaaggagatcgcaacaatcaacggcgttaagctgaactgggtacaggttgaaaacgaaggtaacgcttaccagacaaagctggacgaggctcttaagggtcagcaggacagcacagagaaggtagatatgttccttatggaagctgactacgctctgaagtatgctaacggcgacgttgcactttctattcaggacctcggcatcacagacgacgatatgtcacagatgtatcagtacacaaaggacgttgcaacagatacaaagacaagcgagctgaagggtgtatcatggcaggcaactccaggtctgttcctctacaacacaaagatcgctgaggacgttctcggcacaagcgatccagagaaggttcaggaagctgttaaggattgggatacattcacagcaacagctcagaagatggctgacaagggctacaagatggtatcaggtttcgatgatacatacagatgcttctcaaacaatatgtctagcccatgggtaacagacaacaagatcacagttgacccacagatcaaggcttgggctgaccagactaaggaatacacagacaagggctacaacaacaagacttccctttgggacgatgcttgggctgctggccagaagatcgacggtggcgtattcggctacttcttctcaacatggggcattcctttcacacttcttccaaacacagttgacgaagagatcaaggctgatggttcaaacgctaaggaaggcaacggcggttatggtctctggaaggcttgctcaggcccacaggcttactactggggcggtacatggatctgcggcgctatcgactccgataaccaggatatcgttgctgatatcatgaaggtaatgacttgcaacaaggacgtagctaaggctatcactgagggcgagcaggactacacaaacaacaaggctgctatcaaggagcttatcgacggcggttatacaaacgcattcctcggcggacaggatcaccttgcacttcttacagaggctgctgacaagatctccctcgagaacaagctttctgcttatgaccagggctgcaacgagaaattccagggtgctatgaaggactacttccttggcacagttgattcatatgaggctgctcttgagaacttcaagaagaacatcacagacctctatggtaaccttacttgcgatttctaatcgtataaaaaaacagtatctaattaaatatagggggtggaggatatccccccctattatttattaatctcacgaaaggaataggtatacttatatgaagagaaaaagcataagctatgccaagtggggatatattttccttatcccattctttgtagtttacatcatcttctcactatatcctctgttccagactttctattacagctttacggactatgttaaggatcagggctctatcggcggtggttggacaagacaggctgtcgaagtaacaccgacattctgcggtttcgataactattcaactatattcacatcaggaagtgaccttctccagtctttctggaatacgatcatcatgtggatcgtaggatttatcccacagatcgttatctctcttatccttgcagtatggttcactgaccttcgtcttaagataaaggctcagggattcttcaaggctgttatctatcttccaaacgtaatcatggcatctgcttttgcatttctgttctacagcttgttcagcagaggcggtgctatctatgatcttatcaaggtaccgctccttgaaagtgtttggggatcaagaggtgtagttggactcatcaacttcatactttggtatggtaatacaacaattcttcttatggctgctatcatgggtgttgatacatcactctatgagtcagcacagatcgacggtgcaacttccagccagacattctggaagatcacaattccgctcatcaagcctatcatgtcatatgttcttgtaacatcactcatcggtggacttcagatgtacgacgtacctgccctcctcacaaaggatatgggtagccctaacggaaaacttaagaccgtcgtaatgataatccaggcaaataagcagggcgacatcggtaaggcgtctgcactctgcgtaataatctttatcgtttccgctgttatcggacttgcacttatgtttgcgtctgctgaccatgacggaaagaagaaaaagaagaaaagggggtaagctgaaatgccaagaagtactgaaatagttggtgaaaagacaaatagtactggtcttatcatacataggataatagcttatgttgtccttgttcttttggtcgttgtttcacttttcccattctatcttttgataatcaacgcaacacgaggcagatcacaggcaggtatcagatggtatcctgaccacttcctcgcaacaaacttcaagaaccttttcagcggttcaacagccgtagcatacggaagcgtatggcgttcactggctaactcactgttcatatcagcttgtgcttcattgctcagcgtatacttctcagcactgacagcatatgcaacacacgtttaccagttcaagctgagaaagttcgcagatatgttcattctcatcgtaatgatggttccaacacaggcttcagctatcggtttctaccagttcatgaacaaacttggctggacagatacttatattccgctgataattcctgctgtcgcagcaccagctacatactacttcatgaagcagtatatggcatctgcacttccgcttgagatcgtagaagccgcccgtatcgacggctgcggagagttcaagaccttcaacaagatcgttacccctatcctcaagcctgcattcgcagttcagatcatctttacattcgtaacaaactggaacaactactttatgccaagacttattcttacatcaaagagtaagtacacgatccctctggtactcaacgcaatgcgttatgcaggaccacaggagaaggacgtgggaatgttcagcttgtacatcgtacttgctatcctccctgtagtaattgtttacctttgtctttcaaagttcatcattcgtggtgttgctctgggaagcgtaaagggttaatacgaagcttcaaacagcgtacagtttttctgtacgctgtttttttgctctattcattccttacttctctttcctattcacataaaagcttcgtttgcatacctttgctattgaccgttatctccattctgctcactctttttccatttacgccatatccattacaaattattttatccgtgatatcctcaccgcaatacccctcataagtgatatgctccaccaaatactccctctctgcaaactctatcctatctttaagcccgacaactacattattgagccactgcttatcaagaccataatacttctccctcgtgataccatgtggtatagttttaccgcttgaatagctatatccatactccccgtccacgtttttcatatatatcttcgacagcatcgatctcgtatcaagctgtttgccgtattcaataatacgctgagtaccgatattcaccgaaaggatactcagcgacatattgacctgcctgtcccctctgatatatgcacgcctgccgtaagccttgaccgcatatacgccgatagcctcccacagtgtcgacttctctttgatgttcacatagttcacagtgtcagttccactctcgtaggttatctcacttgaggggctgtagctcttcataatatccgtcaaactcaccttagaccataccccgggttcaggctcgttctgccccagcataagtgttatcccacggcttataagttcaagaacagtttttccacctctcacccttgttctgatataatccgcaggaccgtagtgcatacgcctgctgcctatataaagtgccacacgcctgatattgttaagatttatgctgttattcagaacgacagacgctctaagttcactgtatggcgtatagcggtctttcacaagccttgctgaaacaatgtttctatagtccaaattgccgctgccaataagttcaaacctgatgtatatcttcgccattattccgcccccctaagctttatcataaggcttccgatcatcctgtcaggcttaaaatccatttctatctctgagagtatgtatccgctgtataagaccccgtctgccgtgaaattgatcgtctttcctccgttctcgcttagagcagcccaagcgtaagccttgtccgacggagcgatcctgccgctgaactgaaatatctccgccgccttgcctgagatatttcgcaaaataccattcacagcctttgtttcctcctgaatgtaacctccgcttcgcttaactccgtccatgtaaaatgaccgtgtgccgatgtcaagctttatctttccctttttactcacttatatcctcctcactgcaaatgccgatactaagctctgcctgcctttcgagcctgtgaaggggcaatgtctgaactgcgcttccaagctttgcgctctttacattcagaacctcgctttttgcaagctccgccataacgctttcacactttccctgaagctcctccatgtcatcgtattttcctgccttgcccatgagccgcaggtcgatatgacatatatactcagtgtaaagctttttgccgccctgcccaatgacttcatcgaccacatcatagcctttaagtccatagaagccaattgcttccccgctgtgcaataaactgtcagccgaagtgtattcacccattgcagtaaagcctgctccgtcaagtatcttttttatctctgccgccatttctgtccagactgtcatggctcgtcctccttcctaatatgcgataacggcattgaatacaaagccgtcctttgagaaaaatctttccgcccttgaaactgcgctgtcacgaagctctcttgccgcctttatcctgttctcctcgtcaaaagcctccaccgccttgccctgtgccgtaaacatgatcttgtattcagcggctttcagacaaataaatctgtaaaagacctccgctgccgccgcaaattcgcatatagccgtcccgccctcagcgaccattcgctcctggtcaacagccttttccatttcgtcagcacacaccgttataagccctgcatacacctcagccgacgtgctgtcaagtccgcttagctccatgaaattgctctttacattgtctttgcttattgccattttcctgctcctttcaaaaaatatacccgcccaccgtcccttttttcattatcctctcagcttactttgtagttttcagcgtctttacagcaccgctcgtaagtacagagaaacctgcaagcactgagcaaacgatctcgttgcactgattagtaataagcttatcgtagtccacgataacatctcctccaagcaccatttcaacagcactgctctggtcgatgcccaccgcaataccgcctgtgagctgagggcattttacaagcgttacaccatatggcgtctgaactgtgccgcctgccatatagtcgccaatgcagtatttcatctcgtccatagcaaggatcttagccataacatcaggagtacagatcatggtcgtcatgttgaactcgcccatggaagcccaaaaagccgccagatcagcgtaagtaagctcgctgccaataagagtctgagctgtaatacctcttgttatctcagtcatagcaaagctgttcacatctctgcttatggtcgctccaaggtttttcagcaccacgccgaaagcctcaagcttctgctttcttacagactcaaaagaacagttaagacgtcttgcaaactttgtgagagtcttactggcggtgctaagtctgacagttgtcataggcacatttccaccctctgccacaacgtcagttgaacctgactttgtaacgttcagacctctgaaatccactccgtcagtgtatgaaacagccgccgctaccttgcccatgatagaagcctcgtccatgccctgcttgacagtacgtcttatgtactcagggaaaagcactgccgactcagtggaaatgaagaatttctccaccctgtcagaatttgcaccctttaccttgatgtcaaaacgcttgagctgtctttcaaaagcgtcaagacctttaagctcggtgttctcatagtttgcgtcaggatcaagctcagccagcgcctgtgtgaatgtcttgcctgtgatagaataaagtcccttttcaagtttgatattgttgtacatattattttctccttttcgataattaaagttgtccgattttttgtactgattttcgtatcatcgaaaaccattcgtgttttcgggtgaacactgttcgcccctacagtgatgatatcacattctggcatttaagcccctatctccacattgtcatcgccccctttcacatctgtcccttacatcttgtaatcccccgtgataaagctctccctttcggctttgtagacctcctcattctcagccgcctgcttttcaagcctgccacggaagtcgataagctccgtaactgtcataagctccgcaagttctttcacacgctttgcactcataaaaggcttgcagaaatagctgagccttaaaacgtccttttcaaaagcttccctcgcaagggcaagctcatagctcttgtcggtgctttcctgcttctcccttaaagcaaaacgcttcgttacccctgcattcacctgtgcaggcactgccacgaacgaccactcgtaagcgtcaagcggctcgtcaagaatgtgataacacagcttaccgccgtattcaccgcccttttcatggtcacagccgcccttgtacatatccgctccgcatacagagcaaagcttctttcccatggtgcagctaacggatacctctttctttattccgccctgaatctcgcttataagatcaccgttagaagcagttcgcaccatgtaagcctttgccataagcctgcggtagacctctccgtctgtcgtagttttctcaggcagagtttccacccaagtgtcaaatattctggcagtctgctttgagcttttagggtcatggtcgaaaatacccgttctgcccttaaaaagctccgcaagcttctccaacgcgcctgatgaaaacttttcaccatctctgtcaatgtcattgtcacaaagcgccaccctgaaaacaaagaccttgtcctccgtgagcggctctctcgcatagccgtttatcttttcaagctcctcgcctgatactgtttcgctcattgcatttcctccttttttctctcgttctctaccctttcgttttcaagctccgccgccttagcctgcgcattgtaaagtcttgacttcgccaacgcttcctcgtcctgaagatttatgttgtcccactctatctccaccccacaagcatatccgttaagccttaaaaacgcctcgcatatctctctgagtataggttcaagcagtctgcggtaatattcaagctcacttgtgaggatatccgattgctgtgcagacattcgctcagtggttgaccagttcagcccaagcaaaaacggtggtattgaaagcttcgctacaagctgttccataagctgtctgacaggtatctccgtgtctatcatctgattgtcagcgccaatgacctttatgtccacatcacccacagccacaaaatcctgcaccgagccatttcgtgaggctctcatgcctctgctccattcctgagctatctgctctgcacgctccttggctctcgccctgtcgctctccccctcagggtgataagtcaccgcatatcgcacatttcctaccctgtcgaaattctgccccatgcactcgtaaattcgcataagtatctcgctcagcgccggcaatccacggagtatggacactccgtcagggtgcttaggactaggattgagcgccgtgtaaagcagtttttcaggacttcttaccggtatctcctcaccgcttcccatgtaaaaaatacgtttttcaaaagcgttcctgccctcacgcactctgtacaaagtggggtcgccaacatatatcccctttaccttgcctgtcctgtaatctgcatatatcctgcctatcgccttgccatatgtaagcagtgaatccagatacatatccgcaaaagtgtaaatggactttcccgacacccccacggaaacctctctgcaaaacctgtcaagctccacctgcgccctatcgtcacaagccgtgaccttaaagccccctgtgagccttattatcttaccgaagcaagcgtcaataacaggaacgttcgccctgagtgcgtcataaagctcctgctgaaaaatcccctcaggcgcaagcctgtaatgaaaccccgactctctgtcagagcctgccgtgttcggcacaaattcacggaccttctttctgaaaatactcattttctctcctttctttctgtacgtttttttgcactaatgctcaactgtcagtacaaaaaagtcgtccttttcacgtcccagacattctgccgcaaaatacctcatatcgtccatggcgtgatcgttctctttcacaggtgcgtcctttcctgccttttcgtcccagcggtaaagatttatctcacgaagcgtatcacgacacctgcggtttatccttatcctgccgtcctttatgcagtccgacacaagcctgatacccgaaacaacgtcgttctttgcaggctggacagtgaattttccatgcctgcgtatgcactgtatgaacgaagccgccgaggggtcgcaaatgaccttttcgatgcaaagcccgtcggcaagctcttcaagccccttgtaatgctcctcgtcagttttctgcataccttcacgtcgagaatcatagtaatactccctgagcctgtaccatactccaccactctcgccccaaagcccgaagcttgaaggatttacagtgccgtaatcacagcttataacataccgctcgcactgtatatccccttcaaagacgtttttctcctcgtcgaacatagggtaaacaagcccctctgccgccgtccatttgccaagtacaaaacgctcgtaaaacgtccccgtatatatcctgtgatagcgttctatcactgccctgtcaagggtcggattgtcctccagaacaaaatgtctgtagataagccgtttttcctccgccttgtctatccactctttcttgaaccagtggtaaggattgtcaggattgcagttaaaccacagcttgctccccgccaccgaacaccttgccacagcctgctctataaagcttctgggcataagtgccgcctcgtcaagaagcacccccgcaagggtcacgccctggataagagagggcgagccttcgtccctgccgccaaagtagtaaaacctgtttttcctgccgcaaaagctcacgtccatatagttctttgacgcgacctccacagccgtcatgcccatggctttcatatatcccctgagcgcaggcaggatatttcttttcagcgacacgatagtttttgagcatagcccaaaaatgcactcgtcaaaattagtcattgcccatgtcataaaagacgccgacaaacaaaaggtcttgcccgatctgaccgcaccgtcacagattatcccgtcgtaatcactaagatcccgtgccgtccaccatctgaaaacaaacctctgattttccgacagccttgttattttcacaagctatcaccgtccctgccgtaaatgctctcgataagtcgcttcgactcaccgccgccgtcaagctgaggcgcaagctccccaagcttttccaaggctttctgcctgtcaaaaaacttgatctccaaaacgttctttccgctgatctttatctcactcacattgaaaagatccatgcccatgatgtcccttgccgtcatgttatcagcgtcaaaaacaagctttacagcgtcattcaccgccccgaaagctatcctgttcagccctcgcttcacataagaaagggtgtcgctgtcagcctcctccagctttttaagctccgcctccgtttctgccgagtgcagaagctcaagccccctgtcctcagcctcctccgcccttgcaccggtgtgcaaagccgcttcacgaagatttctcagataaaagaaaaatctcgcaaatcttttctgttcgcctgccatatcgttcctccttttttaatttctgcgaaagatgtaccaccgtatcttaacggctctcaaaaaacatctctcacttatcccgaaaaatgccccttttgttgcataaaaaatgcaacaattgcagaaatgttgtcaaattaaatcatttatcatttgtttgcataaatcgtcctgcccaaaactgtgaaaaagccacatactttcatgaacagaaaaacttttggtaaaaagaaatacttttattttttaggacgtttcgtaccacttactgcacattatttcagacaaatatgtaagtcatgcgaaactttcaatataccttatgaaaaaaagtatatattacttgacaaaagccgaaaaaatagtacaatagtaagtgtatgacacaaatttgaagaacaacgcaggaggtaaaaatatgaaaatgagaggtatctattcctcagtaacagatatcagacgaaaagtctttacagaggtggcaagacttgcctatgaagagggcgattatgccgaaaagatcgcagagcttccttataagatagtaccgggaagcaaagctgtttaccgtgagtctatctttcttgaaagagctatcgttgaagaaaggctccgtcttgctatcggtctgcccctaagaccgatcgaggagcataagtctgtggctgacggcattgaagaaagtgcgatcgcagaaaagtattacgatccaccgcttgtaaacataatcaagtttgcctgcaacggctgtcctgaaactcattatcatgttaccgactgctgtcagggctgtcttgcacacccatgtcaggaagtctgtccaaagggtgccataaccatcaagcatggcaagtcagtaatagatcaatctaagtgtataaagtgcggcagatgtcagagcgtctgtccatacaatgcaataaacaaaatggaaagaccatgcgcaagagcctgcggcatggatgctatcggctcagatgaagagggcaaggcaaaaatagattatgacaagtgcgtatcctgcggaatgtgtcttgtaaactgtccattcggcgctatcgtagacaagggacagatattccagcttataacagcaatgaagaaaaagaagaaggtcatcgctatcgtagcacctgcatttgtaggtcagttcggaccaaaggcaagccctgaaaaactcacagcggcaatgaagaagcttggctttgcagacgtggtcgaggtagcaataggtgcagacctttgttccatcgaggaagcaaaggacttcatgagagaagttcctgaacatcagccattcatggcgacatcatgctgtcctgcatggtcagtaatggcgaagaaacttttccctacccttgccccatacatttcaatggctttgaccccaatggtacttacagcaagaatgctcaaaaaggacgatcctgacgcttgtatcgcatttatcggaccatgtgcggcaaagaagcttgaagcttcaagacgtactatccgcagcgacgtagactttgtgcttacctttgaagaactcatgggaatgttcaatgccaagggcgtaacatttgaagacattacagatgaagaaaaggtagatctttgcgagggtacaggtgacggacgtggctttgcagtaagcggcggcgtagcaaaggcagtagcagacgttatccacaagcttgacccagagcgtgaggtcaaggtagtatcagcgcagggacttaaagactgccgcaagcttctcacacttgcgaaagcaggcaaatatgacggctatcttctcgagggtatggcttgtcctggcggctgtgtagcaggtgcaggaacgcttcaggcggtagaaaagagtacagcgcttgtaaacaaatatgtaaaggacgcacctttacagaactctctcgactccaaatacgagatcaatcttgatcttatcaccgagccgcatgatgacaaataagagatagaattgaaacggacagcgttatgctgtccgtttttttgtactgtcactcgccgtgacgggcattttacgccatacattgtggtataaaacactttttcaccgctttttgaattcgtatagaatactacacattgcaattatcacacaccccctgatacccccacaaacggcagtaggggcgaacagtgttcgcccgtcgaagaaacaagcccacgattatatcattgttggatagaactgaaaactatccaatcacatcttcaggggagcagcgcaatattcttcacacgacaagtctacacaacattgtgataaattcaaaccttgcagttccccgaaacgggacgtcgagggcgccgtccactacaattctaccccgacttcatcacgccgcaaaatcgctttgctctttgcggatttacgttgtaattggggataggataggcggtgcagattttttgctccgttattacttttgataagaagcacaacttttgtatgctttttctcattaaatctgcaccttgtcggctatcgccgaatgaggctctgcctcaaactccgctaggggctttgcccctagaccccacaagccctctagcgccgggcttgagcgtgcgctttatctcttgcttcgctcggtgcttgggggcagctttgctcattcctcattcctcactcctcattcctcactcctcacccctaattcctcactcctcactcctcactcctcacttaaactcccctccccccttgatttttcccgtaatatgtagtataataaatgaaatagtgcataataacagaaaaattcttacagagaggatctttataaaatggaaataatcaataagtccgatgaaaaactccttgcagaatatgaacagttcgcaagcaccagcaaatacggcaatttcatgcagtccctcaaatggccgaaggtaaaggacaactggggctgggacgctgttatctcccgtgacgctgacggcaatatccgtggaacttgccttatcataatcaaaaaagtgcctattttcggtgttacttttatgtatgcccctcatggccctgtttgcgactggtctgataaagaggtcatgaccgaccttttcgagggcgtaaaggtgcttgcaaagaaatacaaatgctaccagtttatgtgggacccttgtttcgaggagggcgacgacaagtgtacaaagcttatcgaggacatgggcttcaagcacatacacaaagcggctgagctgaccactattcaggctcgtaataactatatgctcagaaatatcgagggcaagacccctgacgaggtcatggcgactttcaagcctgactggagaaaccgtatcagaaaagcacctagaaagggcgtttactgcaaggcttgcggcactgaggctcttgacgatttctaccctctcatgcaggcaacaggtatcagagatggcttctctatccgttcaaaggagtattttgtaaaaatgctcaatggtcttggtcctgaacactgccgacttttcatgtgctatgttgacgaggacggcaagcagataccgttgtcaggtgcagtaacaacacagtatgcaggcaagacctgctatgtttacggtgcttccgcaaaccaccacagaaacctctaccctaactatctcatgcagtggacgatgataaactgggctttggagggcaaaaactatatctatgattttcagggcataccattctacaacgatgaaacaaaccctaactatggcgtatacaagttcaaaaagggctttaacggcgaggtcgttacctatgagggcgaatttttctacattttcaaacctttcatgaagaaagtcgtagacttctgcgaaaagatagttatggatagacacgaacgcaaaagacagaagcttctcaaaaacagaaataaggatatgcagtagacggcaatagattaaatttaaaaatttttgaacagtttatacatttttacccattctttacacagacaacatttgatttttacttatatgtgatatgatttacaaagaggtgagcaaggtgcataaaggcgttataaggaccttgtggctcattgccgcattgagcctggtgctgagttatgctgtgatgtgcattgcatggctttcaaagggctgtcgctatggagcgcagttttgcataaacgtttttatgagagcgcttcctctttgtcttatattcctgtgcatcgtcgagcttgcagggcttttcatatgggtattcaaaataaaaaagctcgaaaggctctacgctaaaaagggcggctgtgacgaatattttgagcttcttgaaaaatatcttctcaggcagaacaaagataagggtcacgggcttttgaagcttgccactgtttacatttcagaaaaacgctttgaaaactgttttctcacacttgaccgtatagcttttgataagcttaccccctcagatcagaacaagtattttgaactgcttctttacggcagactcatgtcaggagatatttctcaggcaaacgagatatttgtttcggcagagcattacttcaagcgaggtcttctcgataaacgcaatgggcaaatgcttttcacccttggtctgctggaatatttcaacgaacgctttgaagcggcggtgaagttttttgacagcgcagagaaaagccgtgacgctgacaagacgcttcggtgcaactgtgagctttacaagggcgagtgttttctcgctcagggtgatgtgagatcggcaaaagcttcggctgaaaaaagtgcggcgctcgttagtgacgataagcaggaagcacagctaagaaagctgatgacgcaggtagaaaaagcttacatcagaacaaaagaaaagtctgctgatacgaaagcagacaacaccacggaaggaggatatgccttttaaggcatagaaacaagtatgataataaacgcactcagaggcttttgcatggctcttgcggacagcgtccctggagtttcgggaggaactatagcattcctgctgggcttttatgacagcttcataaattcccttaacgacattatgggacgtgacaatgcaaagcgtaaaaaagcatttttctttcttataaagcttggcgtgggctgggtgatcggtatgcttcttgcagtaagcgtgcttgcaaacgtgtttgaaagcggaatctacaaggtaagctcgctgtttctgggctttatcattctggcgataccggtcatgataatggaagaaaaagagagcattaagggcaaatattacaacatcatatgggctgttatcggcattgctatcgttgtgggaatatcccttataaatccctccggcagcggtgctgacgtttctcacatgaatataggcacagtgatattcgttgttcttgcaggaatgtgcgcaatatctgcaatggtgcttcccggcatttcaggctccaccatacttctcacattcggtctttatatgcctgttatcacgggaataaaagagttccttcatctgaatttcgagtatttcggacttctctgctctttgggtatcggcattatcctcggcgttttcgttactctcaggcttatcaaaaaggctcttgaaaagttcagaagccagactatctactgcgttatcggcatgatgataggctcactgtacgccatagttataggtcctacaacgcttaaagagcctaaagaccctatgtccttcggcacattcagcatcgtattttttatcatcggtgcggcgatcgtgttcggtattcaggtagcaaagagcgtgtatgacaagaaacagcttgcaaaggctgaagaaaagatagaagaagaatagatattatatcaaaacgaacgaatatataaaaaggctcaatttctgcatcatagaaattgagccttttgctacaaataacgtaagtacacttttttctgaacacatatcgtatggactatatgcccacctagcaaattcatattcttgtgattatataaaaactaccgcccctactgcccccttttgctgttcattcttccaaaatcagcattttatacaattaaacgccttgacaattatgcaactataccatataataaaattagacaaatactatatcctgtattatattccaaacataatatgacagctattgcagaaatagcatatcagcgtctatgatttctacaaatcatacgcctgccctatgtaaaaagtgtttaaattttaggggcgtttggcattttttcttgcaaaaattgtcggcttgtggtataattatcaggagcaggggcgtgttattcccccaaacaggtgaaaactatccttatttctcaaacgttttcgccaatacagtaataaaggtgcagagcgcaaagctcgacttgaaagtatataggaggtaaagatttatggcaaatagtgctgtagaaaaaacaatttccacgcaggaacttaaagaaaagcttcttgacgttcttcacaacgatttccagacaacacctgaggacgcttccgatcagcaggtatacgaggctctttctaagatcgttgtaggcattcttaaagctaagagaagaaagttcaccgttaaaactcagtctgagggcaagaagaaggtctactatctttcaatggaatttcttatgggaagaagccttaagacttctctttataaccttgaaatgcagaagcaggctacaaaggtccttaaggatatgggcatttctataaacggcatatacgagtgcgagcctgacgcaggtcttggcaacggcggtcttggaagacttgctgcctgctatcttgacgctcttgctgccgacggctatcatgctacaggctattctatctgctatgaatacggtatcttcaagcagaagctggaggacggctggcagaccgagcttcctgacaactggctcccgggcggctctgtatggctcgttcctgttccttcaaaggctgtcgaggttcgttttgacggcgagcttaaggaatactgggacaatcagtatcactgcgtaactcacgagaactacacatcagttatggctgttccatacgatctgttcgtatcaggctacaacagcgaagcagtttcaaagctcagactttggaaagctgaaatggctgactttgatatgtcaatgttcaatcagggcgactatcagaaggctcttagcaagaacatcatttcacaggctatcacaaaggtgctttatcctaacgacaatcacgcagagggcaagtcactcagacttagacagcagtatttcctttgcgctgcttctatcggcgatatcgtaaaccagcacatgagcgtttacggcacacttgacaatctccatgaaaaagtagctatccacatcaacgatactcacccaacacttgctatcccagagcttatgagagttcttcttgatgattgcggctattcatgggacaaggcttggcacatcgttacaaacacatttgcatacacaaaccacactgtaatgcctgaggctttggagaagtgggactgcaacctcctcaagagcgtttgccctagaatcttctctatcatcattgagataaatgagcgttactgcaaggatctttgggagagatacaaggatcaggctaaggtttcacatatgtctatcgttgaggacaacaaggtgaaaatggctacactttgcgtacacgcttgccacagcgtaaacggcgttgcaaagatacactctgagatcatcaaaaaagaaacattcaaggacgagtaccttgacacaccaacaaagttcaagaacgttacaaacggtatcgcatacagaagatggctttatcagtctaacgagggtctgacagatcttctttgcgagaagataggcgacggcttcctcaagaatgccgctgagctttctaagcttgctgtattcaaggacgacaaggacgttcttgacagacttgcaaagatcaagcttgacaacaagaagagttttgcaaagtatgtaaagaatcagtacggcgttgttctcaacactgactctatctttgacgttcaggtaaaaagacttcacgaatacaagagacagcagctcaacgctttgaacatcatagcacagtacaactacctcaaggctaatccaaacgctgattttgtaccaaagacatatatctttgctgcaaaggctgctcctggctactacatggcaaagcagatcatcaagcttatctggaacatttctcaggagctgaaaaaggacaagaagctcaacgagaagctcaacgttatcttcctcgaggactacaacgtatcactttctgagatactcatgccagctgcaaacatctctgagcagatctcacttgctggtacagaggcttcaggtacaggtaacatgaagcttatgataaacggtgctatcacactgggtactcttgacggagcaaacgttgagatacacgagcaggtaggcgacgacaacatcatcatcttcggtatgaacgttgacgaggtaaacgcttgcaagtcaggctacaagcctatggacatctacaactccaacgcagttgttaagcaggctatcgacacacttcagtacggcatcaacggacagcagttcaacgagatcgctgacagcctgaagaactctgacccatacatggctctcaaggacttcgattcttaccagaaggctcaggcttacgcttctgagtgctacaaggatcagacaaagtggcagaagatgagccttgcaaacattgcaggcgcaggcattttctccgcagaccgttctgttgaggactacgctagagatatctggggtctttcaaagtaatttattaatgcaaaaaattatcggacagttgcttggcgcgactgtccgattttttgtacatatatgcaattcatgaaacgataaatttgtaagaccacaagatgagcgaaatgaacgggacgccgagtgcgtcgtcccctgcatggttcgagcgatgtttatacaatgtgaaaatcaacataaatagtgacgtgcgagaaaagcgggctgtcgagggcgccagcacctacattgtttgtgcgatgtttattcaatgtgaaaagcaacataaatagtgacgtgcgagaaaggcgggctgtcgagggcgccagcccctacattgttttgacacacaaaaaaaggacggcttttcttcgccgtccttttgatttctaatttagtcctcgtcagcaagtgcaaaatctatcttgccggagtttacatttgcgtttatcacctttactctgatagggtcgcccacacgatattccattccgtttgtaaggtttttcaggctcaccatatcgtcgcagacatactcgccgtcaggcatattgtccgtgtgaagaagtccctcgcaggtgtcaggaagtgcgataaaaagaccaaactcaacagctgaaaccactgttccctgaaactcctcaccgatatgagcgttcatatactcagccttatagcagtcctcacagcttcgctccacctgcattgcggtaagctccgtctttgtggactggtcggcggaggcgtaaacgaacttgttgaactttgtggcgcactcctctgcactgctgccactgagaaaagctgacattatcctatggatagtcaggtcagggtaacgtctgataggtgaagtgaagtgggcgtaatcctccagcgcaagtccgaagtgacccacaggctcggtggaatatcttgcctttgacatactcctcagaacgatattgttcatgataaggtcgatatcagtaccctttgcggcttttagtatctccgacatatccccagggcaagccttttcgcccagcttatactggacgttgagcttgacaagcgcttctctcagggattcaagcttctcgtctgacggctcttcgtggatacgataaacgaacggcaggttattatccatgccaaatcttgcggcacactcgtttgcaacaagcatgaagtcctctattatctcctcgcttcttccacgggtacgcctctcaacgcccacgcagatatcctcgtcattgatgataagcttgctctcagaggtttcaagctcaggacagccacggtttttcttgtttttgtacaaaatatccgcaagctcctttataataggaagctgacctgaaacatcggcatatttttctttaagttcagcatcgtcactgcctgccaaaagtgaatttatctcggaataaacgccctttacacgggagcggataacagtttttgcaaacttatagtcggtgatattgccctgcttgtcaagttcacaaagacatgagaacgcaagtctgtcctcctgcggattaagggagcagataccatttgaaagctctttcgggagcattggtataactcggtttgcgtaatagacgcttgtgccacgcttgaaagcttcgttatccagttgtgactttggctgaacataatgggaaacgtcggcaatgtgaacgccaaggagataacctgtttttgttcgttcaacagaaattgcgtcgtcgatatcctttgtatctgcgccgtcaatggtgaatatcggcttgtcacgaaggtcaaggcggttgggtatctcctcttttatccttgaataatcggacacttccctagcttcatagatgacctcgcttgggaaaacaggggtcagaccattgacctcaaggacgctcattgcacaggcggaggctttcatggagcttccatagcttgaaactatctcgcagacgtgttcagagtgcctgtttccacgctttgtgacctgcgccaccaccttatcgccctcgtgaagctcaagacgcattgggttctcaaagatcattgcatatttcgacagcatatcaggaacgattttcagcacgccgaactcgcttacaagctcccctgtgaacttagcaaaattctcctccacaatgctcatgacctcgccctcggtgcaagctccctcgcccttgaaggttctcacaaggacgatatcgtgtggcattgcgcctttgaggtacttgcccacaacaaaaatttcctcgtcagtgtcaagatttttcacaaagccgtaggtcttattgagccttaccacctcgcacttgacgaatttcttagggtcaacgagccttatgccgaatttatcttccattatctcgccgtttttcttcattttgtcaacggtttttgtgaatttctcaaactcaaagccctttcctctgcatgatctcagcagttctttgaaagtcagtggctttttgcctgctttttttaactttgagtatattatttttctgtaatctaacttcataaatttcctttctttttactattactttactttccaaaagaaaaagccctgcacggagcagggcgggcaattatttcttgatctgataaatgatatttacagcaagagttatcacgaatatcagtatcgcacttatccttgtcagtctgttaagcttagcgtccttggtgtttgaaccgttctttccatagaaagaatcgttatatccaccgccgatagcagatgtaagaccctgctctttggtgtcctgcgcaagaactacaagtatgataacgaggctggctacgatcagcagtgcgcctgcaacgatctcaattacgctcatttttgttcctccaaaacataattatacattttaatatattatagcacacatcttctcagattgcaaggggttttcagaattttttcaattctttttctttttgtctgtgctttcagcctttgaggtggtatctttctgcttctccacctgctggataactgtgacgtttgacacatcaagacgttttttcagaagctctgtgacagttttgagctgttcatcggtaagagccttgttctcatatagcaccactgctatgccattaactgttgtgggcgagcctactgaatggctgctcatgtgaccgcctgccgcacctgttatgtttggataaacgatagcaagctcctcggcgatatcgctcatgtcgatatcatagctctgatagctgtcaagctgtgctttcagattttcattctcggctttaaggtcgtcgttttctttctgcgcaagcacctgtgccaccttgttctgtgtttcctcatcgtcggcgttcttttcaagcatcttttcgacctcgtcagcggtaacaccgctttccacctcggtctgtgttatcacaagcttataatctcccaatccgaaagctttcagctcgctttgaagcacctttgtatcagcagtgcttatctttttgccaagaagtgccacttctatcatacgtttatcggtatctatagttttctgcactatctgagtgccgtcaaagtcaaaattctcggtaataaacttctctgcactgctgttatccattgtctttttcacaatatcatagccaagataaatactaggcagcatggtaataactgtgataaaagcgatatttctgtgtatctttttcaaagccttcggggaaatatcgttgccgtgaggaagtcttaaaattttcagaacaacgatagccgcaaggcagatgaaaaagctgtttatgaaaaagagatacaatgctccgccgaaatagtcaaggcggtgtcttgccaagccgtagcctgcggtacaaaggggcggcatgagtgctgttgcgatagccacgccggggataacgttgcttttctccttacgggtctgacctattatgccggcaagtccgccgaaaagggcgataagaacgtcccacgctgtaggtgtggttcgggcgagaagctcggaggaggctgtggtgataggtgagatagtaaagtaaatcgtcgaggtgataaggcaaatgaccacctgtatgccaagtcttattgccgcaccctttgaaagagtcaggtcattggtggcgattccgtagcctatggctgttataccgcccataagaggtgagatgagcatagcgccgattataacggcggtggagttcatattcagacctatggaggctataagtatggcaagcataaggatacacatattagtaccctgaagctttgcgccagatattatcgtattatgtatctcatcagggtcagccatatcccagcgcagactgaacatatttctaagcccttgtataaatctgccttcctgtaatttcaaatctcagacctcccctgcttattttactgcaccccatgcgatgttctgcaaacgccttgcagaatcggtagtgcctgcgcctgtctgctggataaaatatagtatgcagagctgttcttttgggtcaaggctgaaatagcaacccatccagccgtcccagccgaaagagccttctgactggataagtcctgcggtggaagggtcgtcaaggatacgcatgaagttgccgtagccgtgaccctttgtgctgtcccagttaagggtcttgcgctgttcaggtgtaagaccgtttcttgtcatgaaatcgaccgtgtttctgccgagtatcctcacgccgtcaagctcgcccttgttcataagcattttggcaaactttgcatagtcctctacagtggaaacaagacctgctccgcccgactcaaaggcaggaggtacagtgtaatcagtaagacaaaggtggaagtgagtgaacggctcgtttccgccatttttgtattcataacactgggcaagtcggctgtacttttccgctgggatatagaaacctgtatcgttcataccgaggggttcaaagatctcttttctaagaaaatctccgaacttcatgccagaaaccacctcgataacagcacccatgatatcggcagatgcaccgtacatccacttttcaccaggggtgaacataagaggacgcttgcccatttcctttgcgaagctcacagtatccagaagcttttcgcctttgagatatttttcagactgctcgccccaaagcgcacccattttctgacctgcgggagtgccgtcaggataagggataccggaagtcatggtgagcaggtcgcctatggttatatctctgtcagcaggacgctcaccgttctcatcaagaaccacagggtcggagaactcagtgataaaccacttgagcaggtgacgagtgtcaagcagaccacgctcgataagtatcattgcggcagcggctgtgacaggctttgacatagaaaagagtctgaaaatgctgtcagttttcatagggatatttttctccttgtcagcaagaccaaagcttttgagatagacagtttcgcctttatggataacgctgagaactgagcctgagaaaacacccttagttatctctttttgtgcaacagcgtcgagatatttaaaattttcgtacatgatagacctccatgttatgatgtttgatatataggattataacacagttcgggtggaaatgcaagattttgtgtggcaacaaaaaaatccgctacctataaatgatagcggattgggtgcaggggcacgtcccctacattgtaaagtttacaaacaaacttattgagcgggactgaagtttgacaacaaaaaagccatgacgggaaatgcccgtcacggcgagcatcaaacttctcccagagtatcatacctatgggcgggagcaaaaaaaatccgctaccataatgatagcggattgggtgcaggagcaagctcctgctggcaaagaaccgtaattttgatagaaaccatcaaagggggtgcaacttcggttcagaggggggtgcatttttgattttagggggtgcagttctttgccgaaaggagaggagcgccttcatgaaataatgtgttaagggaaaatagttttttgttaaaatgagtatgtttttctctacacccattgcaaaccagaaagaagcgtggtataatatgacccaataaaccaaaatggtcatatttaagggggcgtgggcttggcttttaccgattacgagactgagcagctccgcaaggcgttgctgaaggaaacgagacattgtgctgtcacgatggggatgaagaaaacctccgtagagcagctgacgaaggcggtccttgccgtctgtcggcggctgtccgataccggcgacatggttttcattgaaaacgatgcaaaactgcttttgcagagtctgccggagaatgtcaaaaatgtgcattaccacgacgacgagacgcacattcgtcagcttctgaaaaaatatggccttgttcctaaacgggggatttcacttgccgccgcgacagtacgcggattgattctgaccgtctcacacaaggagcaaataggaggactgtacccgcaggtgctgaaaacgctggtgtacggtgcttgcagggagttatttgaataagcgataggctgcagaaatgcggcttttccaaggcacagcgattagcatcatctaaccgaataaccgcacatattggttagatgaacctaacgtcgaaaggaatgatagcgatgcgaaaacacaagaatttttgggacagaaatgcccgtatttacaaccgcttcatgcgaaaggatcgagcggcatatgaaaagatgtacgaacttattcgaccgattgtgaaaaataagacggtgcttgaactcgcaacgggcaccggactgattgcaaaaaatatcgtgaacgcggcggcacatatcgaggcgacggacgcctccacagagatgattgccgaggcaaagcgggataaccgctcggcaaagctgcatttttcggtgcaggatatgttctgcctgccatatgcagacaagtctttcaatgtggtgatcgtgtccaatgccctacacattgtgccgcagccggaaaaagctattgccgagattaaacgcgtgctgaaggacgacggcgtgttgattgcgccgacctttacccacgcagagaactcgtttaccggcatggtcagggcattttttatgaggatggcaggcttccctctccacagcaagtggacgagcgaggaatacctgcgctttctgcggcaaaacgtctgggcggtgcggaaaagcgttgttctgaaagcgtcatttccgttaacttataccgaatgtgtgaaatcggaggtgtgataagataccattttttcgagaacacccgcaagcctatagggcttggcggaaaaattatggttgccatgattaacctgggtcacagttctgtggcacggtgggggcttcattttttggagcttgctccggacgccgaggtgcttgactgcggctgcggtggcgagcgtcctatccgtgacacgtcccttgaaaagaccaacaagaagtttgcagacttggcaggtgtcaaacgtatccgtattcatgacttccgtcacagccatgcttccttgcttgccaatgagggcataaacattcaggagatagcaagacgtcttggacactccaacatatcaatgacatggaacacctactcacacctctacccacgagaggaagaacgtgcggtgaagatattgaacacaatcgtgtaaaaatcgtgtatacaaaagaaggggctgtaaaaaaagtccccaagaaaaaaggctgcgatcttgccaaaaagcaagacagcagtctttttttgtggtagctttacggcaaggtcgttccgcagaatgtgagagattttattgatatgatgtcggacagaaagcctgcgagaaagcagaagatcactgcttctgccgaaacggaaaagctgtccgagcagtaattcgccacggttcgcactgtgtgccctcgtgtggcgttttcagagcatgggtggggtaactaccctaaaggcagctggggcgaatttggggcgttttgttgcaaagtttgagaatggcagggatcagatgatttcgggtgggtttgagggaaaatattttattgcaagttaaagtttcggggttgaaaccccgaaacagttacagcggacggcaaagccgaccgcattttgcgagatttacagagttttcggcaaaggggttgtaaaatcggggattttgaaaattaggggttgcagtggcagaaaacagcgtaaagccaaggatttaagaggtgttgtaagatgagttttgagaataaagtaaaatttgcgctatgggcatatcccgaaacgttgaaagacgtggaggttcactacaaaaacgacaactgcaagtcgcagagtgagtttattgaaaaagcgatcaagttctacatcggttatcttgatgaggaaaaaagcgtgaattacatttcaccaatgataaccgaaacagtcaaagctacaattaagggtacggaacagcggcttgcccgcttgcttttcaaagttgcagttgagcttggcaagctgtcgcatatgactgcggcgataaatgatgtggacgatgaaacgcttagaagtcttcatgcgatgtgcgttaatgaagtccgtaaaatcaacggtattattgattatgaggacgctgtggagtatcagaaggagtgatttttaattgccaaaattaattgttacaagccgctatcttaaaagcggcagtggaaaaagaaaacaactgtatcactatgtaaaatatattgcaactcgtgagggttcagttccgataccgaatgcaaatgaaacagctcctgctacgaaaagtcagcaggagcttatttcatctctgctgcacgatttccccgacagcaaagagttatttgagtacgaagattaccaaaagaatcccacaattaaaaacggttcagcgctcatatcggtaatacttgaccgaaacatggacaggcttacaagtcgtgaaaattatgttggatatcttgcaaaccgtcccggcacagtcaagtttggttctcacggtttattctcacaatcggacgagcctattaatcttgaaaaggttgcaaaagatattgcaaaccacggcggtaacgtctggactcatgtcgtttcgctgcgcagagataacgctcaggcaatggggtatgataatttaaaagcgtggcgggaattagtcaagcggcagatttctaacattgcaaagaatcaaaaaattgatatggctaatctgaaatggtatgccgcctttcacgataagaaaacgaatccccatgtgcatatcatcgtgtactccacaaacgagcgtgagggatttctcactaatcatggtattgaaaaaatccgcagtggttttgcaaacgatatttatgcggacgaacttcaccatctctacgcacagcagaccgatttgcgcaatcagatgaaaaaagagtctgagcagttgatgaaacagcttgcggataacatttcacagaatgatgttgataatgcagaactaattgatcttgttgcaaaactgcatgaacagcttaattcttctaaaggcaaaaaggtatacggatacttgaaagcggatgtgaagaaaactgttgatgagatttttataaggcttgcggaaaacgaatcaattcaaaaaatgtactccctctggtgcgaaatggagcagcagaagcacgacgtttattcgtcggcaaagcttcagtttccaaagcttgcggacaacaaggagttcaagtcggttaaaaatatgataatcagaactgtacttgacatgaattatcctgtcattgatgtagaaattgaagaacccgatccaacagaacaatttgcgaatgatgacttttatgttgatattcttccgaagtttgatgaatctgagcaatccgaaaatgataacgtgatattttctgacaacgacgatctgacagctgaggatttcacttggaatgataataattcagtaactgttaatgttgatgatcttccgaaaagcaaatattatttgaagtggagtagttcctaccaagaagcctgcaaactgatttacaataaggaatccaagcttgaagattttcaaaaagcggaacagtttttacttaacgaatcaaggtcaggcaatgttcttgctattcaagatctgggcaaactctattctactgataaactcggcgaaaaagatgaaaaaaagtctttttcattctacgaagaagcatttcagggttttatggagattgagccggattctgattttatgtttccttatgagccgaaatttgatgggcagattatgaaacccgtgaatatgcgttcttacgtttggtatcgcacaggcaaaatgcagtgctacggtctgggaacggaacagaattatgaaaaagcgtttcaatggtttttaaaatcggctcaggaggacaacaagtttgcacaatacagccttgccaatttatgttactacggaaccggcgtggaaaaggatttgccgcaggcgtttttgtggtatcagaagtcttcttcgcagggtcagccttatgcttcctatgctgttgctcagttgtacgataaaggcgaatatgtaagtaaaaatgcagaaaccgcacaaggatattacaaggtcgcattattgggttttctaaaacttgaaaacaaagatcaggcggacgataacctatattacaaactgggctctatgtttaaaaacgggcttggaacggaagctgatatttcaaaagccattgattacttcaaacgttccgctgagatgaataacaagaatggtctgtatgaatatggcaaagcattaattcagggaaaacacattgaagctgatttgaataagggtttggagtgtattgaaaaagcaattaaactcggaaataccaatgcaaaacgttttcttgcattggaatttatttcgggcggatattttccacaggatattgaaaaaggaattgctatgcttacagaatgtgcagatgagggtgatagttttgcttgttttaagttgggtcagatttatttgaaaggtgaaattgtgccgcaggatttagaaagagcagagaaatatttgctgcttgcagaggataacgaattcacacagtatgcttttgggaagttgtatttgcaggaagaaaagtatgatattcaaaaggcggtagattactttgaaaaatccgctgataagaatatgtggtcaagctatcagctcggcaggctttatcttttcggagcagatgaacttgaaaaggataaggaaaaggctgtggagtggctcacaaagtccgcaaatgatggtaatgagtacgttcagaatatgcttaacaatattgatgattttgaaaatatgctgcttagaaatactgttatgggattgtttgtgaatttaagtcgctgtattgaggataattattcgcagaagcagtgttctttaaaaatacaaactgatagaaagctcagaaaaatgatacaaaagagaaagtcaggaattggcatcagagaagaacaaaatatgactaactaagaaatatcttaaaagctatattcaaagaaaagataggttttctcccatatgttgtgtaaatctccaaagtagtgtataataaaagagctgagacccaccgaaaaaaaagtctgtaaaaacgcagtcaactgtgatataataaaaataacacaggaggctgattttttatgggaagaagaaaaagagaaccaatgagcgaaggaaaaaagaacatcatcggaatgctgctcgaggagtatgatatccgatatcacagaccgccttcttccgcagatagaggactggcagaaacgtcctctgggcgaggtttatctcattgtatttattgatgctgtacatttttctgtacgagaaaacggacagataaaaaacttgcagcatatgtaatccttgcagtaagtttgacaggtcacaaggaagttttatccatacatatcggagaaaacgaaagtgcaaaatattggcttggagtcctgaatgagctgaaaaatcgcggcgtaaaggatgtcctcgtgatatgtgccgatggcctttcgggtatgaaagaagccgtaaatacggcatttccacagacagaattacagcgttgtaacgttcatcaagtaagaaacacgctgaaatatgttggtgcaaaaaaacaagaaagaattttccaacgatttgaaaaccatttatcacgcaccgtctgaggacgctgcgcttgaacagcttgagcgtgtgacggagaagtgggagaaagattatccaaacgccatgaagagctggtacaaaaactgggatgtgatctcaccgatcttcaagttttccgctgatgtgagaaaggtcatttacaccaccaatgcgatcgaaagccttaacagcggctatcgtcgtctgaacaaacagagaagcgtatttccgagcgatacagcgctcctgaaggttctgtatcttgcaactcatgaaatagcgaaaaaatggactatgccgctgaggaactggggcatagttcttggcgagctggagatcatgtatctcgacaggctaagctgagccggcacagtcagtctgcttccattccgctacgctccattccagcagactgactgttgaagaaccttgacaaattacggtatttattgtatactgtaaaaaaatgagcggctgtttttcaagccgctccacaatatcgttttttatcactgttgttgaatttacagagattttttcgcaggtccagagctgcagcttatttggaaaaatcagcccaaaatttcttcggacatggagaataaaatcatctcaatgttacgcaaaaggtgtgtcaactgctgacattgaagagcatatccgcaatatttaggtctgagcgtgtcagaaagaacttatggctgatttaaaatgtgtttatcccgctgttgatgtgccttctgcgcatgatgccattgacgaatttgcatcaatatgggacaagaagtatccaaagatttcaaagtcatggtatgaaaatcgggcgaatctaagcacttacttcaagtttctgcaggaactgagaaagctgacttacactaccaatgcgattgagggaattaacagtaagctgcgaaaggtcaccaaaacaaagtcgttatttccaaccgatgagagactgttcaaaatgctgtatcttgcacagaatacttttatgaaaatatgcagataagaccgacggtggtttcgacgatctcatcaaatagatttgctctttaattttgatatgccattccgcagctatacagaatttagaatcaggtcattttttgtcaaacttgtatataacacaatcttatagttttgcatttttacaatgataatatgttccgattgcccggtcatcatattcgtcagtatatttcaaggtcggcaaatcgcagatgtaatagtccgcaagtgaattgttgtgtatggtaagctttatgccgtaatcggttttgtatgccgactctataattacagtttcctcagccgcctggtacattcttttcagatatttttccgagtgcatataattatatatcagcacaaccaaaatcacagccgccccaagcagtgcagaataaattatcacgttctttccatactttttgaaaaaatatttcgcacctgttgacttgcagactttttctgtaatccgctcccgttcggcagctgtcagcctgtaggcatgtattttttttgactttataaatcccatttggtttgcctttgaaatcatatattggtatgccgcagctctgcctttcagtttcccgaaaatcacagccttgcgaagtaaaatgcacattctgtccaacgcctgcggtctgtcgctgtcactttccataaggcttgaaaacagctcgtttccaccgtaatcaagaaactgcaaaaggttttcacgcttgtccattcttatcacccgactttgcaagtacgtcttcaagctttgctccgaatttttcgtaaaccgtgtatgcaagactttcaataggcggctttgcggctttcatcttgtacatacgcttgccctcactgtctgtgcaggataccagacttcccacctttgtgggatagtttttgttgtttatccgctgaatttcattataaagttctgttagatgagtgacataaaatccccttacccccactgccgctataatttcaagatgaatttttgcaatgtttaagcactcaactggcgtggttgactgaatggattcgttgagaataacaagacttctgtcggtcatatattcgcagatttttttcagctccttgatttccgtggtaaatcggcttgaatttattccgacagcttcttcctttggaaaatgggtgaatatgtaatcggcaggggaaatctctgcactttccgcaggaacgtacaatcccatttgtgccattaaatgacatactcccaccgctcttgcgaaagtggtttttccgccgttgtttgctcccgtcaccatataaaaccgtgcgtaatctgacatatcaatatcgtttgcaacaattttttcggtcagaatttcctgcggattttgcgtaacaagctgcctgtagaagttgaggtcaaagacgtttttcagccttgtaacacgcttctcagaggggagaaatttcggtcggcacattttcattccccttgccctaacacttgatataaactgtgccgctccgccatagaagtcaagctgtgattccagctccgaaaggtctgaaaaaaccgaggaacgatagcttttaagtgctgcggcaatccgcagggcgaactcctttgtgtatttgctcagttcacggaaaagggcagtgtctatatcaatgggagtgtgccttgttgccgagttgaaatgctcctcgccaataaactgctctctgcctgcaaaacttttgaacacaagcttttcaagaatatttcccttgggataaattttgtcatatccgatttcaagcagtcctgcactgtcgggattcatagccgaatcaaaattaacaccgatttttacgctccgtatggtttttgaaaaggtatctttcagctgtgaaatgctgtatgctatttcgaaaatgttctcgctttttggcagtttttcaaaaaactgtgcaagcctttttaccgctaccgacttaattgcgtgattatactttgcaaagaacctgttgatgttttcaatgcagccgagaaattcttcaaggctgtccatatgggtcttaatctgcataaacgagttgacacaatcaacatctgaaaagtcaattctgtttcctgcgagttcatttatcagctgtcgaaatctgccgttaagttcggggacattcataaagtcctcaagacaatccagcctgtaatcaagggtttcaatgtcatctgtaaactctttcattttagatgttgcgacagcaaaattcataggtgcaataagttttgctatgttatccgtttcaagattgaccataaaatcctgcggataattttcatattttttctgccgcttttttgcatactcctcagcctccgccgacggatagaacagatctacataatcggtaattttcattgttttcactccacaatttattttgctgtaacaatattcccgtcactaatctcaataaccctgccgcattgctccgcaatcttcgggtcgtgggtaactataacaaccgtcctgccctgtttgttcagggacttgaaaagctccataatctcagcggaagtctttgtgtccagtgctcccgtcggttcgtccgccaaaatcattgacggttcattgactatcgctctggcaattgccacacgctgcttctgtccgcccgaaagtttgctgcatagctttttggcaagctcctcaatgcctaccgatttcagtgccgcaagggctttttctttcttgtcactgactttctttttggaaaaattcagcggtatcatcacgttttccagtgccgtgaaatcctcaaccagtgcaaaatcctgcataaccatcccgattttctcgtttctgatttttgcatactgactttcggaaaggtctttcacaagcacatcatcaatgtagtattcgccctcctgatagttgtcaatgcaggctaaaatatgcagaagcgttgattttcctgcacccgattttccgataatcgcaataagctcaccgtcccgaatttctgccgaaacaccgtggagagccttgaattcgttggctttctttgaattatatatttttactatgttattaagttttaccattactattcctccgataatattattgcttttttcaaagcctttggtgtgaggataatgcagggaatgatacaggataccaagatatatacagcacacacaatcaggcaaatggtgatctgtttccagcccaatgtaattactgttttgctgaacaatcctgccttgtagaaaatcaacgatcctgctattgaaattatcaaagacacaatgcaaatcagcccattgtaaattacattgattgtaagcaactgttttctttttgcaccacccaaatacagtatggcttcgtttcttatattatttttgcagttaatcgcattaacgctcactgacgcaatcagtacaagcaggtatattgcacacattattggcatcaatgtgtacaactctctataaacaatggtctgactgttgttgttcaactgagaaaactgtatcgcaaatgataatacagaaagattctcgttgatatattttctgttgtaaagcttttcatcatcggaaatattccggttgtactttataaaaagggagtctgacattactgaatccaaatcggttttattccactccttatctgtaaaaaacaatacaggttcattatatacaatgctgtccgctgaatacccaagagattcgagtttcaaagcaatctcctcgtttgtaaagcctttgtttttaagctggtcattcagacagttgaaatgtgtagaaagcattaactgataggatggttcatttgattcatattccgagtttgctccaaggtatttttcattatcaccaattacaccgattattctgaccttcaacgttccattttcagtttcaaattcagcaatatcattaacattatagccttgataatttcgggtaattacagcctgcggtatatcatcggattgcttggaatcagttatccacgaacctttttctattgtcgggcgaaaaagatttgcagaataatcatcatatacaagtgcatatgcggtcttaacctcgttggtttgtgtatcaacgcctgtttgcagggacgcaaagtttacagacgagataaaatcaacatctttcagctgagttttgatttcatctgtgttttccaaaagtccgccattttcattatctttcaaaaaatatccaccacaatacaatccctcgccattaagcagcggtttgacagcctcatatgaggaagccttttcgtctattatcgatgtcataattattccgataacaaaaacagcaatcagctggaggcttattaaaacattgataaacgagtgctttttcaggaagataccgataaccctgccgtataacttaattctcatttcaatccctccttaatttttttgccgagattatgatgaagcaaaaacagattaagaagatacgatattgcagagtaaatcaaaattatttctgcgtaaacatatggattatatgcagctttcataagcggaaatttagctgaaagtacagtaagaataaatttatcatagcacaaagctgaaataatgcttacaggaagcataataagaataatctcatttgcggttgatatgctcagatttgaggttaaccctccgcagatacgcataatggtcagttgtcttgttctgctgataatgatgtaattatacagaatggaaatgttcaatgccgaaagaatggcaatgattaccgaaatcagtacaactgttatgtagtaggaagtgtttgatgccaagtcgaatgccggttcataaagagtgattttatctttgaaaaattcgctgatatatgcggtaaaatcatcatattcagatttagtgattttattgttgagtgcaagataaaccccgtcgttcataattgtatcgtcggggactgagctgaacggaacatagatactgtaaaaaaaatagctgctgttagcagggtttattgtgccgataacatcatagctctgaccgaatgctgtaaccgaatttgtatattcgggtgctggagtcggctgatttacatttccgctgcccattacaacagcctttttttctccgtttgaatattgctcctgcgtgaaaaaactgccgtccttaattacaaggtcatcaatcattggctgaaatactttatcggaatattcaaattttccttcagaatactgaagatagaatgcgacaggtatttcctcatcaattccgcttacctgcgtggacgaaaaacaggtaatatatgaaacatcacccataagcttattcggcatattcttcacaaactcacaaaaatttttttttgtaataatgtcatttatggaaaaaccgacagcatagctgtcaatttcgccgtcctcaatatttttgctgtactgatagtacaatccaacaccgaaaaacaaaaccccgaatgaaacaaacatagaaatcacaagtagaaccagcataccggtatgatttttcatcatatttctaagatttttcagcgtgtacattctttcctccttcaaacccattaaggcaatgcattatctgatgttattcagataatgtattgcctttgtaaaatgttcaattgatttttattaaaatttctttaatgcatatttaattcggagcaaagcccgatgtaagcgtagcttttcatcggctgcgacgaagcaagcttgccgcaggagctttagctcctcagggttatatattagtaatcagactgaatatccttaaaaactctattatctttcatgactagagttctggcagaatacttataactagtattacggttatgggttgttgttgctttcaaaagctgacctttggacagcgtaccttttttccatccagaaggagtataagaaccgatttttgctgcagaagtcttgtaataaagggttgactgtacagagtaatttgtttttgtagttgaaagattcgttaccgttcccactgaatctgtctcgcttggagtataagacgtatatgcaagtataattcgataactatcctcatatgatgcttgatacgcactagcacctatagcactcatagaagccattatcataacagcagcacccatagccgcaattttcttcttaagtttcatattgaaaacctccttgaaattttttattgctttcatcataagacaaacgcaatactcccgacctaaagtctgtattctaaaaaaaccatctttaagcaaagtaaaagacaatttctatacttgctatgacaagtattacagtactttgaaaacctttgaatcaatcttcttcctgcacaaaatgattaattcagctcaaaactatactagtgtagatcgtaatagtcgaatatgccaatcttttgaattgtgttttttgatgcttatctcttgtagatgttctttggctctttagtctgatatccaccgtatgccgaagctgctccacaagccaaaattgctgtatgttttgcaatcttctgaatcatttcagctagtagtttttttaaacttttcacattaatcacttcctctctctttaatctttgctgcaatcatgagcaaggcaattaaaaaagttgttaatataatcattgtacctagataacttctcgaaagaaacaatccggtacaattaattattaaagttataactatccctattattttaagctttattcttttcgaatcatcaattggtttattcttattctctataggacccaagatagaaactatcagttcagtaacacagattaaaacaataataatcaatagggagaatttattagaaaatatactattggctaaagcggttaatatgaatgtagtacacatcaatagattgcacctaaagtatgtgtcggcatgatagcctccggtgaatgatctgataagtataaatagtgtaagaaaaacaatactttcgattatatgatgaataaggatacctgctattacaacaagaactatgttaagtaacgatgaaatacttatttctattccatatctataaaagtcttgtacatctgattcatcactgattacatcttgttccgtaataaaattaacaatctgagataccaagtaattcataattttcaccttgctttttttgaattttacaatataaaatatctttcgtcaagcgttttggcatattgtgcagttttcaggcacaaaaaaataactcggcataagccgagctatcatatgagttaagtttctaagattatagagcagcagaaagcattgtcaatttcatagtaatcatatcttccactgtatttatttactatgtccctaataatagaagtgccaagtccatggtttatgatatctttctttgtggtttttaattttggattttcgctaataacagacttatctagagaatttttcactataaatgtataaatgttgttttctttactgatttccaaatagataaacttgtttaaatctggcggcatagcttcacaggctgtgatcgcattttccaaagtattgctcaataagtcacatagatcaagctcattgatacctacaaagtcatttaccgtaatacatgacacctttattcctaaagttgatgcagtagacaatttagagttgattattgcatttgcaactggattattggtttgaacaaatgtcattgtagctttaacaatgccgttggattgttcaataaattccaaagcatcttcggttttgccacttgtgagcaattcataaacggtggtaagttgatcctttatatcgtgccttatttttctgatcagctcgtattgagtctccgcattattaacatactgttccatatactgttcttttacggatagtaccttcatattctttatctgagcattcttgaagaagagtgaataaataacgtaaaacattaggaaattcagtataatgataaccaggtatgataaattgatgtatattctttgcgtatcatccgcattgagtgaaagtacatggagaagtgatactagaataaaggaagatattaatactgtgataatcggagaccaatctgatattgtataactgtcagagaatttgaacagcttgattataattttcaaggagatccaaagagaaatctggattacaatcaaagtcatgaatcttacgctattatcatttgtaatcaagtccttgacgcttattctatttagagatgataataaattaagttcaacagaagtgataagcagcagaataatattgggaatgatcgttgatagtagttttttaataatactgtcgttaaaggcaataatggcatataccaacaatataactaaatataaagtacttgtaaatccctcatataaagtgatgtgatttaacagggttatggttgttccaaatatgatactaaaaatcgaaagaaatgtttttgcctgtttgagagatttaggatttagaaatctatacacaaaccatgtcataataaagccctgataataattaatcacaagctcaaagcatttccatagcaagttcttcattttgtcttcctcaaatactgtgttaatttctcatcaacagtttgtttgtagtttttactcatatttaatctaaagccttgcttaaaaattatctcgtctttatttctatctatattaaaaatgtgacgaagattaactagaaaactcttgtgtatccgagcaaaatcatattgagaaaaatgaatctccaattcaccaatattacctctgatctttatcggttcgttatgttctgaatgatagataacataatgtttactgctctcaatataataaatgctctttatttgcagcggaactcttccgacttctttattttccaaaataataattgtgttttgcttcatttcattgaagagctgattaaccacactatgtagtttttctgtgaaaaaagaatcattgcttttggttataaaattcagtggtcggaaataaagactatcataaaccagttcaggatgattggtaacaaaaattatgtaacagtcgtttgaacttgaaatcttagccgctaattgaaatccgtcgagctccggcatatcaatatcgagaaaaatcacatcaaatggctttattaagtggtgctggaacattaattcgcttgaaacataggtctctaactcaatatcttcattattctgccttgtaaattcagattttacagcttgtgacattttattaacaaatacgttattatcatcacatattgccactctgagcatatgtatttcctccttaaaatgtagtataaatcacaacaattgtatttgtgatataattttacgacaaaattcgctgatttttataaataatacagatttatgactttggactatatttatactataataaaagtgttggaaccggaaagagaggcggagcatatattatgaaaaagcaagtaaaaagttcaaatgtttttggcgaaaagcaaaaacgcattatagctaaaacattgatcaatctgcgagagctaaactttctaacacaaacagatatagcaaaacatcttcatctttctcctagcacgatttctcactatgaaaaaggattaactgtcccacctacagaagttgtgtatcgacttgccgacttttataacgttactacagattatattctcggcaaaagtgcaagcaggacaaatcttaatgacacttatgcaataaagctaacaaataaaatgactataggcgacgctgtagaaataatggcaaagatggacaacgcagaacgtgagcatttagcgtatttcattgaggttataggaaagtcaaaaaaataattcaatttagaactctgaatttgtatcagggttcttttttattttaccataataaaacaacaaggtcaagcatattatgttagttttctgatctttgcatttcgtgctaaacatcttcaccttatgccaattttgttgacatcgataatgtaaaacgtataattaaataagactcatgcatcatatgaaatttaataaggagaatttttatgactataaatgcttggagagcttcaaatgtaaaaaattttgatcaatatactgaattgtacgattttgcaggtgtttctgtttttaaaatcgtagttcagtaaagaacacaaaacatgactgacaaactcagattcggtcagttcatatccgagaaacgaatacaacactctatgaccaagcaagaactcgcaagacagattgggatatctacagcatatctcagtcaacttgaaagcggagcaagaagcaatccaactattgaagtgcttgaccgaatgattaataaattgcacttggacgaagcggaaacacataaaatatatgatctctatgcagcatcaaatgatacaattagtccggacattattacatatctaaagagcaataatattgtaacaaaagcgattcgtaaagcacaggaaaatagtgcaacagaaaaagattggcttgatttcatagaccaacttcaaaaatgaacaaataattttgcggtttatgccgcaaatttatttagcatcagtttagcttaccagctaaacgtcggaggattgatagattgacaatagataatatacatcatatacgctgcccaatatgtggtggcagactttttgatgtaataacaggaaaaggcgagaatagttatttcggtacaaactttgcagttatgatcaagtgttggaaatgccgagaaacaataacgttaaaaccattaaataatattaattacttagtacaagcatcacacgtttgtttaaaatcggagtagaagcctgacaagtagcttttaaagctagtgtcggtttctatttttttatttttgttaactccatttttgctttaagagcagaaatggagtttttttatgcccatttttaaatactggcagcaatacatagccaaatatccataagccttcgttttgattcagaacaagaaaatcaaaacggaggaataaaaaatgagcaaaaacatagtaagtgtttatgacactataaccaaaagatacgttgaaattgaagtaagcgaaaagatccgcacatattacaatagaacccaatggaatattgatgacaacaataaatcgttctataagcacgagatccagttctctgcgttgaaaggaaacattaacggagaacttgaaaactttcaggagttccgaacagaaaatgacgacgtcgaaagaagagtgatacaaaatattaaatgcgaaaagctgtatagctgtctgaatgaactttcagaggatgaacgaaggttgatctttgcaatatattttgaaaataaaacggaaaacgaggtcgcttgttttctacataccactcagcaaaatattcacaaaaagaaacgtaggattttgtgcaagcttaacaaacttttgagatcacaataaaaaacggttgttaaataccagacttctacccctatacaagtgtaaggagaataaaagctccaagtaacttgacaatagaatatcaactctgcaagtacgttgatcacacggctggtatgaaatctcggcagccaaagaaaccacacgccaagactccgaaaggatgagcgataaatgtgacgtttcaaaattcggaacagctttccgaaaaggcgatgaaacgtgtgaggataatgatacttcccagtaggggctaaaagagcgggtgaaacgcccatgagatcgatacgctgtcgattgcctgcagagttccgccgcaacgggtatcggggataaatattgcggaaaacgtccgaaacaaaatggatcggacgaaggcaaaacgaattaaaggcggtttgcacacttttgcagaccgcctgttacatataaattaacaaaagtcaggaggctgatatatgagcgaaaaagttaagcctgaaaaatcagattttcggtacgaatataataaatttggagtatatattcctgctcctacaatcagattatcggacaagcatccatgctgcggctgcgtgtggtatgtcagagatacaaatgtgctgttctgtccgtttcatagctgtataaggaataagaaagtttttgaaactctaaagaaaaaggtgaaggaaaatgctgatcaaacgaggtgatattttttatgcagatttaaatccggttgtcgggtcagagcaaggcggtgttcgtcctgtgctggtagtgcagaataatgtgggaaacaagtacagccccaccctcgtggttcttccgctgtcaacagccaaaaagaattatcttcccacgcatatccatatcaagggttcaaaagcattgcccaaagattcgatcgttcttgcagagcagataagaacgatagacagaaaccgactgaaaagttacataggttcagttaatcttgaacttatggaaaaagtagaaaaagcaatgaaaataagcataggagtggattttgatgactaagttcggacaggcagaatacaacgattttatggcaagagcatttgcggataagcttgataaaattcttgaggcagctgaaaaacagaattacatcaacagaaatacagaagatatatacaaagaatttgcgtcggcaaaagacgcagcataggaggggtaaaatggtaggattttttattggcttgtttgtcggagcttttatcggcataactgtaatgtgcctttgtacagcagcaggacaggcagataagtataaaaaccgcacaagcaagtataagtaatttcgttaggtttgatgataccatttcagaaaaacttgtggtatcattgttggtaaaacggaggtgagaatatgccaactgtaactgtgatacagccgaccatagcagcagaacaaaacacaaagatccgttgtgccgcatattgccgagtatcaagcgattccgaagatcagctcaattcctttatggctcagacaagatactacgagaaagcttttgaaaattcagagactgaacagctcgtcgatatctatgccgatgagggaataacaggtactcgtgaggacaaacgtgatgaatttcagcgaatgataagcgactgccggaaaggcaagatagacaggatatatacaaagtctatcagccgatttgcacgaaacaccaaagactgtctgaaaaatatcagagagctgaaaagcttaggcataacggtgctgtttgaaaaagagagcatcgatactgctgatatgactgatgaaatgatgataaccattatgggcggtctggctcaggaagaatcgacttctatatcgcagaatttacggtggtcttgcagaaaaagaatggctaatggcacatatgaattatcgtgtcctccttatggctacaaaaaagtaaatggcaaacttgttatttgtcccgagcaagcaaaagtagtgaaagagatatacgatagttatctaagcggcattggaatgatatcaataatgaaaaatcttaatgaacgtaatatcccctgctgtaaaaatagtgaacggtggcatatgataggcgtttcatatattctaacaaatgaaaaatatacaggaaacacacttcttcagaaaacatattcgacaaacacacttcccgttaggcgttttaagaataacggaaatgctgatcaatactacgttcgtaacactcatcctgcaataatacaacaggagacttttgataaagtacaaagacttatatcagagaaaaatcaaaagcagcctagaggtacaccacacaattcagtcttacacaaacatatcttctgcggaagttgcggctcaatacttataagaaaatcctgcagaaaaaaatattattggtcgtgcagaaaacacgatcttgcagcggtggactgccctaccaaacaaatttccgaagataaaatccactccgcttttatacgtctgtacaacaagctcgtgtataattttaagcctgtacttacaccactacagcaagccttgcaggatctaaaatacaaaaatactaaaagcggtacgactataattgaaaagtacaaggaaatcgctaaactgaaagaacaaactcacgttctcgcaaggttgaaaacaaaaggctttcttgatgaggcaaagtatcttgaacaaaccacagagcttaactcaaaaatagcaaagttacagaccaaaataaagaaactgaacgtcagcgatgaagaagatgagactcttgaacagcttgatatgatcataggatattttgaaaagcggcagaaacttatggtagaatttgaagaattagcgtttgagagtattgtcgataagatagtagttaagaatcaaaatgagctggaatttcacttgatcggtggattagaacttgcggaggaaatatgatcttggtgtcttgtataccaaattgcagggcattttatgttggtattgatactggatttttgcaaagctttgtggtatcattgtcggttgaaaggagtgagtttatgcctaaaaacagaataatcccattcggttactgtatgaaaaacggtgagataataaccgagcccaacgagctctataccgttgttacaatatttaatgagtatttaaaaggcaaaagcttgtcagaaatagcggctttgatggaagtgccatacagcgaaaattcatcttggaacaagaatatggtcaagagaataatcgaaaatgacaggtatcttggcacagagaaatatccgcagataattgacaaagaaacgttcaaacttgcaaacgaaaaacgtgtcagaaaagcgactgcatcgataggtcagactgaggaagtcaaactgctgaaacaaataactttctgcaaagaatgtggtcaaaagctaacacgcacaaaggacgaactgtgggattgcagacgtcctgaatgttaccgattagatcatcgggttacggatcaaatgatacttagtgccgtgctgaatgtgttcaacaccgttattgctaacccgacgctcattaattcagactgcatggttagcacatactctccaaatgcaaaggtcagatttcagcaaaatgagataaatcgaatgacagatatggtacatacagatgaaaagaagatcaaagaagagcttttcagacttgctcagctgagatatgactgctgcacttatgatgacagtcagccaaaaacagaacttttaaaatcaaggctttgctgcgaacaactgaatacacttgatattggcttattcaaagcgtgtgtttcacgaatctggataagccatttttgtaccatagaggttgaattcatcaacggagtacacatcaaaaacattactgaaaggaatgacaaaaatgtccacagcgccgaatgtaacggtgatacctgcgaaagtgcagacagcggaaaaccgtgataaataccaccagttaagagttgccgcatactgtcgagtatctacggctcaggaagaacagcagaacagctatcaggtccagatcgcatattacaccgatcttatcaacagaaaaaaggaatggacgcttgcggggatattcgccgatgagggcatcagcggaactcagacaaagaaaagaaccgagtttaaccgcatgataagaatgtgcaggaacaaaaagatagatcttgtgatcaccaaatcaatatcaagatttgcacgaaataccgtggattgccttgaatatgtcagacagcttaaagacttgggtatcggcgttattttcgaaaaagagaacataaacacgctgacaatgacaagcgagtttatgatagctttgtatggaagttttgcacaggccgaaagtgaatctatcagtaagaacatactctggggaaaagaaaaagcatacagagagggaaaagtaaattttcagtacaaacatcttctgggctacaaaaagggagcagatggcaaaccagagatcgttcctgatgaggcggaaacagtaaagctgatatataaactatttcttgacggttatagtatgaaaggtataaaaaatgttcttgaaagcaaaaagcttcttacctcaatgggtaataaaatctggaacgaatcttttatccgcagtattttgaaaaatgaaaaatatgtaggagacgctttgctgcaaaagacatatacgcttgactgtattacgcataaggtcgtaaaaaattacggtgaacgtccaatgtatttggtgacagatcatcacgacccgataatagacagggatacctataaccgtgttcagcaagaacttgcaaggcgaagttctaaacgaaagataagtgataagaccaaaaccgaacaaggaaaatacagcagtaaatatgcactcacagaactgcttatctgcggaaaatgcggcacgccttaccgccgtacaacgtggacttcaagagggaaaaagcaaattgtttggcggtgtataagccgactggaacacggcagaagatactgtcccgattcgccaacgataaaggaagaacagctccacaaagctataatacgagcgataaataactactactcttgtgggaacgacgttgaaaagatcttaaaagcgaatatcggcaatgtgcttgaatttcatgggcaggaagagatcacagcgatcgaaaaaaggcttaaagagatcgacaaggcaagaaatgatctgataagtctcatagcaacaggcggctgtgatgaggacaagctggacagcgagtttgaaaagctgtataaggaagagcaaaacctgagtgaaagacttgcaatgctgaaatcaaaaaatcaaacttccgccgaaactcaagccaagcttgataagataatagatatgatagagcatgagaaattcgagctggaaacgttcgataacgtacttgtacgaaaactgattgagtgcgtaaaagtattgagcaagaccgaaatattggtgattttcaagggcggatatgaggtgagaactgaaattgaataacgatcaaaatttacggcttgcgatatattcgcaggctgtttttgttgggaggtgtaacattgtcatcaaactttgacggcataaaaaaaagaaaattcggtatagagatagaaatgacaggacttacacgaagtcaggcggcaaaggctatggcaaatgtccttgacgggcgtgttgaacacgagggtggaagctatgataaatacgttgtcacggacgccaagaaccgagggtgggcgatagtttatgacggcagtatcaactgctataacgcaagcggagacagagcgtctaaggcatacagcgtggaaatgaattctcctgtgctggaatacgaagacataccgcttttgcaggatgttgtgagagcactaagaaaagcaggcggagtgacaggtccgagatattgtgcagggacgcatatccatatttcagcggacgattatacaccacaacagatacgaaatcttgtaaacatcttcgcaagcaaagagaattttctgtgggacgctttgcaggtatcatcagcccgtgaaagctactgtcacaagatggacaagcagttcatagcggacataaaccgcaagaaacccaaagatatggaggagataaaaaagctttggtatcgtggaagaatgagcgagcagtttcagcattactcaaacagccgatatgttatctgcaatcttcacagcttttttcagcatgggcattatgagataagggcgtacaatggttcacttcacgccggcgaggtaagaagtcagatagtgcttgcattagccataagcaatgcggctatgaccaagaaatattgttctccgcacgtttcacaaagtgataatatgcggtacagtttcagagtgtggcttttaaatcttgggctgataggagatgagttcaaaaattgcagaacacatctgctgaaacatcttgagggtgacatagcttggcgacacccggaggacgggattgctgcaagggcaaggcttaaagaaaagcgagagcttgagaaacaagccgcccgtgagcagcgcaacgagcctgtgtgccattccgatgatgaaaccgagtgtatacccgatgaaaacaacgagccatcagaaagcgaatgtgacggcattgaagaacttgaaatgagtatgtaaatttgaaaaggagatttttatggaatacagaagattatatatcgcttatggcagcaacatcaatcttgagcaaatggcaaaccgctgcccgaattcaaaggtcatcggcaaagaaatgctgaaaggctatgagctggagttcagaggcgttgctaccattgtgccgaaagaaaacgcagaagttcctgttctaatctgggagatagacggacgagatgagcacagtcttgacaaatatgaaggctttccgaactattaccgcaaggagctttttgagatagatgttaatggcgaaaagaaagaatgtatggcatatctgatgaacaacggtcacatttcgccaccgatgagctattattacaacgtcataaagcagggatatgaggcgaacggtatggatacaagctatctgagggcggctcttgaaaagtcggtttgcgaacagtattttgatgaagagatggacgaggaatttgacgaagatgatgatcttcaaatgaagctttaaggagattgattaaatgagatacaaggatttttatgtgagaattacgccagacaaatatatccccagggttgacaaaaaaggtgataaaattctctgtgagggctttttgatacggatttttgctgatgaaaaggggcaggacgagatcgacaattttactgctgcggtggggtttgagatactggaggacagtttggctgaggcggaacagttggcgaaggattttgtggagtgtgaggggaaggagtatctcaagattgttaagtaagatatatggtgattagataaaaagaaacaaggcggtatggaaattatcgctttgttttctctttcaagcttttgagtatgttgagagtttgaaagagaaaacacatacttttgtcgacaattgtcggatttgatgtagaataaacttgaaaaatagcgaaaatgcacaaaaataacttgaaatttggaatgatttgtagtataataaaaacaagctaattcattggcactgttgatctcaaatgaatttgttctgtatatcaatgataaaataaggttttatatcaagacgaatatttttattaattatgatacatttatattttagaaaatccaatatgatagtaggaggagaaaaatgattttatcggataatgaaacaaagattgatatgttaaacaataaagcaattgcaaaaacagtggcggatattattcgtgattgtgatgatcgtccgatctctattggtattcatggagactggggtgctggtaaatcttcgattttggccatggttgaggatgagtttaattcagcacctaataaaaatgataaaattgtatgtattcgttttaatggctggcaacatcaaggttttgaagatgcaaaaatagctttaatgagtgccattgtttctgagttatcttcaaatataacgatatcagaagaagcaaaagatatattacaaaaactatggaaaaatataaactggttttctgttgtaaaaacagcgggtagtgctgctttttcccttgcaacaggtctacctccaattggattactaaacactctaacagataaattgaaaggtacaatttcaaatgaaaaaaaggtcaaaggcgcattagacagcatagaaagttatatgaccgacgcaaaggtttttgaagatgtatctttgaataaagagttttctgaatttcaaagatcatttgaggagttattaaaaaaatcaaaaatagataagttggttatcttaattgatgacttagacaggtgcctccctaaagtaactattgaaactttagaagcagcccgcttatttatgtttacaaaatatacagcttttgttatagctgcagacgaagcaatgattgaatatgctgttcacagtcattttcccaatttgccgacagagaaacaagatgatgataatagtgatgattattcaaagcgttatcttgaaaaacttattcaagtcccatttaaaatacctgctcttggtaaagtagaatccgagatgtatattactcttttaatgattagttcgcaaataaaagatgatgataatgaattcaacaaattactttcagtaactattgaaaaaatgaaaaaaccttgggaaaactcaggatttagtgaagaagaattacgaaacacattggaaacgagttatccttcacttattgaaaaaatatctgtggcaaatcaaatttcagatattctatcaggaaacactcaaggtaatcctcgaaaaatcaagcggtttatcaatatgttgttgttacgaaaacaaatggcagatgctcgtggttttggagactcaattcagattccgattttggctaaattgatgcttgcagaatattatttttcagataaatacaaagaaattgcagcacttactgatgattatggtaaatgtcctttattgactgaatttgaaaaacaattgtcaaccactgatcctcttctcaaaattgaagatgaatctgagcatggtgctgttgttatatcgactccaagagataaacaaatgcaagaaacgccaaaaaaggataagcatattgaaaaatgggaaaaagataaggctttttcaaaatgggttgcaagtgcacctatgctagaaaatattgatttacgcccatatttctttgcatgcaaagagcgggaagactttttctttgaacagataaaatccgagcaattgagagaattagtatatgtattgatgagtggtaagatggcaattgccagcaaaattgatgagattatacatttgtcaaatgatgagtcgcaattggtatttaaccaattgaaaatgaaagtaaaaaagatttcagatatatctacgcaacctaagggaattgatggaatacgaatccttgtagaacatcacaaagaacttgaaaatagtttgttaagttttattgaatcatttcaaacagatacagttggtgcttggatatgtgcaggttggaataatagtattactactgatgaaggcaaagaaaaactttgtaagtacatagaaaaattaaaaacaaacggaacagaattaacaaaaacagctgcggaaaatgcattaaaatgaggtgaaaaaatcatgggaacatctacaagtaatcgaggacaaaacgggaaaacaccgttagtaccatcttggttaatcgatgatgaaaataacggtacaaaaccggatacggaaatcactggcgataatattcaacagcaggatgatactcagtcatatgattcaaagcgatttacatctcctagaagtgattttactcgctacataaacagtggtggaaataaaactggcaggctgcataaagctatttcgtcatatgtgagaaaatctgctggaggctcaaagaatgcaacaatgcgtttaggctcagcacgaaaaagtactgcaaaattagtaagcattatgagcggttttgctggcggcaatatttctgctacagcatacaggttcaatcttggagatataattggaaaacctgccaaagaagtttttcttcgaattatagactttgtttgtccggatggtggtaggactgatgaaggaattgcgagaagtgcatacatagaagcgttatcttcgataccggatttagaaaacaaacaaatcgaatcattatctcctttagaatttcttgcctttactgaaatatatatggcagatgttatacaacaaaaacttcttaatgatattggtaataagattttttcgctgcccaatgatatattatgtattgaaaacatagagaaacaaatgaaggactttatacaaaatgcgatttcagattctatttcaaagttaaatgttgatatttgcaacatcagtcagcagcaagcccaagatgtcgtagattcagtttataatacagcgtttgaaataatgtcttcatatggggaggaatagtttatgagcaaatataagctgattggtagctatgatggcaatgatattagtatgaaaaaaattgaaaatactgtagttgctcaaatacctttgaaaaacgaaggtgggcttttagtttacatagaaaatattcttaatgatcttagaaaaaaagaaatatatcctacagaagatgggtttgatattattgcattagcaatattggtttatctcgctgatacaagaatatctcgaatcaaacatgcagaagatagttggacaagagaaattgctattgaacttccggttttcaatttgaacacttggaaatctgcaaaaaaactattctcacaaatgctaaattttcttaccggcgaccgttggaaaattgattttgttaaacgggaaaatgttcttgcagaaagcaaagaacgaaaaactagttacgatgccgtatcgctgttctcgggcggtatggatagccttattggaacaattaatcatttggaacaaaatcatagtattgctttggtaagccatgcaggtgacggttatactaaggaagctcaaaaagctttacttgccgagttcaaaaacaaatatcccaatataatgccaacatattttaatctttggctttcttttggcaaagatatgctgcttgatggagacatagagaattcgacaagaagtcgctcgtttttgtttatatcttttggtattttcattctcagtgggttgaaggacaataatgttctgcaagtacctgaaaatggacttattgcacttaatgtaccgcttgataatctgcgcgttggatctcatagtactagaacaacacatccattttatatgaatctttggaataaggtattattaagtttagagttaccatattcaatagtaaatccatattggaataaaactaaaggtgaaatggctgatgaatgtttgaataaggatattttgttggagataattcgaaaatctacatcgtgttcttcaccacaaaaagctcgatggtttgggctgccatcccagcattgtggatattgcgtaccttgtcttattcgtcgtgcagctatgcataaagcgtataaattcgaaaatgacccaacaatttactccgtaaactccgttaaagaaattatcaatgcccattctaagcgtaaaggagaacagcttcgctcgtttcaaatagcaataaaacgcattaaagaaaatccagacttgaaaaatatacttatttacaaaggtggcaggcttgatggaaataaagaatacatagatcagttatccaatgtttattaccgtggtttgatggaagttgataactttatttccgaatacttaaagtatgaagaacataaaactgataaatagattttttgaggataattgatatgatttacgatttacattgtcatctggatttattgccgtcaatgagagagtttgctaaggacgctaaagaaagtaatattaatattttagctgtaacaactacgccgaaagcatatgaaaaagaaatagcttattttcattcatatgaaaatataaaaattgcgttgggattacatccccagctagtttctgaacgatacaatgagctagatctagttgaaaaatacattgaagatgctgcttacattggtgaaataggattggactacaatcgtcaattctactcctcaaaaaataaacaaatagatgttttcgagaatttaatcaaatggtgctcatcaaaaggtggaaaggtgatttctattcattctgttcatgctgataaaaatgtacttgatattcttgaaaagtatgattgtaccaagaataacaaatgtattcttcactggttttctggttctttatcacaacttcgtagagcagttgaaatggaatgttatttttctataaatgagatgatgatgcaatcgttgaatggtcgtaaattaatatcgaacattccaattgataaggtattggttgaatcagatgctccttttattaatagaataagcacgcctcagcaactcgaagctacaattctgagagttgaattgtacgcaaatactatttggaatcatggctcagaaattattcatttatctagtaaatcactatttaaataattttacgtacgtgaatcaatttacttttatcagatataaatttaatagtgtcataccgtgataatttactcttaaagcacaacaaaaaattggagatttattatgacatataaatattgtttagttagaagagctatatatgaaaacgatcctacaagtaaattaaaaaagcgtcgaagtttaaaggatatgaaaagattatttaaacttccattttggattatgatgtttttggtgatatgttcattaatatctattgctttgattctattgtttaaatttaatactatgttggtttctattccttattttgtaattgcactagtttcattcgtttttgagatacctcgtgaagataaaatatatcatatggaagagcgaaataaagaaattcgaataaaagagtgtgagtatgaagaatatattaataatgtcagagaaattctaacagagttaggagtaaatactccgaataagattgaaaagcttaaggaagaatgcgaggaaattttaatcaaaaggaacaataggttttcaaatataaacaacagaataatcgatatgctaataggagttccacttggtgcgttgatagcaagtactatatatgctgatactaaaacacaaaatgagggtattgttttgattttatctataggattaatattatttataattattcaaattgcaaaagtttggcaatattacacagatgcaaattttaaagatagataccttttagatgttttaaatgaacttagttattatagtgacgaataagaaatagattccgtttttcaattgtaaagcagatactgacaatattcatctattttatagtagcaagacatacttgtgcaataaaatagatgcacacctcgaaaagctcgtatttacgagctttttttgcgttttgagggtaaaaatttcaggtgtaaaaccgtagatgctttttcgttaaaaaaggatctgaaccctcaacaattaaacatcgtcaaacaagtaccacaaaaaaagactgctgtcttgctttttggcaagatcgcagccttttttcttggggactttttttacagcccctttttttgtttgcagcaaggtgtggtcttgacgcagggagctgtgaaacgccttatggcttgaccttacggtataattatggtaatataaaatcgtacatagactatgttataaaaggacgtgaaaaaatgcggatcgcagtttgtgatgataatgctgtttttcttcagttttttaaatctatgctggcaaatgagcttgaatcaaggtcggtcaaggctgaaatagaaacgtttaccaaagctgagagctttttttactgccatggtaaaaggcctttttcggctatatttcttgaccttgatatgcctgaaatgaccggttttgaagtcgcgcgtcagctaggtcagaatggtaattgcttcgtgatctttgtgacaagtcatcaggaactggtttatgacagctttaatttcagaccgctgaattttatctgcaaagatcctgacgctgatgttatgaaggataggctccatatggtagcaggacagttgacggacgcactgaagcaggaaaagacagtggttttggagaatagggagcagggaaggatctctgtaaagcttcgggatgtaacttatatagagagcaatagccacagcatcatatattattttgcaaataataaggataccattgcagtcagagatagcattggtgagatagaagaagcttatcgtaaatttgattttatacgggtgcataaaaaatatatcgtcaatctgaaatatgtttttaacataagccgttcaaatgaaacagtgatcttcaaaagcggttcagagcttcccatgagccgaggatataagaatgcagttgacgacgctttgactgaatatctgaggagaaagtgatgactattacattgtggacgatatttgagatcttgataaacttttatcagggcggtctggaaacatggtttatatatagattccttacgccaagatctcatgaaagggctaagatatgggctgttatatttgccgtttgtgaaggctgtctggtcactgcttttaattatttcactgtatttgagggctttggaagtgctttgtactgggcaagtctgcttgtttttgcgttttgcttttttagtgacaatgcagtaaagaaatttctttccatatccctctcgcaggttgcgatcttgttgataacgtcattggaactaaatgctgtatcgtcattttttaaaatatccctcagggagcttgtggtcgaacaaagcttgcttagatttgtgacgcttataatgatccagatttctatattcattgtatttagattaatactgatggcctttaaacatacagatgattatacggcttcagattgggtgacgatcattgcagtgcttattatttcgtttttcctcgttatggtaatacatgaactgtccctttcggcagacgatggccataggctgtatataaatctgtcatatatgcttgtctttgttcttaatatacttatattctggataataaattctttgataaaaaagaatcggaagctcaaggaaatggagatagtcaaactaagagagcagtatcttgagcagtttattggaaacgccgagtcgcaatatgacgccatgagaaaattaaggcatgatataaaagacaaatatgaaacggttaatgaactgttgaaagtccaaaaaatagatgaaacgagaaaatttatctcagaaagctttgaccttatcgagaagtcggagtcctatgttaaaacgaaaaataatattgtaaatgctatcgttaacgcaaagcttacgatggcttcttccttggggataaaaatatcatgtataacagtttcagattttgagggaataaagggaactgacctttgcgacctgttgagcaacacgttggagaatgctataacggcatgcaaggaaatagccgacgacgcaaataaatttctgtatctgaagatcgaccgagaaacggatacatatacgtttttgataaaaaattcaatagatcattctgttatggatagtaatccaaggcttacgaccacaaaggctgataaaaaacagcatggtctggggacctcaataatcagagagatagcaagaaaatataatggcagatgcgatttctatgagtcggagggaatgttttgctgtcaggtaacattgatggcagatacaacggtcctgaactaattgttccggaccgttgctgcatttcgtgacaaaaacctgcaactcattccaaaaagcttgacatattgcttttattctagtaaaattcaaattagggtaagacaaaagcgaggcggtagtttatggatcttgttgtatcgggtatacttaattttttgaccgagcaggaagctatcggcaaagcagatgaggtacaggatttttatcggtatggcatagaaataactatctcatcaatgttaaacattgtgcttgtattgcttatgggagcattgacagggcatttgctggaaagcgtaatatatttggcagtgtttattgctgtcagggttattaccggagggtatcatgcagatacatatttcagatgcaatctgctgatgtgttcaacatttattgctacagcttttcttaatgacaaggtatgcggatatataaatatatgggtgatagctgcctttgtggtgtttgaagagataatagcttttgtattctgccctgtggagaacaaaaataagcctatagaaaaagataaaaagccaaagttcaaagcgatgggaatgatagtttttctgttgcttgatctgtttggcggggcgattatcaatagatatcagatggttggatctatgatcctgttaacaaatctattaattgcagttttaataatatcagcgaagatcaaagaaaagaggtgtgataagaatgaaatcatttaagaaattgcttgctagccttattgccagagcgactaagagaatgggtatagctgcctgcggatgtgcatcaatgtatggtggctatcaaactaaagagccaaaaaacatttacaagaattaagcgtaaagctacaagaattacgataagcattacaaagactttatcatttcccctttaaatcttgtgatacttgtaaatgaggtaacattagcaggaaaataacttcctgctggtgttaccatttttttatttgtagtgagttcaagtttatgacagtgagtaaatttgcttttaggcataaaaaaatacgccctacaaaaggatgcgctgtactattcggttttcaaagaacgggcggaggctatagagaaagccccctcactttccatgccgaaaagttgagggggctacaaccaagttttttaattttctaaaagatttttgagctttgctctgatttttgtcgaaggcataaagaaagagcgcccagcaaggtttttacttgctgagcgctcttgaaactgtgccggagattgccgtccccgttcggctggggatacatggtcagaatgtgggtgtcgcttgcctcctttcggaaagggacttgctgccaagcccactttcaggaaaataggcggtggcggaatgatccgtcaccgcctattgtgtttaggctatttcgatttcggaagcgtcggcttatttaaccttggattcctttctctttttgccgcttacgcccagcagagtcagaacaccgccgctgacgtacagagcagccagccaaccgatgtggttgctgctgtcaccggtctgaggacacttggtggagttgtcatttcctggcttatcggtgttattatcactgctgcctgtattgtcggtgttgccgccgtcggggagcttgtcgatgaccgtattctcgctgcgcttggcaccgcaaatgttgcattcctcgtgcttgatgccggttgcctccttggtagcggccttgtcgatctcccactggaagctgtgtggtgccgtgtcggccttgtcgccgcactcgcactcatgccagtggttggtgccgtcatacttccactctgtaccgtagctgtgggtatgattgctgcctgttgcagggatcggtgcggtttcaagaaccttcttgcagacggtgcattccttatgcttagcgccgtcggcggtttcggtagctgccgtgtcaacgatccactcgctggcactgtgagccgcaatattggccttatcgccgcactcgcactcatgccagtgatcggtgtcgtcatacttccactcggtgccgtagctgtgggtatggcttggaggcgcatccttataggtggcctcgagcttcacatcattgccgggcatggtgaaggtggtagttgccttggtggcgtctgccagagtgacattgccctctagcacgacccacttgtcaaagaccttgcctacctctggtgcgtccgccgtaacggtcacaacggtgttctgcgcgatcttgtctgtgatgagtgtacctgcggcaagggatgccgtgcccttgatgaccgtgacaatgtatccggtcgcagcggagttctttacgaaccttgtctcgccgcagtcggcgcgctggcaggtgtagagaattccttcgctcttgccctgttttgcgggtttgccgccgtcccagtcgtggctgagcttattaacgacatgaccgtagcggataatctgtccacagccggctgtacactgctggtcgccgctatagcctgaggtggtgcatcctggcttaacctcattgatcagcttgtagttatcggcaatttcgtggagggacggggttgagacgcccttatgcgcgatcctgtcgcacgatgtgcagtactggctgccggaatagcccctctctgtacaggtcgccgttcttacatcccgcagttcaaggggaccgctatgcctgaagtcgccggtctcgccctttacggtgccgccgcaagccgtgcagcggtagtcgccctcataggcgcggtgtcggcagtcgcccgatttggcgttatagcgtttgccgccatggctcgcgtctgtggttgccgagttggccgtgccgtagtagtacagcggctgcagtggaccggtatgaccggcgtttgcaggtgggtagatatccgaaccggcactgatgacatggccgcagtctgcgcaggcggtgtcgccggtgtagcccttacggtcgcagatctgctccttcgcattgagcaccgtggtgccgccgctgtggtcacagcctgcatagacaggctcaaagaagaaactgccgccgccaggggcacccatggtgctgaactctgggatcgtgcagccccactcaagggcggagccgttggtcaccagcttgaacagggtcttcgcctcattggtattccaatttctagtaacaggtatgatgtcatactcattgtattcgcggcgatactccaccttccagccgatggctttctgaccggttctctcctcgggataaagcctgatcttgtcgcctggcttgacgatcatacgggttgcccgaccgtttttcaccgtcacaagagcggtgtcctttgtccactgatcggctcctccgtcatcatccttgtcgatttttgtctttgtgtactcgcaaatgctgcattcagcctccatgccgcctctgccaccctcggtatcggggtttttgaccacattccagcggccccagctatggggaaccatgatgaattcctcgcagccgggaaccttgcacttttcggggtgggcatagtcggattcgatgatgagttcctccaccgtcttggtcgagccgccgatgttgaaggtatactcatagatactgccgaagccggtgcagtcccagttccagccgtaatcatggacatggctcttcacaggaacggtatagtcgcagacggaacatctgagcacatcgactctgccgccgcctaccgcgtcaaggcttctgtcaaacacaaaggtatgcgggaatatgcgctccttggagccggtagtcatataatgcgcttcgtattcgcctgcttcaaacaggcacgggagcttgtgaccgtcgcacttcgggtcgccgcccacgacaccgttatgggtattcccatgcttatcgacccaagtgaccttgtattccggcgttttctcgctgtcttctgtgaagcacttataagtacacccactcttaaatcaggcaatagaccatattcgatgaatataaaataacgcaacatgaggctatgtctccgaaactattaatggaggcatagctattttttctcttgaaataatctctccgatgtggtataatgataactgatacataaagcatgaccaattgtgaggtgattgctatgaatattgctatcgttgatgatgaacctgtattcttaaaacaatttcataacagattaagagaaatgaaactccccgactgcgaaatacacgaatttacaagcgggagagacttattgagtttctatgtcaagggaatgtatgaagtcatcatactcgatgttgaaatgcccgatctgaccggattgcagaccgctgaaagaatcagacagatagatggttcagttattatttctttcctgacgaattatgccgaatttgccgttaagggctacgatgtgggagcgtttcgctatatattgaaaaatcagccagactatgtatataccaaacagctaaattctatcattgctgagtgccagcagcgatttagaactttcactttcaataataaaaatctgtcattcaagttcaggctgacagatattctttactttgagggacatagaagaaaggtatcactattcacagttaatggtgaattggagtacggcggcgatttttcaactgtgtgtggcgagttgttaaagtacaatttcgctattataaaccgtggaatacttgtaaatcttgaccatatacagaatattaccaagtacgatattattctaagcaacggcagaaaaatccccataggcaaaacatataaagatgagatagttgctcgctatcttaactatgcaacagggagatgatcgagttgcccgtattgattgaaaatatcattgagattgtcaatgtagcaattgaaatgatgttggtattcttatacttttccttgttgagtaaggcaaaagttaataaagcagttctttatctgtcgtatcttctttctactgtaatactgtcagcgacagttttgttgacagataatattttagtgtatctgattacaaccattattcttattagctccatgtcctttatttgttatgatgattcaatccgtcataaaatattttggaacatattgtttttactgattatatctatatctgaacctattgtgattggattactttgcattgctaatatgggaacaccagatgaattcttagagtctggtttaggacgttatctcggaatggtaggcacaaatataatttatttatggcttataggattgatgcaccgcataataaacaaaaaaattcgtgaactgccgataaaatattggatattgataatagttattccaatcataagtatttttcttttacaaacaatgcttgatggatttgttggcagcaacacttatagttatgtttctttgggcgtttctcttgcaggaattatctttataaaccttgctatgtttaatttctttgaaagttttgaagataagataaagttaaaataccttgaaacaataaagcaacaggaacaggaaaactataagctgcttaccctgtcatacaagcaagtacgagagtttaaacacgatattgaaaatcaatttttagttctgaatgatatgttggaaaacaatgatactgattctgctaaggaatatcttgtcaagctaagctcatttgtaaggcttgctaacagactctgctatactggtaataatgccgtcgattctattgtgaacatcaagggttctcttgctcagacatacggtatagagtttatttgcaaggtcaatatcataacaaatatcaaggcagacgaattggagttgtgccgtatcatcggaaacgctcttgacaatgcaatagaaggttgccagagagctggtgtatcacataagcatatttggataagcctaatggaagaacgagagaagctatttattgtcattacaaatacatcagataaggtagatacatctgttttaacatcaacaaagaaagaacaagggcttcacggcatagggataaacagtatcaaatcctccgttgatagattgggtgggttagtaagtttcgattatgatgacggaatttttaagctgaacattatggttcgtaattgtttacaaatttaactatttgcatttcgggacaagaagacgacatttggggacactttgagaccttttttctcaaaacctattgaaaaaatttgcaacttgtgttatgatttttgcaggaagtgattcagaaatgatttcaaaacttgcaaaaagcatagcacacttttttgtggttcagaacataacggaagaatccaaagaggtgatctacgcatatggaatggagctgctgatctctgatgtgctgaataccattatcgtcctgctgattgctctgttttcccatacgctgcctgcggttgttgtattcatagccgtatttatggggttgagacagtttgtaggtgggtttcacgctaacagtcatcttagttgtatgttcacgcttgtcatggtgatgatggttttctcttacggcatttgcaatgtaagcggacatattacgccaatattcagcatcagtttcataatgatagcattaccaatcattctatgtattgctcccgttccgcatccgaataaaccgatgtcagaggaaaagagtgtcaagctaaggaaaagaagctgcatcttagctgttaccctatccgttgtcacgattgcactgcttgtattccaatatcaaaaactaagcctttatgtatcaagcggaatgctgctgtcagcaatcatggcactgctcggtcactttttgaatcggggtgataacagtaaacgatgataaggaaagagaaaaacggagtattttggcgattgtaattcttgctcttgtaaggctggtgctgtatatctcaaatggcagcgtttgcggtattacgttttatcaaccgaaagagcctgacttatctgaactgtttgaaaggagggatttgtaatgaaaaagctgatgagcatagcaaagaaggcttctacggcactggcggctcttgcgctggtggtagctaccacatcagttccgagtgcttgcttccattggttcgcacaacctgtagagccagaagagctgagaaactatgtaaacaagaaataattggcaactgtgtgttgcagaaatgtggtatgaaatggttaagaataagattttgaaacgtatcgtggcaggtcttagctgtattgcgttatctacaactatgcttacgagtttacctgcttttgccgatgattatgttgacgaatatcaatattactcaacgttagatcctaatggtgaagagtaccaagaatggaaatcaaatctggcaagttctgctgtaagtgttccccaaaatagaatgcttaaaagtattctcaaaaataatactttaatagcaaatgactacattgagttcaacactgcaagtaatggtcactatactattggtacaataggaggaaaccctaacagttcaactgatgataataaaaagatgcttttcggtcatccgggtggaggaacatcaaaaacaacaattgttgttggtgaaagcataaatgagtttacatcatcaaatgtaacttatgatgctgatggttctaaaagtgtttccaaagcttcttatgatggtgttgatgtcacacaagaactatctattattgagaattcggcgactggacgagatgatgttgttaagattaagtatatcgtcaaaaatgatacagaatacgccaaacaagtgggcataagaattatgatggacactatgctcggtggtaatgatgctgcgccattcagagtaaacggatctgatgtaacaactgaaaccgtatattcaggttctaatattccgcaaatatggcaagcctttgattccgcaactaatcccggtgtagtagcacaaggtacattctacaaatcgggagacagaaaacctgataaagtacaatttactaattggggaaatgtaacaagtacgctatgggattatgtgactcagccaggacgatctaatggagatagtgcagtatccatcacatggaacaaagatactttcaccagtggtgaaacacgagaatttgttacctattatggattgagtgagttagaacagaatttaattcctccgttagcattaagtgtatacgctgataataaggttagtatttccaattttaattatgatgatataaatgcaaatgtatatttggataatattggagatggcgatgcgacagatgtatcgataaaaatcactgctgataaccttgaaccaaagtatggaacctcacttacacacaattattcggtaataaagccaagtaaaagctattcaattcctttgaaatttatagttccaacagattcaaaacataattctgatataaatgcaaaattggattttgaattatcatacaaagttgccaagaccggtgatacagaagtaaagcgaataaccaaaaacataacaattcctaaattgaaaagagccgttgtagtagtaccgggaataatgggaatagatcttgcaaaaacatcaaatgatgaaagtgtatggggatcttggattgaacagccaagtaactttgatgatgttaaaaaaattcacaatgcgttccagtcgctcaaatgcgattactacggtaatagtaatattgaattatatcctgttaataattatggatatgatgatacttataaaggaataattgaatcactaaataatgatactgatatttctgataagtatgatatcttatttttcccgtatgattggagaatgggagcgcaaataacggctaataatcttcatgatcttattagtgattataatgaggtagtttttgttgcacatagtatgggtggtattgttacagaaaaatacatttcggaatatggtgctgataatatttctaaacaaataactgccggaacaccattttggggtgcgccaacgatgctttgcgttttaagcactggtgatttatcatatatcataggaggactcggggtagcagaatcattatttacttcatttgaacttccaagtgttttggtgaatttaggcagttgttatgatttgttgccaaataaagattatacagatgactggcagtggatatattcatataaacgaacttatgatcattggtatgattattttatagataacggcaattttacgtattttacatttgacgaatttgatgagctgatttctgatgattataataattatctttggatagatggaaaatataaccatagccgcataaaaatatcccaaaacaatactaataatctgaaaagaatagcattagtaggaagtaatagaaataccatttcaactattcaacattgtcctggcgatagaggattgcaattcgttccagaatatggtattggcgatagtgtagttccaattgaaagtgcaacaatgaattttaatcacgatcttttggatataaaaatctttgatcaagatcatatggggttaatacagagtcaggaatgcatagatgagatattaaaaaacataaaagatacaaaatcatttatgaagctgcccatgagaacaaaaatggcaaataacaatcttacatctaatgccatagaagaaaccaagacactttcaaataagcttgctatttcaggttattttgatttattcttttcaaacgaaacctgttcatattattacacaaattcagaggttcatgaagggaataattttaaatttgaccctttaacatcagttggcaatccgattttactggctcaatttgctgatgataattatgattgtaaaatcaattcacttgctgatcaaaacactgatattatgtgcaatattgatggaaacatctatttgtataccaatatctctgtgaatagtggatctgtattattcttaaatttatcagatggttcattttttattaacattgatcttgataatgatggtgaaatagatacaactgttacgccaactatcaatccaggggtaattcaagatgatgagaaatcacctgaaataacagtagaatcttgcaatgcaggtattagtaactcaaatactataaatcccaatatagttataactaacaactctgacaagcctttaaaaatgagtgatataactataaattatgtatttaatgcagacaataaagaaaaccttgaataccattgcgactggcttgctgtagataatcaatacttaggtaatacttcggtttgtgaatttgttaatgacgattacggaaatacatatgcaaaaatcaaatttaataccgatgttgaacttcaacctaataaacagtttgtaatccattttagactaaatgcagcagattggtctaattgggatacatcgaatgattattcaatgggaacagaacagctattgccaaatgataaaataattgttttttataatgaacagcttataagcggtgtccagccttgaagtagaggttgaagcaatgaaaaaaacaattataattataattatatcattattagttacggcaggcacttttgttttatctaagtatcacaacagagataaaatgatgactcaaatgaataaagatatacaagattattattatataagctgtccaaatggaaatgagcttgacatcaagcaaaagagcagtaatgaatatcaatactctattcttagttatccttttagcacaacagaatacactaacaaatttacattcagattaaaagtgagtcttgatcagaaattcatatttgaaaaaatcggcttattgacaggcacaagcggagtaaacgcaaatacagactttcctaattgtcttattaaagaaaatgattcttctcaatatcaacgtttttttctccccacgccagaagaagataatgatgtttcaacaatccttggcgaaggcaaaatatatgtatcattcaagaatgcaatcaattcatcagatatatcatctgtaatagatgaatatagtgaatacggaacagtgacatggctttgggtcgatacttacaatgattctgattcaacactaccaacgattcaaaatcctcaaaatgacgaaagaggagtgtatggtatcccgttgttctatgctggcgaaaagctcatttcaccattagataagtttgttaatataataaatgataaacacgcttatttggaagacgaatttgaaaacataagaaacggtattaatacaggtaaagatactattaagcaatctgatattaatattataggtattgttttattgtcccaaaaagatttgaaccgtagtgccataataaacgaaatcgccataaagggaaatgtctatgtagttaactaaactataaatttattgttatcttgttttattgccaaatactatatttttcgttccacacaagtctgaataggcattgtggggcacaccacaacaggcacaaactctattggaactgaataaccgcaagccctcggaaatgctcttgtaagcgtttctgagggctttttcttttcagcggttagaattccgctccgcaggctcggatagtgatgtgtggcatttccgttcgcctgacggtcaagctgaggtcggctcggtgatgccgtgacggagttcatactcacgcacacggcggtagaaagtatttgctgacatattcattctccgcataaagtccctgcccgtgatgtgcttggctctccattccccatagagctgaccgaacctcgtccagtcggtggggataggctttcgcccggtgtacttgccctgagccttagcgatctcgatgccctcacgctgtcgctgtttgagctgctcacgctccaactgtgagagtgcagcgaacacggtgagcataaatttgcccgcaggagtgtcggtgtcaattttctccttgtggctgatgagcgttactcccttgtctgtgagggtgtcgatgatgttcagcaagtcctttgtggagcgtcccagacggctgatactctcgatgtagagggtgtcaccctcacgcacatagtcaagcattgccctgagctgagggcggtcggtgttcgctcctgacagcttctcggagaagatgcggtcaacctgataactgcacatgatctcctgctgtctcgctgtttcctgatgctccgtagaaacacggatataacctattttgctcatagttgttgtttcctttctttattcaagtgtatttttatttctatgtttagcctgtgtcctctgacggcttttctcacgctcacgcttcatctgctgttcgttgatgtactggcgcacctgtcgggtgtacttcttcgccgtttcacgcttggtgaggaatgcggtatgctcgacattaagcctgttccacttcgatttcagcttgttggacttctccaaaaggtcaagcatcgtcggcggtttgccgtcaacagcatacttcttgatatgctccttgatgtacttgaccgtctgctcgtagtcctcgatagtggcggcatttttcttcttgaaacggctctgcgaccagcccgatttgccctgatactccttgtaaacaggctccagctcgtcacggtgcttcatctttgcaatgagcgtgtcgatagctgtaaacttctttttcagatcggcacgctcagttgtgtggtcatcggagtgaggtgtattgaagaagaatccagacagctcgctgaatgacataacgccaccagcttcaaggtctgcgatgatttcgtttgctctgcccatacctctgatagctttccacggatcttctttcttttcaggtgctttactctccgtaggtgtgggctgtggtgtccgggcagacggttcaggcttcggattgatagcagttgcgttaagcatatcaagctgtgcctgccgtcttgctcgtcgggctgcaaagaacttctccacctgttccgcagcagcttttctctttgcggtttcacttgtttcggtgatagtttcaggctcggcagattgtttcggctttgtcggtgcggtgactgtctgtgtcggcttcggctcggtctttggaacaacaggcttcggcgcttcgataagcatatcgggagtgacattcgccgctgacagcttttcctgtatctccgctatctgctcggctatgcgttcgggggtgaagtctgcgcccagggtgtcggctcttgtaaacttctgttgaccgtcacctgataaacggaatttcagcttgaccttattgcttggcttgtaaacatattcgatactgcactccgaacatttttcaagaaaatccttgaagtcacggctgtaaagcatgacctccgcaatcctgacacggagcttatctttccacgacttgccctctttctgcatattcctctcaaagtgagataccccatgtcccttttcaggctcggagataacagatataccgtgttcagcacatatctcgtccgaaatctcacgcaactctgcccacgctctttcagactttctgccttgattatgctcggtggtaaagctcagaccgttatacagatttgtgttgttgaaaatgatgtggcaatgcaggtgcgacttgtcatgatgaacagcaatgacatactgataatcgcctttcagataacggtcgcacagctcctctccgatctgcatagcttgttcgggcgtgacttcaccgggggcaaagctctgtatcatgtggtaggcaaggatttgggtgcgtcctgttcctgtgtttcggacggctcggaagtcctcgcttgctcctgcgctatcggctcggcaagcataagagttgacatataaaccgtcgatggtcttatcatctcttgtgatgtaagcgatcgctgcgctgactgttgccctgatcgtatggatagaagtgtatgccaaatttcgtttacccctttctttatctcggtaatatcctcggcatagatgtgacctgtgctgtaaagtcggacaagtatctggttgatgtttgctccgatgcgtttcatcagacggttacactcggcaatttcggaacggtcgggcgtgagatcaaccctcgcccgaacacaatcacggatatactcggtcttgttcttgtaaccgtactgctcacacttggaaagaatgtcctgcatttccgattcggtgaaacgaacattgagggtgtaggacttcttctccttcttgcgtttcaggtacttgcgttcatcgtcggtaagctggctctcgtccttgtcggcaaggcacttgtcaaggtcggctctgacctctttgtcaagtgcgtgattgattgctccctcgtaggtcataccctcaaactccatagccttgtgtttgggcggtcttccacgcttctttttctcggttttcatagtggtgtctcctttgtttgtatttcggcgttagccgattttcttgaccgctgtgcggtcgtttcggggcttggggtgtccctaacaagcatttggtattttcgctcgctgtgcggcgcaaaatacaatgcttgttatttttgttgcgctgtagcgctattttccagcctgtgggattttcatatcactcaggctttcgatgctccgtcagcgaatttggagctatgcgacttaaactctccgccgcttaggtcggcggtcatactcgctcacgctcctgcgtgatgcactcaatatcatcactcttgaaattgtaaactggctcagcgcagttattgcgcagtctgggcggcagtcctatgaaatatgctcccataagttaataccaaattattgaccgcttcgttaagtataccgcagaaaaattttatgatgaaaatgatatgcaggggtgcgtgtgatcgtcacaacgtcaaagcccttcacttttctaccggtgtttttgagaaaatggcgttgtttttcagaaaagtttacactttgttcatgacggttctcccttgtgcctaaattcaacagcatatttctatacagaatgtgaataggtcacggcggcactcggataaaaccccctctatatatacaagcacgttcaatcaggaaacgggcatgatttttataaaaatagttgctccgtgataataattctccgtattgaataaatcagaaatggtgacctatgcagtatgcagtcaatgtgatatggctcggatttgcaatgctcggtctgctttctgcaaaattccccataacaatttcacgaatgaagaagttttatggcgcactcaacttcttgcgcaatgcgaatagacttttgctgtccgagaatgctataatattagcatagggtattatccctaaatccaatacattgggaggtgatgagaatgagtaagaaagctaagaccgaggttgatgagaagtccgctgttatcattacggatgctgttcttgcggagaatcaggcaaagctcgacagctacgaaaagtctatcaaagctgtgcaggagcgcaggcgcaaggtcatcattgatagcaagctctacacctacgataagctctcacagctttacggcggtgcggagggacaggcacttctcgatgctgtgactgcggagcatacgctgatcggcaagctgacagcaagcggtatgacctatgagcagattggtgagctggctgacgatagttctgccgatgctgacaacagctcggacgaaagctattccgaaaagtacgctaagcagatgagcttttcagaaacagatcattcctattcggagtaacatatattccgacaacaaaacgattgctgtgtaagggacggctctgccgttccgtacagcacctgtgcaggcgtaacgcccctgcaacaaaaagccattgcgtgtagagatagataatcgcaggcggaaaggagacacttgccaagaaaagatacaggatttactttggctgagctgaatgagagatataaagataagccgaccagcaaagccgtgtacgaagtggacggtcagcgttatgctgtgacaagtcatttcgtgggtgaaaaagaccttgataaggtgctttatgaacttgctttcaaaagagcgtttcagaaaaccgaaaagaactaaaaagttttgaaaaaagacttgccatattcggttttctgcgctataatagttgtatcatcgaatatggtttgctttgattggaaaggagttattatggcaaagcaaactacttacaatgtcgggatctatgtgcgtttgtcgcaggaggacgaacgtgcgggcgaatccctttcgattgaaaatcagaagaagatgctgacggaatatgtcagcaagcaggaggggtggaatcttatcgagatatgcgaggacgatggctattcgggaacaagtttcgatagaccaggtatcaagcagattcttgatgatgcaaagtcgggaaagataaatcttatcctctgtaaagacctttcacgtttcggaagaaattatatcgaggtcggtcagtatatagattacatttttccttcattcaatatccgcttcatcgccctgagcgacaatgtagacacgcttgacagaaacagttcggcaatggatcttatgcctgtgatgaatttattcaacgaatggcacgccgccaacacgtcaaagaaggtacgcagtgtcatggcagcaaattctcggcagggcaagtatctggcggcttcagcttcttatggttacatcaaggcagatgatgaaaagcatacgcccttgattgatgaagatgccgccgttatcgtaagacgtatatttgagcagagggcaagagggttaagtccgaagcagatcgctatacagcttaacaaggacggcatcgcaactccctcggatcatcgttatcagcttaaaggcaaagataatccccttgtgacttcacatctgtggaatgattgtatggtgcgtggcattcttaacaatgagatttatatcggaaatctcgcacagcagagagtgacaacggtatcctacaaaaatcacaagcagatacgcaaggacaggtcggaatggatagtgattgaaaataatcatgaacctatcatttcaagagagctgtgggacaaggttagagaggttgacgcatcggtgagtatcggcaagacaacaaaagaaggcgtgattcttccgctgtcaggatttatgtactgcccagactgcggttacaagatgaaaatgaacagaaccatgcacacctctaagaagcgtggaacatatgagactgtcagctatcgctgtggtacttatgttagaagcggaatggacggctgcactcctcattccattttggaaagagtaatttcacagattgttgttgacgatattagagcaaaggcacgacttgccgttgaggacgaggacgcactccgtgaagccgttagaaaacgcagacaggctactgccgatgcggagagccagcataacagcaaggaactccatgagggtgagaaaaggcttgcacagctcgaaacgcttatcagtaagacctatgaagaaaagctcctcggtactgtacccgaagaactctgcgtgaaaatgctgaatcagtatcttgatgagcagaagatgctgagagagaaagtcgctgtactgaaagaaaagtgcgaaaccgctgaacaggctgaaaaggatattgacagatacattgaaaatatcaagaagtatgtcgatattcaggagcttacccgtgagacttgtttggagcttatcgagtacatcgtgattggtgatcgtcccgaaagcaaggacgaggacaggcagattcacatcttttacaagttccttgacaaagggcttacggagaaaagaaacattctgcttccgcagaatgtggagtaaataatatttgggtgtacttttatggggttctcctccgtgggcacaggcacacccgcctgcttatggctgtaggcatgggtggcagtcagctttgcctccgccgttttcatggtgtccgaagggtcgccctttctgccgatgacgcagtagtaggagtagtcatccatgcaggcctcggcggaaaccgacagcctcagcgttggggtgttcacgtccacatagtaatctttctccggcagcttgtagggcgccgccgtgggattcgcattattcttctgataccactgataggtcagctcgtcgcctttcaggctctttgccgagacagagaaggtgacccagttatgttcgctgtacaacaggtcgttttccggctcttcgtcataatcgccgctgctgtagatagaggtcttacacttgacgcccctcggctggcggttgatgacgatggaactgccgctgatgtagtcgcagaccttgcacacgcccttggcgtcaaattcatggttggcggcattcagctttttatcgtcacaatagcggcaggggtgccagtgctgcgttccgtcagccgcccagctggcggaggctatgtgggtatgtccggcgccggaatgctccgtcttcaaatgatcctcaaaatcagagtcgctgaagcaccagtcgtcatgatcgcagcccatagcgcttacggcatctcggcagcagtccttgcagcgctgatcgcagccgtcctcgcagggatcgctgtcgtggaagcacaggccgcagtcctcgcagaagtgatccgcatagtcagtgtccattgcgcacattccctcggagcagtcggagttgccctcgcagcactccttgcacatctcgcaggtttcgcagaactcgtcctcgtcctccttatccgtgacccagccgtcgcagccctgacagatgtgctcgtcccactcggcgctttccacgcaggtctcgccgtccgggcagccgccgccctcggagttatctcggcagcactccaggcacaggccgcagtcctcgcaggactcctggttcagcaggcattcctcacactgctcgcaggccgtgtggcaatcgatgcagtggatgacgccggtatcatcgtcgtccacgcactcgtccaccgaaccgaagcagctgttgcaaagcgagcagtgcatcgggtcgctgtcatcgtttgcgcagtcatcgcagaagccgcaggagtcgcagatggttatggagcagcatggacccttatggcattcgccgcacagctggtcatcctcgccgatgtagcatttgccgcaggtcgagcagtgcgtgtcctccatgcagtcggcgcatttgtagcattgatcgcaccaattgggtgtattgaacagacactcaccacaatcgttgcagtggaattcagcgaagcagtcggagttgcagtcaacagtgcagaacccacaaccgtcgcacatattctcgccccagtgatagtggtcgcagtagatacaatctgtgccgtcatcgtagtcttcccaaaaggcatgggtatggagctcctgactcggcatcagtgagaacagcatcacaagcgccaacaggacgctggcgacgcgccttcgtttgttcgtttttgtcatactattattcctccctcataattattttgaagatttttatgctttttgtgttgcctgatttaaacactgtcgatgaccgaagcaaagtagttttcggataccgaaccgaagagaaaagcgtctatcagaccctcgcgctttgcctgccgtaccttttcggtcaaatcttcatctgtatcatcatccacaaagagaatgacacgacagctttccgtgttccgttttaccttgtcacggattgccattcgttctttgaacatccatggcgaatacgccttgacctccattaaaagcacatccggtcgatgcgttttgcaccactcggcggttgcgtccggcgactcggaaatcacaacttggcaatcgtccaatttttgcatcagcattcgctccatggtgtgcgcatggatatcgctttgaatgtccagaacgatttttttcatcattcatcaccaccttctaaaagcacaatcctaatcttacattatctattatactgattttttggcgtttgtcactggcacttgtgccagtaacagaagaaaaatctcgattttttcaaagatttttgccttttgggcgcgaaaaaccccttgaccgtacagccaaggggttcagttttgcttatttgtcttttaaggtgactaccatgagcttgttttcaatggcggttgcaaccagcgcttctctgctttcaaagccgctcttttccaccatatcgtccaggttccagcgaacgccgtttttggagatgcccagcttatcggcaatttcctgataggtaaagccctttatataaaggcgtaggatgtctaactgccggggcgagaagacatcggacatcgtaccctccatttcaatggctggagcggtatctgggaataccttttcgcctgccagagtgcgctttaccacgcttatcagctcctctgttccgtggtccttataccacaggctgtcggcagcacccatttttgctctttgcaaaacttcgggatcgacaagcgaggtagccacaacgattttgatttgcggaaaaacctttttgatgcgctctgcggctgcaagaccggaatgcttatgatgcgtctgcacatccataaggacgagctttacggtggcgtcgcagtgcttttccgcttcaaaggcgtcacggaaaacgccgacaagatgaaactcgccgtctgccgcaagacgatcgacaaagtgcttttggatgtatagatcatcctctacaagtatggtgtttatcataggctgaactcctttgcgggaatcgtaatcagaagagcaaagcgtggattgtgcgaaatatgcatttcaccgccggagctttcaatactgcggcgaagcgttgacaggccgctgccttcctttatcggctctgtgggtattttgccgttgttggttatggtaacatcatagcgttcgccacgctgggcaatgaggatatatacctcattcccgtctgcgtgcttgatgcagttggtcacgcactccttggcggcagcaacggtcagctcctcggctacggtatcacggggcaggtagccgtcgatttttacagccacgccaagctgctgtgcggttctttttacctcgtccattgtgctgacagaggttacacggttgcttgccagcataccgatggcattttgcagcgcctcaagctttcgctcggtatcctctccgctgtctatgatgtcacggatggtcaggaggcttcgcccgatggtatcgtgaatatagacctttaggtcaaggctttctttctctttgacatcgttctccatgcgagcgtacatcttcctgagctttcgattgacttctgccagttcttcatttatttcctcttgcttttggcagccgttatacagctcggttacattgtgcgccgttatctgctgccagcggtcatcgctgtccacggtgatattttgtgtgcgaaactgccagacggtcttgtcgggcaggatgtagcaatcattcttgacggtcacggatctgtccggcgcgctcagggcattttccatatcgcttttgatttgcagctcgtggccgcaaagggcaaatgagagcctgcgcatacggttgttgcacaggatgatcctgccgttcgggtcggcaaagcagatgcccataggcagcttatcggttgcttccttaatggagaacggcgagagctcgttctttttacggcggtattcccgcggcagagcaatggcaaagtgaactgccgcaaggaaaatggcagcggcaaatatcagccacggtgcgtccagcagaaatgcgtccccgatattatcgggatctgcctgagaaacggagaatagcagcgggatcatcaccgccataactgccagactcagcaggctgcgcaccggcttattgctgcgaagaagctgatacataaacagcccgatctcaaggacgatctccacaagcatgataaacggcagcatggtctgccaaaattcagaaagggaagaaaatgcactcatttcctgtcaccttctttcgcttcaaatacaaggtgctggtattcctcgtcatcctctttttcacagcggatactgtctccgcttaccaaagcggaaaggtcggctttgcagcacacattcagtgacaagcgcaagccgtttgcctttatgaggcttacctgtatgcctgttaaattcaaaatgtcggcttcaataaccgattcataaaaatcaaatacagcagtcgccgttttgccggagagcatggaaagagactcgtccacatagagcgagctgcggacgcccaacagcttcagcgtttggagggactcattgaaggcacggtggagttccgtttccgctattttaatatctcggtcggtaaggagcgtcagatgcttgcgacgtttaatatagctgcacagcacggcgatctcggcaaggagcgttttggcactgtcgggatcggtgcttgagattcggcggtattccttagtgagctctgcaatgcggtcgatctgcgtctgcgtagcggaacgcaggagatcatacaggcggttttgctcctccaccttgcggcgcttggcttcacgcttgtattcataacggagcatttcgttcctgtcggcaagctcgtctgcaagaagctcggagtcctccttgatgtcacgcaaagccgacacatcctctgtccatacggcatagccgccatcaatgggcatggtgtgaacggtcaagccgcccatcgtgaccgggctttgctcggcttttttcatcgcttcctttgagataggcgcagtgtttacagctgcataccgaacggtaaagtccttgtcggtgatctctgccgatgtgccgacagaggaggcaaacaagtccacataacggctgtttgaatgtatatatccacaggcgatgcaaagctcaaaggtcagaatatacatcacactttggaatgcggcaatatcgccgaacaagtggagcagccaatccgcacccgcatagtaaagcacgctgtaaacgatcgtcagcagcataggaacgattggcagaaagtggagccttcctttttgcacacggcatttgaaaaacataattacgagtgcggcaaaggcacacagcacctgccagcctacaataatgaagtagcctatcgagtagccgttgtttttgtctgtccacacggcggcgtccttcggaaaggtaaatacgaattggtgcaggtcatttgtgagcacgagcagaagcaatgtgccggagatgatccacagaatcgacattcctttgggaaatttgtattcgtccggctttcccaatgacatggcaatcagcagcgccagcataggcacaaacagcatgggcagatagaacagataccacaggtaacggacggcatccggctgccagaatataaaatactttgccgaacggactaccatccatatgatgagcagtaccgcggtgaccgtcataaacctgcacacctgcttttgcacgatccgctgacggacggagagcccccaggcggcgaacagaccgatatagataaagctgcgcagataggaaaacagcatcgggtagaagctgcccctgcccacaattcggaagcaatatgccagtatcacggcaagtacagcgatgctgcttgttatgatagtattctttttctgttcggtcataaacagaccccatttcgccttcattcgtgttttgtttacctttgggtagcaaaaaaggggctgtaaaaaaagtccccaagaaaaaaggctgcgatcttgccaaaaagcaagacagcagtctttttttgtggtagttcgcatcttctcatagtttaaacctcgatacagtatttcaaataataaatattccatctcatctcaccttaattggttttttccaaaaattcatctgatacgctctaattatatggaaatgataaatgagaaacttgttttactctacatcctaatgccgttagagtgcggagtaatatcaacacattttctttgtaatccttgctacattcaaaccaataatctgccccttggtccacagaagcaaaataggctattaatattccttctttaatatatttttgaggctgactaatgatagatgttgctaaaaaatccgtccaattaaccttattatcaaaataatatatcattgactcgcacgcacaatcaaaatgatttatatttattttcgcatcgcttaatctcaaaaaaatattaaatgggtcattaatgatttctgatttttctaagattacctttgtatcaactatttgagaaagatattcttccggcaatctgtaaccatgaaaaaatatcttttttcctttagaaaaatcatataaaaactcgtttaataccttggcagcagaaatattttcattaatgtccgaagtccaaaaaacaattgaatctttatctattctatattttacaaatacttcattattgcatctcataatgactaatcctcactaagaaaataatttgatatgacacgagatatactcgaatcaattattggagataaaggaacatgagctttacttccaaacaaagaaggaaaatgataatgtaaatatcttgacacgtcaaattcaattctaaatgacttagaattataacttgaaaaatttattgaaatacccttaggatttgttgtcgtataagatgttattttaccataattagcattagaagttttgccaattctaaataactcttttgcttttgaaagccagaaagaattttttaatagtgaaccaaaggctttagaaaagccatagctagcccctgcaaatgcaccagaaaaagcagcattgaaaaatacctcgcctaacgaaatatcttcacctttaattaatatatctcctaaatcgctaattagcgaggaacccaagcccgatgctgcaccaataagcatagttttgccaagtcctaaagcggcttttcctccggcagacaacccaaatcccatttctcctgaaataattcctgcaatagctcctgaaaacgctccgttttcaaagccatcccaaaacgaacctcctgtaacagcagaaataataccgccgaaaagacctactatgcctgtgccgaacaatgcgcctaatgccatagcaccaaatataccaccgacaccggtggctactaaaatcacagccgcaataactattactattgttatagcagctttccaatgctctttacaccactcgccgacttttttgcagccgtctttgaatttctaccaacggcttttttcacattcgggcttcatgtagtagtactcgtcgtaataatcgtctttgctctcaataatagtcagagtttatacagttgtattttactacaactcctaataatatctaaaatctgtgaaactttttttgttgcttggcaattttacacctccgtaagtatattggttaaagattcattaatggcatcattatttcccaatatacttccatatcggatatttcaagattttccaccacatcttttccatttaggaatagcggtactttgtaacctgcgcacttgttatgcggtaaaatataattgttatttgccttacgccacttttcataatactctgaagctaagcataccaaatgattagtgggaatttctttattgtgaaagtcataaaagttaaaatcagtatcaaaggcttcacctgttcctggctcaaacatcagtactgtatccgtctcattataaattgcaaaactccgtcctagccaatcatagccaaaaaccattatttttcccattgctggcggaaatgttttacctattatttcattccatttttctctatcttctagattatggattctgtatagcccatttaagaatgatttaccattataaacctctaaaaactctctttcgcttttaatatccaatttttcattattcttaatgaattcgttaaaattttcgtacatgaattaacactcctcaataatttattgtcgattgaccattgtaaatttccttattattgtaccgtaatcaaaatctttaatcaaatagcctatttgtttgccaagactcctatttacacttttatccaaaggctttccattaacttttacatcaggatttccgccaagttgtaaatctattgtgtgatcaatatctttgccagctggtatcgaatcttttccaaatgccttcttgtattctacagacggagaatcatttctttcaaccttagtttttacagtatcagcatccgataaagctttacattttgcatcggcttctgctcgttgctctggtgtccaatcctctttatatgatagctcagcatcatatgtaccgtcatcattttttatcaacttgcaatttgcattatgaacccaaaccccattctcaccaacatagtaagtatgatagtcctctacctgaaaattatacaccttaacaggttcttctgtcaactcaacatcaaaattttcaactaaaagaatgtttccatttacatcaagtagttcatcaccaactattagttcagaaattaatctccaattaagatctattaatcgccaatgccaaacttttctctatattccatgtttgtagcaaacaactcgtcaaatggaactattgattttgacgcagtttcaatgttaacttcttcggaccaaagaaacggatatatcaaaatggatttatcaaattccacattctttgcagattctctccaatttgtccacctcattgaactataaaattcatctatattcccctgagcgagccaggcaataaattcagagtatcttaactcaagatcttcccaatccaaagtatcaggagcaaaataccacacatcgcctatgccctcatcaaatttgcctgaattgatcgcaaatataccgcccacaacatcagtggcaacgataagcatttgtttgaccctctcaggtgtaccgtttttagacagcaaatttattttagatatgcctaccctatcagatgtatcaccgccataaagtcttatccaatcatcaaatacaactcctgatgtgttcagtatgacagcacccatagcagacgcagaagttactctaagcatatcacatattttagcactgtctgacccagcaccattaaatatcgttacctctgtctgtgacgtttcaaacatttccttgatctctaaccacaatttattattttcctgcattttcattaacctccattaatcaacaattattatttcaaatgtagccccatcggggagaccccttagtttatgcccaataaaagaacccgaacctctattatcggatcttttgattgcacgaacatgagtccctttgcctccttctttacacattgcaaaaggatactcatccaaatccttacctgaaactttgctaattgcctttagtgacgcttttatattagattttgctacacttctatttattgtaagttccctcggctgaccattttttattgcatcctcaatgtgttttgcagactctggatacttttctcttgataatgtaattttgtaatctgcgttatgtacaagtattctaaactcaccaacatgataggtatgaaaatcttctacctgaaaataatacactgtaacaggtttctctgtcaactcaatagcaaaattttcaattaaaagtatgttaccgttagaatcaaggagctcatcattaattttaagttcacctgcattgataaagcccttatcttttacatagaacgggtggtcaactgatatatattaaaattattatctaatatccgaaacaatctcagccagaaagttccaccatttgtataaatcatcaaattcacgaatataatagtttccaaggtatttcggattacacataacaatcagtttttgagcggaaagatcggacaatttattttcattttcatattcttcaagtatactgtatattctatcggcatcttttatataaccattacttaatagatagtcatgtaatttaagtaatttatctttcattttagatttacctctcaatcgcaccattgtattttccaccgtcagtaacaacttgccaaccgccaccactcctcggtataccatcatcagcaataactgcccaatcaggttgtgcagctacctttccctcaagcaaaatctgcgattttgttagttgcactgtgctttcagccatcgaagtattattcggcggcagtgccaagttattaattctttctgtaggagttacacctgcagattctcttgtaacaaatactccagatgcttctccggcatttgattccgtaatcgtaaatgtttccccttcgaaaccttctcttttataaataggtccatcaaacgaatctataagattctgagctgctcgctcatctaatcctcgttcttttaatatatcctttacttccgattgtgtaagttcagtatacttatctggttctaaggaaacgtaattctttcccgcattatgcaccaacacgcccaatgtacaaacatgataagtatggaaatcctccacctgaaaattatacactgtagtaggttcgtctgtcaactcaacatcaaaattttcaactaaaagaacattttcgtttacatcaagaagttcatcaccaactattagttctcctgctttgataaagccttgattttttacatagaacggatggtcaacagttgtaacgacttcttcgctgttcacaataaggtgtcatttagatgatagaccttcgatacaaatcatatacctcagtatcattgctttccaacaagtcttcaaaagcgtctacaccattttcgtttaaataatccagttcattgtccgagataggtattgcaaacagccagtttactatatgaccgtcaataagatggccttgcaaatcctcccagtatgacgggatagtgtaataaatatgcctcatttctaagtttttataataatcatcaataacattcatgttcaccatcccaggagtgtacgaataatgatccttgataatattgaacgcacaggacgctaatatattaggaaaacttgtgaactcactcgtgcacatacctataaattccaccctgatttctcttccttgtctatctacaatttctattggatactctgacaaaccaatagttgaatatgttgtaaggccaacatctggcctattttcaccaatgtatatatcgatcttatgactttcggtttcatcagaatatgaaataaccttcggcgttagttttacggcctcgtgaatgattttaaaaatctcttttttgttttgcatattttccatattgcacctccaaaaatttattttgttatatacatactttaaataccaactaatgcaataatagttatttaactaccaattcaagcttatgacaaataatctaaaatcatggtcctaaatattgatctgtcatatcttcacaagaatgacttctatttgaacttggaagttctgggcgatagtgggacgaatcattgtgttcatctaaaaactgttttctgtctataccacgttcctgtgcacttgctcgatgttttctaaactcataaccaggtttatgccccatatcccaaggctcattggggttaattggttttcctgttttaggatcacgaacaatttcatcaggagaattcgcctttgcttcttcccatgttttatccctaacgcctttacgataacccgatggacgtttatatgcatcccctgcattatgtacaagtatgcgaaaaccaccaacataataagtatgaaaatcctcaacttgaaaattgtatacaacagtaggttttttgtcaactcaatattactttttttcaattgacaaatgactgccatgtgtatcgagaagcttatcactaagtgtcaattcacctgcattgacaaagccacgatcattcacataaaacgggtgggtttcagttgtaacaatttcttcgccgttgatcaccaaatgaataagcttagaatcttctcatatgtatgtttcaaggactgttttttgtaataatactttcatccttttcatttaaaagctcaattatatcatctccgtcaatgactactatatagtcatacggcaacataagcgcctttaagacggagggacgtatatttaataattgataagcataaattgattcgtattccgtagtatcaacgtttgagaatttaccatctttattttgaaatatctcattcacacaccaacctgagccacctaaatctctaaatctttgtaaacaaattttgggtttaactatagaacctttagcaacagcaattttatcatcaaatctaatagtttcaccattaatatgatatttttgtaacatatccaactgttccatttgaatccaaaaagcaagtgttaaatcctcagtaacttttaagaatggtgttggctcataatcaggtgtaactatacaataaccactgattgccttttgcaaaatatataaggaaaaaccaatttgaattttaaatccgtcttttaatctaccaacaggaatatcagatattgctctccataatgcttgtgattgaaagtaaagcatatcatcaactttaattgtatactttattccgttaatctctttggtataagtattcatttctttctaacctttcacttattgcttttgcaatagctgcacgagcagcttcatctttttgatttaaaaactgttgtgcttcttcggagattgctcctaactttgaatgtcccgaccaagcactgatagatttagcacctttagatgcatttgttttccaagtcccataaagttttcttctaaatttgcaattgctttctggtcttcaaaactcaactgatcaaatcctgactgttcagttatttcttttagaggcataatatgatcagcttccagcgtatcaacttcgtatccatatatcgggtcagttttttttgccatctactgaattaacagcttttttcgctttggcatctggtgaaacttttcgcagtctactataagtatcatctgcattatgcaccaacacaccaaaaccaccaacaagataagtatgaaaatcttctacctgaaaataatacacctttacgggtttatctgtcaactcaacatcaaaattttcaactaaaagaatgtttccgtttacatcaagaagttcatcaccaactattagttctcctgctttgataaagccttgattttttacaaagaacgggtgggtttcagtcgttatgatctcttcgctgttgatcaccaaatgaataagcttagaatcttctcatatataggttcaaaacgtaagttagaaaatagataagtgtatactctttttcctgttaaagttgtgtcttcaatcctaaagtaattaccatctgtatcatatgctacttattttccagttttaggattattatatatctccttgccgctaaaagctgtgaaactttttcttggttgcttggcatttttacacctccgtaagtatattggttaaagattcattaatggcatcattatttcccaatatacttccatatcgcatatatcaaggttacccagttcgtctttaccacctaaaaacagaggcactttataactaacacaatccttataggccagaggtttgtagtcatttgctttataccaatattcaaacaagtccgacacaagacactcaataggattttgggaaatgagttcatcatggaattttattatatcggcatcggtatcataaacatcacctgtaccaggttcaaaaagtatcaccatattcgttttcttttccaaagcaaatatacgacccatccaatcataacttaaaactgaaaaagtatctttatatttaggaaaacagtcaccaacaatatcattccactcatcaatatcatttttttcaaagaatctgtacattccgtttaaataacttttaccagagacagcattgataaagtctttaattgaacggcaactcttgttttcatcaacaaatttaaaaaaatttttaaacattcccttttatcgcctcatcacattctgaacatcgattgattatttgccatatttctctttaatttcttcataccaactcataaattccgacacaggtgatattccactcttggtatagttatcataacggtaggatgcatcgaatttatgagtagcaacatcaaactccaacttatattcattaggacctttgcattgatacatatcgcacaattcaaccagtttgtcaatatcttttattccgatcgataaaaactcgtcagaggcctcatcatcggcaaaattcccagcaggtataactctctttcctttaacaaaaatagcattgaacattttctgcgatgtatcttgataaatataaatatatattttatcaacacttccgttggtatattccatacataacgaaacaaattctgactgtaaatcagtgaatgcgtcttcaaaacctttgatcataattttctcctacttttttattaaccttgcaacttgcattatgaacccaaacaccaatttcaccaacatgataagtatggaaatcctctacctgaaaattatacactgtagtgggttcatctgtcatctcaacattaaatttttcaactaaaagaacatttccgtttacatcaagaaattcatcaccaactattagttctcctgctttaataaagccttgattttttacataaaacgggtggtcaacagttgtaacgatttcttcgccgtttactgtaagatgaacaagagtagttacctctcttatgtatgtttcaaggacggtcttttcaccagtttccattgtttcaggatctgttgaaatgattttatctcctgactttatcttttctatggcaaccattccgacaaccgccatgacaagcgttcccgccacaaaacatgacggtttaactcctgcactgttagctgccttgttaaatccgctgttcattccgccggtaaaaacagctacacttgctatagtcgtctgagctacattgtatatagaactctcatgcaaagccgcattaaagtcactcagtgtcaatcgtattcaaatatgatactattttaatattcaaaacagataatttttgatttgacacattaatatatttcttacaattttccgttatttcataacgaaaatgaatatttattacaaaattatcaaattgcttatctggataaatatctgcatattgcttactctcaatataccacaaatatgtattgagcttatcttgtaatataacaatatgatcaaattcaaacttaccctcaaagtgcaaatgatcatatatttccataattaaggttttattatcatcatcaaatgctattccatcaataacatttacatctgtaacagccatatatttcacttcctgttttaaatttggttaaatgaaattttatttacctctaatcgtattgattggtgtaccttcaggaattacatctacaggtttaaaaacaccaccaccttctccagtaactacaagatctttatttaaagctcctgtatcaaatccattagccttttgattagatgtgtatggtgcagtttgactcgctttatactcttcaataaaatgatttccatctgaatctaaagcaataccatcgaggtaatttccaccatttctcatggcatttccattcgaatccattggctttactgaaacttgtgtttctgcttcagggtgagcttctttcaaattagaaaattgttctttctcaaattttcccattttcttgatttttggtaacggtttcagcctttttccctgaataatccttgctagcattatgcaccaacacgcccaatgtacaaacatgataagtatggaaatcctccacctgaaaattatacactgttggaaactttgagttatctgcgtaactaatatctaatcactgttacataattcccacatatccataaacaaagcatttcccacagtcatttggttagtttcttctctgtctttaaacttttttatacctggatatacttcgtccatatcattaatatataatcttgaataacctttttctgtgagataattgcaaatcgtttcatcaacatcaaattgctttttgctatacggctcatttctgaatccagcaagatatgaatccattccatcaggatctggactgtcaatagaaaattcatcttgaaggtagaaatacttaactatcttgtttatttgcagtagcgaaacatattcaatttcaccttctgaaaaagaacacctatttacaacaattctaatctctgaagaaggctcgtttgaatcaaaaaacttctcaacattttcagatttggtctttattttttccaatagttcatcaagaaaatcaactgtgtccctgcactttgtaataaataattctgtatttccgtttatgtatatatcttctatcgctttttttatatcattttgcataaaatattacctcgttatatcattactttactattaaatcgtgttgacccgatgtatcagcaggttttgtattattaaaatcaaaatctacccctcttaaagtccttagcaggagaatattttctaccaaaattatgtaccagcgcacaaaagaagtcaacacggtaggtgtgaaatattttaattagacgtctttactgtaatatttttttgcatcacttaggctgacctttttgatataacgtaactgtcagtccttcctcgcccataatttcttcgccaatttctactacgatatctctgcttgggaaaagcgaattaactctgagttgccaaaaatactgaattgcctttgcaaactcctcaatatagtcatctgaactatttataacgtcacattctttgactaaactttgcaatgaccaactattgacgaacatctcaatatctttagtatttttataaagtttccttaattccatgatatttccattatagaactcagaaataaatatacaatcatcaacttcaatgatctctggacaaaacaaactagcaaaactaattgccgtttcaatatcgtatgaattagcaacatgattcattaaagacctgccctgtattttagagaaatcatgtagtatcctctcatcaactatgcttttatatattttcattttaatcaccgattttctaataattctcttggaacagaaccaattaatttcatatcacgtggatataagtgcccgttcggagcaatatcatagactcttgctttgactctctttgtagaaatatccaaatttaatctaccatccgccccataaaccaatttatgtccactctctgtattcacataggtattcggctggccttcaagaggtcttgaacctccacttcttccaccagttcttattgttccatcatatttagtttccttgattttttacaaagaacgggtggtcaactgtagtgattatttcttcaccgatcacattgagatgaacaagcgttgttacctcttttatgtaggtttcaagaacagttttcggagaagtttccattgtttcagggtctgttgaaatgactttattgattgcaacaattactctactttaacctttttatatactcatctattcccataacaagcacctcttgcaacatttctaaataacttttttccccaccactttttttaatcataacatcaaacacttgttttaatttaccatcaatcataactgtaataccagttaccttttcaccagtatttgtattttcaaattcttccgacataatacgcattttattatccattacgcactctccttagatttcactctataatttttccattagtggcaacttcttctatccattcagaccatggtgctggtaattcataacttcgaccaggtgtagatatatcagttagctttggagcagttcccccttgattcaacggatttgagcgataaccatcttggcttattgtattttcttgtaataagtcatcaaaccactttggtacctcaaattcaactgtatatgcttcatttcctcgaacttcatttttaaaataagttgaatgttctccgttatctatgctaatatttaaatttttattcttgttagcaattgaaattgacccgttttcatttacagttattttttgttgactagaattactgctgccatctcctccttgaactcttcgatatataacagtctcttcattttcaccaaatgaaatcgtgtcatcttcacctattttgcgatactcggtttcacttaagttataatctgcatttgcattatgaacccaaacaccaatttcaccaacatgatatgtatgaaactcatctacctcaaaattataaaccttaacaggttcttctgtcaactcaacatcaaaattttcaactaaaagaatgtttttgtttgggtcaagaagttcatcaccgattgcaagttctcctgctttgacaaagccacgactatttacatagaacgggtggtcaacagttgtaacgatttcttcaccgttcacagtgagatgaacaagcgttgttacctctcttatataggtttcaagaacaggagttcgctataagttcagataagcgaccatctatcgaaagtgtcattttatcacctcgtcattactcaattgaaatgaaccatatcataaggataatactgctcatttttcaaatcgtcatctacaaaaccaagtcttttggcaatagcaccagcttcaaaacaccaatatccataatactgatatttattcaccagttcatgtgtaccataccaagcactatctacagagcctttataccatcctctcaaatattttagaaaagcatctctatcttcatcgttaatgctttttactaactttttgtatggacgagggaaggatattttcgatgtatcaaactcacttttatttccaatgaggataaaatctaataatgaatcatatgtttcagatttcctcaatttattttttattatattcaacttaccatcgtccaaattcagaagatatgctaaagaagcaaaaataatattgctctcgtatactgaatcatcccaagcttcaccaaacaaatctaaagaagattcaaattctttttttatttcttcaattgaatcaccttttgaatacttagcgattattatcccgatttttttttgtaaaatgtaatcttttacaaaaagtatcttgtcatttaagtattttccagcagcaataccctcttcaaatcttttgattccttctgacattttcaaaatatactcatcaaaatactcttttgatttaattgtatctcgcataatattctccttaataccaaaaattctcgatgtaaataattgtctactttaatgacttaacactagttgtaacatttactaaaccgttatcgttacttacatttactctgaacaattccttaacagtatcaccagttgcaagtccttcgattatgtcatctgggtcatcgactatttttcctatattattttttatcttagtaaatttcacctttattattgtttggcactaataaaagaggtcattctatttcaaaccatttccatggctgcgtttcatcatcacgaaaagcgccgcatcctagaggaagatcacataattcaccaatagaagaatcaatctgctccatttccgaaatcgatattatagcagcactttcttcaccaacgtcctctccgtccagaaattcccacatttcatcttctttatcatggaaaactaaaactactttcttttttttgttaataatatctacagttgttattaccattgtattttcatcaatatcaaacataatttttcctcacttatttgatttaaaaatattttcttctcttgataaaacctgtgcattagaataactattactttctccactgcttcttggctttatgtggtcaatttgaacttccaatggatctggcgttacgtttagcttactttgagttgcgggaacaagttcttttcctgacatatcagattttatttttccgccatttcgtctcatattttcttgtattatctgtcttttttgagcctttgtaaacttttcccttcacctacatattttgaatcttttagattagaacaatcaccagcattatgtaccaatacacctaatccgctaacgtgatatgtatggtaatcctctacttgaaaattatacaccttaacagaatcatctgtcaactcaacatcaaaattttcaactaaaagaacatttccgtttacatcaagaagttcatcaccaactattagttctcctgctttgataaagccttgattttttacataaaacgggtgagtttcagtcgttatgatttcttcgccgttgatcaccaaatgaataagcttcggatcttttcttatgtaggacttttatgatgattttagttagtcttcctgcggatcatatatccataccaaatcacattgtaattcgttataatatttttttaatttatttaaatatttatcgacaacatctgggcattttttggaaaagaaaattttaatacaaggctgtttatcaaattcaggatattgttcaaacaattgtcctgattttataaagcctatatagttttttaatttatcttgaagcaattgccaatgtgctactattgcttcttcctgccatgttaaatggtcacttatacccataattatatgattatcttcaacataaatgtaatcaatactgtttttctcaagtacagacattagttacctcctattaaattcatatcatctagaatggagcgagttataccattccttgtcgtatatccctttaaaggtccaagtatagtgccgcctaaaaagccgtcttttccttttcctcttatcatgccaccatttctttgcaacaatttataaccatttttttgattttgggtatatggagctgtatctgatgcttttacctcataaaaaaaatcatttgttatttcatctgctctaacattataatccaccaaattgctatcgttatcgaatggttttatagtgatttcctgtttggtttcggggtgttctttaagcaatttttgatgtctttttaaatctgatttgagctgattgatatatataatttttctttgtctctgagacctcagctcatttgctctgttttcatagctattaacttcagaacaagcgtcataatatctacttctagattcatagtagtaatcttcataatccataggtattaacactccaatcacgaatatttgctgagttttaatttcccaatgaccaacattagagattccgtaaacataacaataggaatagttttttctatgggctgaaaaatcactgatactgctagccatatgaaaaattctattgataagatcaaataggctctttttttaaatacgctaatttcatctctgtctaaaggcttgtttttatcttcgacaggggcaaaagcaaaacataccaccattccgaccaataataagataatatatatgattgacaaatcaacataaccaataaataataacatttccatgataatcactatggaaataaaatagcacctcctcggggtgctagcgtggtatcctccggcatagcttctcagtggtatataaaaaactaagaaagctatgctttcaaacaccttgcccacaataacgccgataactatagtgctgataaggttaagtaaaaccgttatccccatattaaatccgtattcatacaaatcgaaatcgctttctgatataatacctttttcacatagacgttgcgttattttgcaggcagttttcttaaacattagaacttccgcagtttcttagaatcagcaggcaattcaggctggtgagtgatgaacatgcatgtagaattcacgtttgatacagtaaccaaaagtgccaatgcaacaaacaccttacccattcttgtgctgagtttcattaaatttttttcatatgatcttcttcagttcataacaagttatgacttgattatacataatataagaataaaaaaaacgtaaatgtcaaaaagaacgtcttttttgtaaaaaaaaatagaggtaacttattgctacctctatttttcatacattatcactgatgtttcaaaccagttatcagatacatcagtttttaaaagtcctccatatttttccgcaatattttgaacactctttaaccctattccatgatttatctcatcattttttcttgtccttttatccttgtgtatgattccgtcaaatgaatttcctactaatattttaatgtaaccctgcttataaacaatatcgatagttatcttcttttcatcgttctcgcccagaaggcttaacgcttcaagtgcattatcgataagattacaaataacgatatttagatcaaatgaactaataagaatttgctcagggagaacaacatgataacttttttcaacgctgttgttctctaacgttgccaatttgtaattcagaacactatcaatcgtttcattccctgagtcgataataacattattactataaatataatcattggtttcagcaaggtaatctttaagctgatcgtatttctcagcactaagcaaactttgcatgttgataatatgatttttcatatcatgctttaaaaatcttatcttcatctgagattcctgcattaaatgcaactgattaagataagccttgttttgctgctcaattatattattttcgtatttttcagaaaacaaattaattagattatcatacaaataaaacatgtcaacattaataagcaaaattatcacagaacagataagtgatacaatatttaatttgaccgctgttaagtaaccaataataatgctaacaaatggtattattataacagttatatagtacataacaggtaaactaacgttaagttgattttttttgaaaaaactatgcgatacaatatttacaaaggctaccataactatgttagaaacaaacccttgttcaaaaaagattgaatgaatatttaatacagattgtatggctacaaccagtgtatccagaacgataagtactgcacaaagtatgaatgacgatccaatcgaataaataaatttatttttgtggtaaattgctatcaaacaatacggcacaaaatttgataaaagatttataatccaattaccaaacagtaaatacgcacagctatttataatgtaataaagtgtaaacagaacaacatctgattttgccgattcttttttcttttgtaaaaacacattggaaaactgataagtggcatatatgtgaaacacatttgaaaacaaataaaataaagtagtcatatcattctttcaacagctgttcactgacctccattttcttattagggcttatcggcaattccactcggtctatgccaataaggacgactgaatgtgacgtgaatctttcaatataatttttatttactaaataagatttatgaatactgataaaatcacttaaactttcattgtcaagcaggttagataattttccgtaaaaggtatattgattcgtaatagtatggatcactattgttctgccctgactctcaaaataacaaatattagatactatgatactgtttttgactttatgtgcagtatattcaaacaccttttttctcttagcctgatccaaataataagtttcaaaaaattcaactattctttcataggtaattggcttttttatataatcatagggccttattttaatggagtcaatagcatactcgccataagatgtcacataaacgatagcagtgttgtcattggcatacagtccacgcagtctttttccaagctcaataccattcatttgtttttcatcattatttttaaattcaatatcgagcaatataacatcaaacgagttccccttgagatactcgtccattaattcctcacaagtatcaaattctgcatgatcaatttctctgtcacattgtattgaatagtctaacaaatactttgacaaactttcctgcatatgtttatcatcatcacaaattgcaactctgatcatacgatcaccgcctttattcgccattataccaaacatttatcagaaaatcaatacatattttatcaattttttggtataatagtttacaaaagaaattataattttttcgcaaaatctgcacctacaggcaaaaaggcaaaaaagcaacgtaaaatcatgtattatttactaccaatcagatgtttctgacggctaaaaacttttaagctacaaaattgagtttttcaacatatttcttttttgtatcaagcgatgagtgaacatagcggttaagtgtaatattaacattagaatgacctagcaactcgctgacagttttagcatcaaagccattctcaatacaaacagtagcgtatgtgtgacgcagtaaatgaaaattaacgttttgggaatgaactttaaccgttcttctttcctgacttccgacggttcgcggcgaaaaaagcagatgcttactccagaaattcattaagctcttcaagctcacggtttttctttaaaagctctttgatccgcttgtttgctgcctgaagctgctgtgcgatagtaagtgactctccaggtgtacgcgagcctgcacctgtgtctatttccccgatccgcgccttttgcacccacgtccccagcgtcccttgggggatgcgcagctcatctgctgcggccttggtgccaatctcctttgcgagctttattgcctgctttcgttaaattgtgttgacaaatcccattaaacaaggactttcggataaagaaaacggacaccaatcaagatacgcattgtatcaaaattggtgtcctgttatggtgcggatgacgggacttgaacccacatgaccttgcgatcactagcacctgagggtggggtaacgacagtgaataataagttaactcatacccttatcctactgataacccccttatccatctcatgcaccgtatcgcacagcacggaaatatcctctgccgaatgaaagcatatcagaatagtcttgccctactccttgtagctgagaagatactctctcatttccttaacgccgtccttgtcaagtcagttgaaaggctcgtcaagaataagaatcttcgggttttccatgatagcctgagcaagccataagcgctgaaagccaaagatatagtgcttgcattcaatacaaaattaagtattgattccatagctaagaatcacgaaatttagtttttccttaaccaattatacaattcatacattattttttaaaaacttcaaacgcatcttcgttttcaagactccatttatattttgtcccaatgatctttgttcctttaaatctaacagtaatggttttacctttataatctgctgttattctgcaatatatatccctgtcatgatatttatatatttgtggatcaccatggatgataagggaaagggtttgactgtcgtatcctgcagattcagcatagttgaaggtctcatcaacaaaagttaattcatatttttcacaaatctttttttcaaaatatgagccaaatatcttatgatccatctgtggtgatggtatttttgcaaatagaaaaagtatcataccgagcagtattatcgccaagactgaaaataatattattttttttttcataatacctccacatatatttatattaatgctgttgtattttttatgaataaaggttttagggtttttacgacttttttgtcactatttttaatttcataagaggctgtactactgtaacctattgggtcattatttcctgtagatgcattatcaccatacatctttttatagtcgactactgtcttaattgctacatatggcttgtaataatttcctttgtttgtaaaacttctagttaacttctcataatcgtataactttgtttttgtgtttaactttccctcagtaagcacatacttccacgctgtcttatcacaactgtagccaaattcccatctgcctttatacttaacccatgtatatttcattgtggtatttaagcaaacatccgacaatcgaagaaactttgaactatccgtatatagatcatgtggtgacggcgtacgagaaaatagtgattttattaccacccctaaagttttaccagctataggatgaccacatcctgctaataaagccccaaaaccttttccaaataatgttgaaacagctgtatttaaatatttttttgcggttgcttcattggtgcatttaccaataagatagatattgggagaataattgcgacgtaactttggtttactagtggatactttatcacttacacttagtgagtagtattgatatgactttccaccataggaatacgtcgatgatgtgcgaatcacgtcatacatcttttcgattcccttacaaggataaaagctagctttagctttgttcataacattgtaactactcgatatattttcttgattgcaaaataattcagaaatctcattttcgcttagtaaaaggtctttagtttgcaattcttttctcaaatcgttgtatttactttccacaattatgtcgtctggattatcttctagagccgatacagtatcaaaatactcagtaattagttcatcatttctctgttgatattcttgctccattgtattaaagtttgtgaaaacctcatcactctctgaaattgttacatcatctccagatatagagataccagccgcaattatgaatcctttgaaatcaatatttttagaattaatatttacataaccatttggtgcaaaaataatacctttataattaaattcattggaattaatcactatatttcctgtgtgaaatgcaataattgaattttttgattcggaggtcacagatgtagcattaatagtaatgtctccgtcagtatataatctcccatcaaaatttaaatcttgtaaaaccaatgaaaagtcagtaaaataattatctccttcaatagtatatagattatcagagttagctatatcattaaaatcatcatattcattgttaataaatattgcatttaatgaatcaaaaattaatccattatcattttctgttctcattcctatttcttttatgctattgtatgaaatattaatagaaccagctcatgccaatcacaagaattgtaatcaaagaaacgatccttttatacacaaaaaacacctccttttttgttagcattaatacagaagcttttactccctcattcatacataacaaatcagaaggtggattcgttacagaaaaacaaataatagttttatttttctgctttttgcacagaatttgctatatcaattagttcatttctgccaatgttggagcttatcataataatataatctccattatcccaaatcaagtgataaaattgatgattatctatataataaactgcatcgtgtccggacatatctattgttgatatttcagcgttttctgtgttaagtcccatatcaaattcggatttgactaactgctgataatcaattattgtattctcattttgataaatgatattccgagaaattttatcatattcctcataaataacatcataatcactcaaatcataacctatatcatagttgacttgaattgtgtccaatgcagcctcattgctttcaacatttgctgatatctctgaatggtctgaaaaaatgctcatgaaaaaatccttaaatgcatttctcaaagcggatacgctcattattgttgtaaatgcagcaataaaaatcactataaaaatacaagccactcgtttactggctgtattaatcatttggtagtacggctttctctggcgacctatcagcttattcatctttcgggtaaacttatctgaaaacttatagtcattgttatgtgcaggaacagataattcatattctcttgtcaaagcctcagatattgctctcttaaactgagtattattcaatgtgactactcctttctaagatgtctttcaacatctttttagctcttaatgcacgttgtctgaccaatccagaagatatttcaagttgtgttgccgtttcttttgctgagaactcttgcagaaaatacagatagataacatccttataaatctgcggaagttgttttattgctaataaaagttcatcatagttttgtttttcaaaatatgattcatcaactatttcagtttcaaataattctgtactatgctctgcacgattttgattttgcctataaatatttatcgctgtgtttctacatataataacaatatatgcttttaattcgtgacatggaatttgtgaaacttttgaaaagttatctgctattttcaaaaaagactgatgtacagcgtcctcagcatcttccttgtttttcaaaatgccatatgcaaccgcatacatatcctgcttgtattttatgtaaagctgttcaaactgatttttttcttcgttggtttcgagcattgataggtaaattgccagcatcaaatcacctctccgttttttgtctgtgcataacagtatatcattaaaagataaatatttcaagtgcattttcagtatgaacataaaaaaatgataattatttactgtcaaccggacagcccggaaaagttaagtacgcagacttagcaagcatcgcaaacggcagtccgcccacaaggggcagaccaccgattgcggcttgtcggggagaaccccgaacccccaatctgccactccctccctctcacagtgcgacggcgaaaacgcacatcttacccccgtgtcaaaatcaaatcttctgtgcaaaacaatgaaaatggaccatgactattgacaaacgtattaaaatgcgataccataagaatggagaatgataaaaactcgtaaagatttaaacgtctttgcgagctttttgttttgtatatattttcgctgtgagcagaaagggtgaaacattaattgaataaggaggcttgataaattggaacaattcaattcaaagtcctgcgaagaaattatgacaaccgtgtacaagccaatcgagttcgttgtagacggcttgcttgcacaaggtctgtatatcttagcaggcgcaccgaaagtgggaaagtcttggctggcacttgagatgtgcttgtcgatagcgaaaggagaaaaagttttaggtctaaaaacttcacaaggaactgcgctctatctgtgtttgaagacagctttcagcgaatccaaaacaggctttatgaattgacggacgagcctgttgaaaatcttcactttgtaattttgtcagacacaatcggaaaaggtctcgaagagcagatagagcaattcaaaagtgagcatagcgatttaaaagttatgttcattgatactctgcaaatgattcgtgagtcaaacgataacggttatggttcggactacaaagagctatctgttctgaaaagtctagctgacaaacttgaaatcgcaataatagttgtacatcacactagaaaatgcaaagacagcgacccattcaatatgatctcaggttcgacaggactgagcggctgtgtagacggaagtatggttctgatcgaaacaaaacgtggcagccgtaatgcaaaactttattgtgtaggacgtgatattgaaaacgcagaaattaatttgcagttcgatagtgatttgaaaaagtgggtcgttaccgatgagccgaccgctccaaaaagtaaggccaacatttttcttgcggcattgtatgtttacatcaaaaagaaaattgatttttcaggtacggcgtcagaacttatagagaaactgaaaagtgtttctgatgaaacattttatcccaacagagtaacaagagatctggttcgcaacggttacacgctgagaaaatacggcattgattttgagtacaaacggacacgaaactgcaggctgataattcttcattacgaccgtgagcgtgacagcagtgacagtaaaaacactagcgaagttactgtcaacaggctgaccttgaaagtatgaaaagtcctgcaaaaccttgctttacaagatgtgacggtagaaatcaaagcaagttttactgtcaacatttcaaagctactgtaaaagccaaatcagcgaacgtggggcgatttgtgggctaaaaaaaatcagtcgggtaagtttagcagaaactcaccaaaaccacacacaagcgatctgtgagccgctgtgagcgatattttaaataaggttagcttgtgcaagtcgaactcaacgatttgagcaattatgtacttttcacaattcagcagctagagctataaccaccaaagctaaatatttcattgcaagttaaagtttcggggtcgcagcccccgaaacagtcacagcggacgagcaaagctcgccgcaaaagtgccgaaaatacgcagtttcagcaaaatgattaccacaaaaaaagactgctgtcttgctttttggcaagatcgcagccttttttcttggggactttttttacagcccctttttttagctgataacacgataattctcggctgcttcttctttttttacatactcggtgacattgagaacttccaccttgacaggcttctgacccatatttatgctgataatgtcgccaactttcacgtcatatgaagctcttgcaatcttatcgttcacaagcaccttgcctgcatcgcaagcttcgtttgcaatggtacgtcgtttaataagtcttgtgactttcaggtatttatcaagccgcatattttcctcctttgtagtaaaaaagacctaacccgcaggctaggtctgagtggcataagctttagattacttgtttacagcgtccttaagagccttgcctgccttgaatgcaggaactttcttagctgcaacagtgatctgctcctttgtacgaggattgatagctgtcttttcagctctctctctaacctcgaatgtaccgaaacctaccagtgagatcttctcgccgttagcaagtgtctctgatacagaatcaataacagttgtaagtgccttctcagcgtccttctttgaataatcgcccttttctgcgataagattgatcagttctgcctttgtcattgtttttacctccaaattatttttaacgaataaagttattcattcattttgctctcgccaataagcgtcaagctcatttatgctcagggcggtcatatcctgcccgttttgccttacagcattttctgttttctcaaacttttcgatataattattatttgtatccgtcagcacttcttcagcgtcaaggtcaagctttcttgcaagtgaagcacaagtgaacattatctcaccaagctgttttgcaactacggctttatcactgtcagcactgttttcaagagccttaacagcattttcaagtgcgctgatatcatgagcattgtcatactcgatacctgctcttgctgcacgtttgcttaacttctgcgccctcataagtgcagggaagttctttggaacgcttttaagggtatcggaataagtttcctgtcccttggtttctttcttgatagtgtcccaatttttaagcaccgtttcaacgttgtcagcttctacgcttccgaaaacgtgtgggtgtctgatgataagctttttacaaatatcagttatcacatcgtcaagtctgaaattgttgttttcggtctcgataactgtatggaaaaccacctgcaaaagaacgtcgccaagttcttctctcatcatttcaggagagtcacagtcaattgcttccattacctcatagacttcttcaagaaaatctttcttgatagacttatgggtctggaccttatcccacgggcagccgttctcacttctgagaattaccacgatatccgcaagatcattgatatcaaagctttctttagcaagcaattccttaattttatcgctcattacatcattacctttccaaaagggtgcttattaataataaaccattttgctcaaaatttcaagggttttgcggatttttttttgaaaatatgcaatttacaatatttttcggcgtttcgcacaataaatataaacaaaaaaagtacattgtgctaccaattcctatagaaaaaagggtcacaaatctatgatttatttgcaaatgggctattttcgtaagtgtttcgtgtgacaaaatggctgtcacactgcacataatagcggcgtaggtgggctttacgaaaatttcgctcacttttggttttagatccgtcattttgcaaactgagcgtacggataggacgcatatgaaaacctctgatacaagagtagaaatagctgctcctgatatatttattatgggctgtcttataagtataatgttcagaaatagcttgataattccacctgccaacataattattatggctttgtgaggttttcccagagtttgcaggatagcaaagcagggagttgctatggcaaggaatattactgctattcctagtatggacattggcattatgcagacctgtatctcagtttcacggcctccaaaaagaaaacgcaggataggttctgacaaaactgcgatgcccatgcctgcgggtatggctatgatactggtgacgatgagcatttttgtaaggcctgactgcatggcttttttatcgtttttggcacagctttcggcaagtgaggggagtatgcttttgccaaacattgcggtgatggtcggaacaagaccgaaaactgtcactgcaagaccagtataagagccgtaaatgaagttcgggagcatatcggtggtgagcttgtcagagagcaggttgtcaaatgtgtgtggagaacctttcatggcggctttgatacacggattgacagtgagcatatctatcatgttggcaaaggtcattattactgagataagtgcgatcggaagacagcagacgataagctttttggctgttgctcctgtggggtctgttatggtatctctttgaagcatttgctttgttacgctgtcgcctttgatcttgcctgatatgagaatatacagacaggcgatcgcagaggctatggacgaacctaggatagctgcggcagctataaatggaagtgcagcggaggctgcctgacgtgagttttcataggctgtgccgaatatcatgcctgttttatcatacatatcggagatatgatacattagtccgtaggcgaaaccaagacctaggataagtttgaaaagggtttctatcacttctgatacagcggtcggtatcatattctgcaagccctcacagtaaccgcgttccactgacataatggtacagaaaataatagatggggcaacgcacatgagagcatattttgtacttggctcgccgactacattgcgtgacagaaaatctgaggtgagtatcattactgcagctgcggctgtgctgataatcgtgaaaagaaaaaatgcagttcgcttggaatgacgcatatttgaaaagcgttcaagggcatagttttcagcggtaaggcgagccatggtggaggggatacctgaaacgactattgcgaaaactggtgtgaaaactgagaatgctgaagcgaaatatcccatgcctgtgccgcccagaagattagtaagaggtatcttatagagaagtcccagaatttttgttatcagaaccattgcaagcaatattgctgagccttttataaagccttgtcttttcatctgtcaacctgctttctgacttgtttttatatgatcttatgctgttatggtgggttttattacggtttgtccatatgtcaggtggatatgcagttgtttaaattgcacaaaaatagagcttagggtgctaatactaaaaaaaagtttgcgtaaacactttattttataggaaaaatgtgatataatcatattatgtatatttaagaaaaagaggtaaaaaagatatgacttataagttttcagaaaaggtttctcatttgcaggcttctgctatcagagagatacttaaatttacttctgacccagaggtaatttcatttgcagcaggcaatccttctcctgaggcattccctgtggacgagcttaatagaatatcagaagagatattcaaggaaaatcctatcggcgcactccagtacagccttacagagggatacactccgctgagagatctccttaagaaagagcttgaaaagaagggtgaatttgaccctgagagagatgatcttatcatcacaagcggtgctcagcaggctaacgagcttgcttgtaaagttctctgcgacccaggcgacattctttgctgtgaagctccaagctttataggctcacttaatgcgtttaagtcttacaatgttgagcttaagggtatcacgcttcatgaagacggagttgacctgaaagagcttgaagaggctttcgctacaggcaaggtaaaggtattctacattatttctaacttccagaatcctactggtcttacaacttctcttgaaaagagaaaggctatctacgagcttgctaagaagtacagcgttatgatacttgaagataacccatacggtgacctgagaataaagggtgaggctatcccgtctatcaagagcatggacaaggacggtcttgttatgtattcaagaacattctcgaagatacttgctcctggtatcagagttggctacatttccgctccaaaggagataatcggaaagatagttgtctgcaagcaggtggctgacgtacatacaaacatctgggcgcagatgctggcttacaacttcatgaaggacaatgatatcgaagcacatcttgcttcactgagagtgatctacaagcataagcttgaacttatgatagagcagatcgagaagaatttctcttcacagatcaagttcacaagacctgagggcggtctgttcatttggtgtactcttccagagggcagtgacatgactggtttctgcaaaaaggctgttgcagaatataaggtagccgttgttccgggcaatgctttcatggtaagcgagtctgacaagacagcttcattcagattgaacttctcaactcctacagacaaacagataatcgacggctgtgagaagcttggcaagctttctaaggaaatgttcggcgattaagataaaatgaaaaaagttccttttacgccttttcagcttgtgcttacggtggtaaatacggcggctctaatgttttgcatggggtgtgattgctttgtgctgatagtgggcatgacggcaggcaggacaaagccttatgtggtggatcttgtgctgagtcttcttgctatggcggtgtttattctgcttgtgttttcagcaggcaggataaatattttcagtgataaagctgaccccgatggcgacactgcacctgcggtatcggcacttaggacgtatttttgtatcttgttttttgatatctcaggagtgctgggccttatgcttgcgggagcgttgggagttgagtgggctaaaaaagctattataatttttgctcctgtcgtttttgtccttgcggcgattgtttattttattctatcgggcaggataggtcttgatgatttttcggatagtgacggggaagaatgatattacaaggggggtctgtcatgaaaagtgcattgaaaaaggatactgtcagagagataaggcactcgttgggtagatttctctctatttttctgatagttcttcttggctgtggatttttctctggtatcaaggcgactatgcctgatatgatagacacggcggagaaatatttcagtgataacagacttatggatattaagttaatgtcgtctataggcgtaaagtctgaggacgttgaggctgtgaaaaaagctgatgatgttcagggcgttatggcaggatattccaaggacgttttctactatcatgaaaatcaaaaccttgtgctgaaattcatgtccttcaacaatgttgttgatgagaacagccctaataatcttgataagcctgttttactagagggcaggcttcctgaaaaaaaaggcgagtgcgcagtagaggtaaaaatgagttcgcctgacacctttaaggtgggcggagagataaagatcaacgagcctgactcgtcaaaaaatataactgatactttggcaactgacacatacagaatagttggtattgtggcttcaccgctttatatcggctatgagcgtgatgcgaccacagtgggcaacggaactgtggtaagcaacgtttttgtgcctgagagcgagtttgtgtgcgattattacactgagctttatgtgaaattcaaaggcactgacgagcttgacccgttttccgacgagtacaagcaggctgtgaaagataagagcgttcaggcggtggagttttttgaggacagtgtgaacgcaagatttgaaaaactaagcagtgacgctcaggacagtattgacgtcgctcaggagaaagttgacatcttgaaacaggcgcttgcctgcgacgaaaatcagcttacggagcttttggcaacggcgcagaagtcggttgaggaagctcaggaggcttatgataaggctgaacagagtggttctagtgcaaagtatcttgcaaggtcacagcttttaaaagcacaacagcttgaagaagtggcaggaaagcttcttgaagacaaaaagacaggaagtacggcggcttttgatgaatataatggtcagcttgcggcggcagaagatgagatagccggagcgaaaaaagagcttgaagccgttaaaacgcctgcattctatcagtatgacagatttgaggctagctctgattatagttcattttatggggacgctcagaaggtcgactctatcgcaaaggtgtttcctgtgttctttattcttgtggcggcgcttgtgtgcctgaccacaatgactagaatggtagaggaacagagaacgcagataggtacatacaaggctttaggatacagtggggcaagaatagctggaaagtatcttttctatgcagcaacagcggcatcagcaggaagctgcataggtgttgttgttggattgcagatctttccgaagataatttatagttgctataatattttatataacattcctgatattgacacaccgttcaagcctgtttatatggtgctttgcttggtggtgtcggtgatatgcacctgctcggcggtgctttacgcttgtatcaaagagcttaagtcacagccgtcacagcttatgcgtccaaagccaccgcagaatggcaggcgtgttttgttggagcgtgtgaattttatatggaatcggcttgactttcttgcaaaggtcactgtgagaaatttgctgagatataaaaagcgtttctttatgacaatcgtgggagtggcaggctgtacggcgctgatagtcacgggttttggtttgaaatattctataaagactattgccgaaaagcaattcaatgagatatttctgtatgatgggatcgcagtacttaattcagctgattttgacgagaaacaattggaggacaagataagcagtattgcacaggtagacaaatctatgcttatgcagagtacagatggcattgcagaaaatgaaagtgaaaaccagtctgtttctatgatcgtgccgaaaactcctgaaaatatgggagattatatcgatcttgtatctgctgagaatggatcaaaccttgaagtgaaaagcggttctgttatcataacacaaaagcttgcaaagcttcttgacctgaaaacgggtgacactattactgtaaagctcagtggtcatgaggaggaagagttcaagataggcggagtaagcaagaactatgctttgcattatatttacatcactcctgatgattttgaaagtgtatacggtgagaagcctgtttataatctttcttttattgacctaaagaaagacactgatgaaaactctttcaaggaacagcttatttcaaatgacgagttttatggaataagctttaaaaatgattcaagcagaggtttccttaattctgtggacagccttgacgctatcgttattttgctcatcgtttgcgcgggaggcttggcgtttgtggtgctttacaatttggcaaacataaacataactgagcgtgttcgtgagatagcgacaataaaagtgcttggattctatgacggtgagacttcagcgtatatttacagagaaaatctgatatcgacgcttgtgggcattatcgtgggtcttgcggcaggaaagatattgcactattttgttgtgataacttctgaggtcgaccttgtgctgttcaacagacagcttgtttggtgggcgtatgtgcttggtgcgttgctcacattggcatttgcatttatagttaatttggttcttcatttcaagcttaaaaagatagatatggtagaatctttaaaatcagtagaatagacggaggtattattatggatatttttgaagaaaactgcgatactgaaaataactgcacagtaagctatttttggaaaggtcttgcactttttctccttggcgttataattggtctgtttgtttcgcctatcaagaaaggcgttactatcggttgtaacaacaagatagacaagggtggctgtaacgatcattttgaccctgacgagtattatgatgattataactttgatgatgatgaagatgattttgaccatgatggcgtaaaattttaacgaaaggcgtatattgatatgaaacttggcatggtaggacttcctaacgtaggaaaatcaacactttttaatgcactcacaaatgcgggtgcagaatctgcgaactatccgttttgcacgatcgaaccgaatgtgggcattgtttcggtgcctgatgaaagacttgacaagctggctgagatgtatcaccctgtaaagtttactcctgcaacacttgaatttgttgacattgcaggtcttgtaaagggtgcttcaaagggcgagggacttggaaacaaatttctttcaaacataagagaggtggacgctatcgttcacgttgtaagatgttttgacgaccctaacatcattcatgttgacggctctatcaatcctcgcagagacattgaaactatagatttggagcttattttctctgacgttgagcttatcgagagaaagcttgacagaactaaaaaggcaatgaaaggcgacaaatctcttgcttccgctgtagagttccttgaaaagctcaaagagcatcttgaaagcggcaagcctgcacgttcttatgacatgacagaggacgagctggagatacttaaagaaacaccgcttctttcacttaagcctgttatctatgcggctaacctttgcgaagatgatttcagaaacaatatcgaaagcaacgagcattacaaggaagtttgcgagattgcaaaagccgaaggctcggctgtgttcccgatatgcgcgcagatagaggctgagatatctgacatggacgacgaggacaaggaaatgttccttgcagatctcggtcttgaaacttcaggtcttaacagaataatcaaggagggctattcgcttcttggtcttatttcatacctgacagcaggcgaacctgaggtaagagcgtggactatcaaaaagggaactaaagctccacaggcggcaggaaagatacacactgactttgaaaagggcttcatcagagctgaagttgtttcatttgacgatcttatgagctgtggctctatgacggcggctaaggaaaagggtcttgttcgtcttgagggtaaggattacgttatgcaggacggcgatatcgttctgttcagatttaacgtataaagcgtaagctacacaaaggcaggctgaaatatgcttgccttttttatgtgcaatatgtatgttttttttgttattatatttgtttaaaatcacaaaagtaaatttaatttgtgttatagattttttcatatattgatgatagaatgtgatagtaaaaattaaagatgataaatgtaatagttagatttttggaggaaaagtaatgacaaaaaacatgacaacgggtagtccgttcaagcttataatgagctttgcgcttcctctgcttttaggaaatttgttgcagcagacatacaatcttattgacgctgccatcgtgggaagatttcttggttctgacgctcttgcaagtgtcggagcttcaagcagtgtgcagtttttggtgcttggtttctgcatgggaacagcctgcggctttggcgtgcctattgcaaggcatttcggagcaggggacataaaaaagctgaaacagtatttttataattctattgttataaccgccgttactgcgtttgtgttgacgacagtttgtgcggtgctttgtagtgagatattgaagcttctttcaactccgtcgaatatttttgatgacgcatataaatatcttctggtgatattccttggcataccgttcacacttttgtataacctgctttcaagcgtattgcgttctgttggcgacagcaaaacgccatttgtatttcttgctatatcaacggttttgaacattgcacttgaccttgtgtgtgttatcgtgttcaggtggggctgcatgggtgcggctatcgctacggtcgttgcgcaggcgataagcggaatactatgtgctatatttattatgaaaaaggtcagcgtgctgaaacttgccaaagaggacagagtgatgtcaaagcctgcggttctgaaccttataataatgggctttcctatgggacttcaatattccataacggctatcggctcaatggtcatgcagtcggctaacaacaagcttggaagcatttatgtgtcaggattcactgctggggcaaggataaagcagttcacaatgtgtccttatgacgcttttgcaacaggtgcatctgtttttgcaagccaaaatctcggtgcaggaaatctcaagcgtatcaaaaagggtatacgcattggagttggcgttggcatgacatatggagtaatagccggtattgtacttatattcttcggcagagagctttcgcttatctttgtgaataagtcagacgcagcagtgcttactgcttcagccaaatatcttttctatgcaggctttttctattggacgctaggtatactcaacacttgcagaatgtgtacgcagggtcttggatattctggacttgctatattctcaggagtgacggaaatgatagctcgaatttctgtaagtatgatatttgtgccgaaattcggttatcttgcaatctgcttcacagatcaggcggcatggatagcggcttgcttgtacatagttcctgtttgcatatattgtgtgaacagggcaggcagacacattgcaggagatcacggacttcctgtggaaaataaataagtaaaaggcagctctgaaaaaaatcagaactgccttttgttatgcctacttgtttatagcttttttaagttgtaagacaacttcgctgtagtatcttggattgacatcgccaagtttcatgttgtcattgtatgcagcatcgggaagtcggaagtaaagctcttccacggtcacgtcctctatctcgtaatagccaatgtatgttcctgagaatttaagctcggcggtcatgcctatgttgatgagcttgccgtcgggatctttctccttgcctgagatatcatttcttatgaactcatagaaaaagcctgcgtcctgtgcctgacccttataccagcctgctttggtcatgcggttgactagagtggtgttcgttatctcggtattcttgaagatctcgcaggcggtcttattcttatcgatttccgctactttgtatacctttcttcttagctggtcaaatggctgtattatcttgtaatcatcaagctgttccagccaagcttctttttcatgttcagtaagctccagcgggtgaacaagccctatctgcataacctcggacagctctatctcatcatcatctgagtttgtaaagctgccgtcgtcaagataacggaacgaagttttaagacagccattttcgtaaataccccatataagacctatcgcaaagcagtgcatgagaggattttttacaaagagagctttccaagctgctgctgtccacttacggtcaagcataagcacatattcaagacgctgtttctgtgcgtcaacaacagttttcatttgctttttcatttccttgaaatcagcagtagccttttctgcgagggcagggtcgtcattaacgcctattttagggagatttttaagctttttctcgccctcgaatatttctatatcaagctgtggagtgagataaacggagaattttctgcttccaaaatcaaaggtgcggcacattttctcgtcaaagcccatgtcaggtactatcttgtccgcaagctcctgcgttgtcaagccaagctgatttgcagcgttggcaagtgcgtcaactgcggcagctctgaccgcacgactcttatattttcttgaaatattgtctacagtcataagtgcataggaactgccattcagagctacggcattgacggctttaaccgcaagggcaacacgcatatttaatgactgtttcgaccattcttttatgtaatccgtcaggcaatttattgcttcatcaccgccgtaaatggccgcaaaatacattgtccactttgttttcgcttctgcacctttttcaagccagcggctcaggacttcaagggcgaatgtttcaagctcgtcagatttgagcttctgggcaagtgccttgccctcgggtgggagggtaccttcgttggcgtttgcatatgtaagcaggagagcctgcaaatagatatcctctgtgactgtatcatcggtgaagtgaataggtgcaaaaggctgttcaaaaagccagagaactttcttggattttgtacccttagtgagggaagtcacaaggtcaacatctgagatgtcggcaggctttgcttcgctgcccaaaagttcagatattttcgatttgagtttgtcggatttttctgtggcataggctttttcaagctctgtgcggtaggcgtcagcaccttgattttcgattatcataagtgcagtttcacgcttggctgattttttctgagcaagaagtttgcaaacatcatcgcgccaatccttgtgggcggatataactttcacaagctctgcttttattaccttgctgttatcgtcacaaagggcaaaaaattcgtctttgtacttgttgctgtctgcgatatcaagaagccttatatacaaaagtcggctggacacagccattttacttacgtcgataatggcggctttgtctttaaattcaggcatgatagccgtgatctttttgataatatcctctttgaagtaagagttctctgtctgccagcccagtgcccgtatgattatctcaataggcagtcctgcttttatcattgcacggacggtgaactcggtatcatgttgaagttctctgtctataagcttgagcgggtcgttcgtatcctttgtagcacctatggaaagggcggcgatacagcggattataaaatcgtcctcgccatattcgccaacataattcatattctgatgtccgccattacaggattcttcgtctgcaaaagggagtatggtgtctaattcggctttgcctgtgatatatgcgtatatctcgtcacggtgtttgaaatgctcggctatattttttgagatatgttcctgctgggcggctttaagacctactgcctttgcatcataattcgggtcagtggctttgagcattttctccattattatgcctagatcaaagcgagcgttcttcattgtttgtatgaagatatcggggtgatcttttgcgagctttaccatttgcacagggtagtttccgtttttgtcaggtaatttgacaaagtgcagaatgtatctatctgtaagacactgtggttgagcttcgataaggtcgaatatcctgttggtggagagcttcaaatacatcagcccttgggtaagctcgtcacagtatttcacaatgtttttatcgaaaaatgcacgatattcttccacaaaatatgacgcttctgcatatgcggcaagaaaaaggcagaaaactgctgtagttgtttttggctttttttcgaccacttcggcaagcttttttatggcaaattcggctgtatcaggaattttcgttttgccaagcaggctctttttaggcagttcagttgcgtccaatgcgaaaatgcaaaggagaagctgtgcaatgatatcgtcagggctaacgaagttgaatgttcttatggcatcgtctgcggaatagacaggatttacattgaaagcgtattgtattgaatcatttgggcggtgtgatatcttgcttgatatccagaccgcttctgcattctcaccataaaaatcggtgagcggcttcatatacatagccttgttttgggaatatatataggcacggcaagacagtgcatttgtcatatagcggaaatatggacctgttgccattgagctgaaaataatatagcgctctttaagctcatcactgcctgtgtctgatatctcgcttttaacggctttgtcaagcttttcacgataattatactgacggaatttcggataatatcttgttgttatttttctcataagctcattgtttcttggatttgtgatgtcaagatattcaagggcaaggtctatggtctgttggtcaaaaccaagctcctttagagcggtttcaagctttataaagcttttggtgttttcattgtagatcattttttctcctccatattatttatcgcactgaacagtgctaatttttgtgtgcaaagtctgatataccgcattgtgttgcctgcggcagtgaagatatcaaggcttttgtctgcggtggtgtgtcttgcattttcgcacagctttgtgaagcattcataacgttttgcaagttcttcaagtccgcactggcgtatgctttgagcgtgttcgtctgcaataacagagttcactccgcactccattgccgtgactatcctcttgtcggtttcttcggtggcgtcaagaagctcgctacacattccatagtcttggtctgtatcattctcgacaggtacaggaacattgtcaggcggatcaataaaatcatagacctctattgggaaaagcgttagcctgccgtggtcgatatatccctgagccagcaggacgtagtttttgtgcttttcttttagcattttgccacctatggtttcaagcgtggaaataaaatcacgattttctgctgtgtattttgcggtgacggatatttgtctatcacagccgtcttttataataaaaatctgctgttgagtgtgcttgtcaaaatatgaaacgacgcactctttggggtgaacgaaataaagtcggtcggtctcctcgtcgcttttgtttgcggagatcttttccgcaagctctttgaaatcgctgacaataagctcacggagggcaaaacagtttagctgtgcaggacctgcgcctatggcgttggtctttgacgatgaggacaaatgccccatgctcaccttggcgttttttagttttagttccgtgtgcatatagttgtttagggagctgtcaagatcccatacagttgtgctttcggcaaatcgtcttgactttctttcatagaaagtggggcgcagatcgctgtaggtgaaaaagcgctggggcgaagttctgtctttatttagaaaatagtagatacagccagtgtattcgccactgacatttcttgtgcctataggcaggagttggagcgtcccctcatagtcggtgtattctctgcggaaggtgccgagcatttcttctgtgatgtcggcttttataagcttgttcatgctgtcagcatattcaaacattttgtgagtgaatacctgcggactgaatgaagctcgccttgaaacacagtctttaagtcggctgccaagttcacgcatttgtctttctgcctcagccattctcaaagcatggcaggaaactgcggcaagctcaaaattatcggggtcgctctcttcggctcttacaagacctcgggtaaatattccagacattatttttatgcactgttcggcacattcttttatctttttctgggtatcctgagaaagcgaatttatttcaggttggtcggggagttcaatttctgcttgttcaggctcggaggttatgacctctggagtgatatcctcgccgtcgtactgtggaagctgtgctttcaaaagcagtatggctgtgataatgtgcctgcacattcctcttgaaacacaactgcattgactttcatcaagtggtgattttatggtgcaggtttcaccgtctaattttactatgtaacattcatggattttttcagccgaaagggtcatgtttttggattccttcaacgcacgtttgtaaatgcccttgtttgaaagctcaataagcgtttgttcgtttgcaatgtcaagctgtttatcgatcacgtccaagatgtcatctcctatgcaaatatttttccgatgtaatccccaagcttatcaggggtaagaccgccaacgaatgagcccatatctgcaagcttctgacctgtcgccttgtcataggcagggtcggcattttcatcaagggcggtaaggaatgagagatgtgcgccgcttgtgattatatttttgctgacgttcataagctgtgcttcactgccaccctcgtagaggtctgttaccacgataacgcaagtgtcacggggcgtaatgataaggctttcgcagtaggtaagggcttttgcaatatccgtgcctcccccaagctgaacgctcattattgtctgagcagggtcgtctgcattgtctgagaggtcaacgatgcttgtatcaaatatgatgagcttcacctctgcaaatgccagttcggaaattatctgcgccattactgcactatagatgactgaaccgagcattgaaccgctttcgtctatggctatgataatgcgctttttgttatgctttttcacacgtccactgaaatagatatctttcagtataagctggttgcttgctttgtcatagtttttcaggtttcggcggatagtctttttgaaatcgaggtttgcagagcattttataactgacgatgtgtttttatcaagcctgcctgtaaggcttcgctttatggtcatatcaagcttttgtttgatatcgtctgccacctgttttgctatttttacagccgtctgcaacacctcgccgttcatgagatgtttgagctgaatgatagttttaagtagcgctatatcaggcttcatttcttcaagaacctttttatcggtaagaagctcggtcatgttgaacctttccaaagcttgacgttcaagcacatcggcggtctgctttggaaaaagcgttctgacttttgttatccattctgcggcgtttagcacactgccaccctgaccgccttgcctgctgttctcgtcccttacgtcatcgccttgcgcacggctatagagataatcgagtagcttttccatatcctgaaacgttattatctctgctttgtcacctgtaaaggaaaggcttttgtcagacattccgcccagcaccagccgccagcggttgacggatatggctttgtttttatctgtcatggcttttcctcctcagacaaaagtttgactatctctttatctatttccacaccgaagctatatagcctttcgtttataggtttttccgtaagaagctcagcactgtcagcgtcataaagctttgcggcagcggtggctgtttgctgtatttcatatggggtgaaacaactgaaagcaagcttcatggagggaagtatctctataaaatcgtcatagtcaagtccgcagataagcgtgtctgtcattctgatgaaagaatcgtccgtcatgatgatatcacgggcggcattgaaaagtccgtgaagaaactccgctccttgtatctgaacattcctgtcgcctttgagatagcttgacattgcctgttcagcaagcttgcggcggtgggggtcaaaggcgtaaagtatgccaagtgctgtgccgtaaacaaatgggtctttatcagatttgccgcagagggaaagcagggcgttttcatagtcctgacgatattctctaaagccgtcagtgacagctttttgcattgtgtacattatcgctgcacattctgcaatgtggtcgtctttcaccgatgccatatcaggcagtgctgtgattatccttgtcatacatcgctttgcacaattttctgcggcggaaaactcggtattataaagctgttggagttccataagagtgataaaatgccttagacctctgcctacagagaaaaagtcaccgtctgagttaagaatgttctcggcacaagccttgtcattatcagagagttctaagcccatttggaagcagtccacaaggatatgcgccgcaacatcacagtgcttttcatggcgaagtgttcttgaagcacaggtgcggcaggcttcttcaatggtgaagccgtcggcagtatggtctatgagtgcaacgtctgtggcagggacttttttgtatacccattcttcacggacacggcttctgtcttttcgcctatgtaaatcaggcccttttgttcgctgggcaaagtctgtgcctagaaacaccattctgtggaaaaatctgcttagttccatgccgtttgcagtggtaaaaagtgaaacttccgtcttattaggggttactgtttttattttaagtcgaaaccttttacactgtttttcaaaatcagcaataagcggaggaacgtggtttatatcacctatatgacctgttttgtcgcctgtggcaagtttgtgcataaggtcgataggcagggcagaggatattgttttctctcccttgataaatgacgaggttatggcgtcttcaagctcgtaaagtccacattcatgacagctacgaagtgcggcaagtccactcatcatagactgcgctgcggaagcgtcagccattgacactgggatatcatgtttatcacaggctctcactgtgcctatgagcaggtcaagaactgtgtcgctgtaaacacctgccgggtcatcacagtggattagcttgttcatcacgcaatcataaaaataaggacgctggataccagaggcatatccactgagagcgtctgctgcttcataagaataagctacggggaaacagccctcatctttttgagagagcttgtgaagcttttctttttggatattatcacttttcaaaagctcataaagtcccaaactgtggaatccgcctgttacagcaagaacttttttgttatctttaagtgcttctttgatacgcagagccatatggttttctcttgcaagagtgccgtctgccgcaagaccatcttctgtttcgtcatttcgtgtaataatgcagtaggtgtacatttgctgtacaaaatcttgtacagatagtctgagtccctctatctcaaaatacttctcccagaactcttcaaaggtccttagatctgttttctcgcaaagctttttgcagaatttgctgtatataagtctgctgtcatcagtgtagctgtgcttgtccttattactgcgaaggcctttatttacggctgtggtaataagtatctcgctgtagggaagatctataaagcgtgcttctatacccatggctgcggctgttttcagagcgttatactcaggtgaagcatagataaaagggtagtagcatttatagtcctcggcttcatcactgataagcttttttctgtccttgtagtaataatagaaagccgcagggagttttgttctctcgtccgtcaacacacctatcatatcattggcgttttcaggaccctctataagtatgacatcgggctgatatactttaattgctctgatgagctgccacgagcagacagggctgtggtgtcttacaggaaaaagcagaaatggctgagaatagtcaaaaggtattatttcagatacttggctgtatccagatattctgtccatatgcctccctcacttgcacttttttccttaacagcgatcctgaaatagcttttgagcttttcaaggtcgtctttgttttccttacaaactgctcctaaaagattctgcgtaagctctttgagatcagtttttccgtcaccataataatatgcactgctcatagtttgataaaaaacggacacagcttcggctgtactcataacggcgtttggtttttcaagctttgttccctctgaggtaacgccctcacgaagctcatgatatgtgacagcaagaagttcagcagcgtcggtgtctataggctggtcgatatgacctgtttttgcaaggtcttgtgcttcacggataatgatctctttttcgagccttacgtcacgaacaggctcgacagtctcaaaattgaaacgccttttcaaagcacctgacatttcatttacgcccttatcacgagtgtttgcagtaccgattatattaaatccttgcttggcgaaaacaagtccttcgttttcaagctcagggatattgagtatctggtcgctcattacagaaataaggctatcttggatttctgcaggggtacgagttatttcctcaaatcgtgcgaaaatgccttgttccatgcctatgagcagaggagcaggcacaagggcttcacggcacggaccttttgaaagaagcatggcatagttccagctatattttatcatatcctcggtagttccagccgtaccctgaactgtgttcgtgcttatgccgcagcaagcagcagagagaagctcagagagcatagttttagcagtgcctggctcacccaccagcataagtccgcggtttccagcgagggtgattatacagcgctcaacaagtgcgtcattgccatagaatttgcgctttatctgcattttgccatcggcagttttgatgattccgcctaatataaatgttcgcactgcctttggcgacagcacccaattctcaggctttttgccaatatcaacacttttcaaggcgtcaagttcatttttgtagcgtatctcaacgggcggttttatgtattcattcgtcatagcagttatctcctaaaagttaatttatcagcaataattatatcatattttgttgttatttacaataagcatggggatattcagctaaattgacaacgaacagatgttttgattgtgcattttgacagttaggatcgggtataaaaaaaccgcttcgcatttctgcgaaacggtttgataaatgagaatgaaattatctctttgagaactgtggagcacgtcttgcggctttgagaccgtacttctttctttccttcattcttgggtcacgagtgaggaagccttccttcttgaggagaggtctgaactcatcgctagcctgaagaagagctcttgaaagaccgtgtctaattgcaccagcctgacctgttactccaccgcctgttactgtgcaaacgatatcgtacttatccattgtatctgttacagcaaatggctgacgaacgatgagcttgagtgtctcaagaccgaagtaatcgtcaatgtctctgccgttgattgtgatcttacctgtaccctcgtaaacacgaacacgggcaacagaatgttttcttctacctgtgccatagaaatatggctgctttgattcgtacatctaaattgctccttccttacagttcgtatttaacaggcttctgagcagcattattatgctcagcacccttgtatactctgagtctctttgcagcagctctgccaagtgtgttgttagggagcataccctcaacagcaattgtcatagctctgtctgactgattagccatcatatctgaatacttgatctccttaagaccgccaatccagcctgtgtgccacttgtaagacttctgatcaagcttcttgcctgtgagaacagccttatctgtgttgatgatgattacatggtcgccgcagtcagcgtgtggtgcgtaagttggcttgtgcttgccacgaagaatgtgagcagccttagcagcaactctaccgagtgactgaccttcagcgtcgagaatataccatgtgcgagtaatgtcgcctgcttttgggatataagttgacatattatttcctccattcagaattttaaaaagtctgttcacagccgcatttttgccctgtgaactcacaacgttgtctattatacaacagcttttcacgattgtcaatagtcaaaacgtcgaatttttaatttatatccctcattctctttaattctcttcgttttgctccatttctctcgatttctcacaattcatttcacttttgccttttacactaatatacatagtaatatggcataaactaaagataatcatagtataagcaacgtatattcaatatttatctgtctacgctagaatatgtgcttatatgtctgtatttgcattttcggtatatgcttttcttctgcaccaaaattctgcaaaccgtctgctttactgtattttcagctttattcatcttcaaatgaaaaaatatcctctacagatacaccaaatacctttgcaatatccattgcaagctttagagacggattgtattgtcctttttcaagacgtatgatagtttcacgcctgacgcccactttttcggcaaggtcaccctgcttcatgtcaagcttggcacgatattccttgagttttgtttttagctccggcattactcgtcctcctcatcggtgctgagcttgccctcatggtggaggaaaaatccgctttcaagggtcatataactgaaccagaatataaaccatacttgatatagtctgtcgctgtttatctttatggttatagttccttcccagaacattgatataaagatcgctactgctaatattatcaaaaacatttttgtgatactttgatgtgccttgagcatattttcttttgccatttcatcctctttgtcaactttctgacagcttgcatacagccatattactgcaaataaagccgtcatagcagtcaacacaacgaatataaccgtcgcccatgttgtattatcaagcttgtaatgctccacagtgttttcaaatatctctgtgacaagtattgcaattcctgttaccatacgctttttgtgatattctctcagagttatctttttcttttcttttttcgctttcatttttatccctctagttctcatcatcatcgaacttactttcaaaatacagccctataaaattgtacaccgcatagcagaaccatatcaagcccgttataacatattcgtttagtgcgaccttaaatcttcctaaaatatcggaaaacaaagtcataactgaaataaacaggcaggcaatcgtgaacaggaacgttataaaagtctgattgacctttgctgttgtctgctgagtaagctcgtcatttgtatctcttttgccggccgtggatatcatctttgttatgcatatggcgatcagcgcaagcgttcccaaagatacgataaggtttatcacattggtaagtgtgtgccctttctttatcgcagtttgtgatttaaactgctgcatatacaaggtgatttatttatcaccttatgtgacaataatatcacttttgccttgcaaagtcaatagaaaagtgacaaatttatcacctttgtgcatatacacaaatcgtgccatatcagtttgtactcatttatgtacactgacaacaaaaaggcgctgtaaaaaaaagcgcaacaaagcccgtggattccctcgatatggaagcccacgggctttaatatatcacacagcaaaaaagaactatctaatcttgaaaaaagggtacagcaaacacagcggcacaaaaactgcgtttttgccgattattaaaatgttgaaaaatatctttttcaggctgcttttctgattgcgatcttcttcaagtggaatttatgcagattaaaaccacagcaaatcatcgcaatttctaaattcatggcatttaagccacgtcttctggctcttttttcgtgttttctaatgtgctgtcttaaatcagcttatctattatatcatattagctaagctttgtcaagacttttctttgtgaattctttatgaattcgtttgaactcttttgtgaagttcttttcgagctactccttaggtctctcctgttctcccgaaccttttaccttcgtttcgcttctttctttatcgcgctctctcgaggcgccttgtttattttatcacttttatgccattttgtcaaccccttttttcgctttctgctttttttacactttatttcccttttcttatctctttttgtccattttgctttgctcctttgttatcttgatacaaaaagtgacaactgagcgtcgctcagttgtcactttgctcggtgtttcctctattttgtgttaatgatttactcggtatggctccgccattcctcacttctcattcctcattaatcttaccgtttccgccattaattctgcagctttctgctttttctccaatgtcactgcaaaatacggcttatctccgtcaaaaaacctgatcctattcttataagctccatacaacgcttgtatctgttccacctctgcggttttcacaaagaacagcaccttatctcctctttgtgttatttcctttatgccaagctttgaagcagtatttctcgtaagtgcaacgttcaccaatcccagcactgatttcggcgggtcgccgtatctatctataagctcgtcgataacgtccctggaatcctcctcattgcctatggaagctatcttcctatagcaatctatcctctgtgacagattttctatataatggtcaggtataaatgcgtctatggatatatccaccaaacaatcctcaggtgacggtggcagagcctctcccttttgttcggctatagcctcatttagaagtcgcagatacatatcatatcccaccgcttccatatgtccatgctgtttaccgctgagtatagagcctgcacctcttatttcaaggtcacgcaacgctatcctgaagcctgagccgaactgtgtgaactctcttattgcatcaagcctttttgccgctacctccgtgagtaccttgccacgtctgaaagtgaagtacgcaaaagcacggcggtttgatcttcccacacgtcctctaagctgataaagctgtgaaagtcctaatctgtcagcgtcctctattataagtgtatttacattcggcacgtcaacacctgtttcgattatggtggtgcagacaaggatatctatttctctgtcgcaaagctgccgccatatttccgacagctcctcctcaggcatttgtccgtgtgcgaacgctatccttgcgtcagggagcatttcctgaagcttatttgcggtcatcatgatagtttccaccctgttgtggatataatacacctgaccgccacgtcgcagctccttgcttatggcctgcgctataacgcccatattatgctctataacataggtctgaacagggtgtctgtccataggcggttcctctatgaccgacatatctctgataccgctcattgccatgttaagcgttcttggtatcggggtagctgaaagtgtcagcacatcaacgcccttgaaagtttccttgaacttttccttatgggcaacaccaaaacgctgttcctcgtctatgataacaagacccaagtccttgaacttaacgtctttctgcacaagcctgtgcgtgcctatgataaggtcgatagtgccacggttcagctctcttattatctgctgttgctcctttggttttctaaacctcgacaaaagctccaccttcacggggaaatgctcaaatctttttatcgccgtctgataatgctgccatgcaagaacagttgttggcacaagtatagccacctgcttgttatcgagcatacacttgaacgccgcacggagagccacctccgttttgccgaagcccacatctccgcagagaagtctgtccattggggacggcttttccatatccgtctttatctcctgtatagatcttaactggtcgtcagtttcctgatagtcgaaacgctcctcaaaatccgcctgccaatcgttgtcaggggaaaaagcaaaaccctttgccatttgtctttgagcataaagctttgtaagctcctccgccatatcctttacggcagactttaccttgtttcgtgtcttagtccactccatagagttgagcttattgagcttcactgccccgtcatctctcggacctatatatcttgacacaaggtcaagctgagtaacaggcacataaagcacgtccgtgcctgcatattttatggtgatataatcctttgttacaccgttcgtttctatattttttattcctgaaaatctgcctatgccgtacatagcgtgaacaacaaggtcgcctgtctgtatatccgaaaggctttttatctcttctcctgccttatgacgggatttacgcttctttgcactcatggctttcatctgagtgatagccgcacagcctatgtcaggataatcaaagccacctgacagacagcccgtgcgcaggtatactttaccctttattatctcgctgtcctcagtgaggatctccgcagagatgccagcatcattaaggtctttatttataataggaagcgtcttttccgagcctgccagcacaacagtgcaatacccctgagcgcagagatttttcaattcttcttcaagattgatgatattaccgccccatgccgccgtttgtcggcagtcggtattaataagctttttgaacttcacgccgttgttagagcgcataaagctgtcaagaaacaccgacttcatttgtgttatttttagttccgcttgtggtatatcaagataaaagccctccagctttctgaaaagtatgccgtcctcataaagaagcttcatatcctctgaaagctgagcaagagccgccttgcccttttcgatacagttagtatactccgacacaaggcaaacaccgctctcaaagtaatcaaacactgttgtgagcttgtcatagcacacagtataatacttatcaagatttgtgagggtgataccgctctgagccgtttctatatcccttgaaatattcgttcttatcttatcggtacggcttccacggacagacttcgacaaggcttcaagctttgtcacaaggtcatcagtgtcagggaaaattatctccaaggcagggaaaaccgttatctcgtctattggttcggtacgtctttggctttcagggtcaaaatatgatatagagtcaacctcgtcgccccaaagctctattctcacaggacgtgactcctgcacagggaaaatatcggcgatagagcctctcacagaaaactgcgcctgaccctccacctgatctgttcttgtataaccgcctgcaagaagcttgcttgtaagctcctcaaggctcagttcgccccctgtttttatctcaaaggaaaactctttcagcttatcctgcggaatagttccctgcaagcaagcttccatgcttgcggcgattatcttgcatttgccctgagtgataagagagagagcctccagccttttatgctcatattctcttgaaacgccctccatgtatgcaaagttcaggtcttttgctggaaaaacgcaggcaagctgttcccctgccatttcgtttatatcccctgtcattctaatggcagacgcttcatcgtcgcatataacaaggcagggggaaagcctgctgagagccattgcggtctgagccttgtgtatatttgaaacgcccgtgaccgcacaaggggtaaaccctttgagcaggcagtttttcacatctttataaaagccaagacggctcgccatttcataaaaaatattcatcttgctgttctccgaaaaaaatatgcttaattgaacttgttcatagcctcgtttatcttgccctgcaccataagctccacagcctcgcaggtgtttttatccacatcagaaagctttttcatttcctcgtcagtgaatcttgaaagcacccagtcagccaagttgtaatcagggtgaggctttttgcccacgcctatttttacccttggaaagtcctgaccgccgcacagtgcgataatgctttttatgccattgtgacccccagccgaaccgtttctgcgtatcctcattttgcccacgtcaagtgaaatatcgtcatagaccacaacaacattttcaagcggtatatcataaaagtccatagcgtcgctgacagcctcaccgctattgttcatgaaagtttcaggcttcatgacaagacagctttttccgcctataacggcacgtcccacaagagccttgaacttatgtgtattcaccgaaaagccgtatttcttttccatagccgccaccgcaagaaatcctgcgttatggcgagtattctcataagccacaccgggattgccaagccccacgataatatactcaggcttgcccattgccgtttccctctcggcagacaatttctttaatttctcgaatatatccattgtaaattctcctatcttttataatatgtcagccccgacagcttattctatccacgcacaataaccccgtctttatgcaagacggggtataaacaaaagccgacattttactgtcggctttattatagcataggcaagtggatttgtcaaattcgagttttaatttttataaaccttttccatatcttctagttccttttttgctctgcctatgtcagcagaagaaattttgtcgttcacgatacgattattgcttttattcatcattttctgagttctctccacacgttccatttggtcgattattccatggatttttccgtaaattttattacgttcttcatatagttcaaggttagtttcactcaaaccatcgcgtaattcaaaattattatatgcccttgctaatgtattagatatgtgatttccctttattattatgcctattcctacgcacaatgccacaaatgataaaaacgtcacaaaagccccgatatccaataatatcattgagaaaaagcccgcaacagaaacaataataccaacctttacatacttaccgcctatttctctatatggacgttctatacatcttatcttttcccaaagcatctctttttgttttttaagttcgtctatatccgttatatcacaccattcatagtagggatctgacctgccggaaccaaattctggatcatggtcaatgcttactccgtaaatatcgtcattatgcacataccaacgttcatctgccataaaaaacacctctttaaaaaatctaaagcaagctagtctttggtgaaataatattcaaccccagcgttatccaatttatacaaaaccaattcgctgcttgttatctctttgattccaaaatctttagtataactaccgcactgagtatatatcctattatcactcacactgtatgaaccaacgtcagtagacccgtcctcagttattttcaaagttccgtcctctgcaaattcaaaagtacaatcgccatcagagctaaattctccgtcactagcagtgccataaatctcccaagtgcctataagcttgctttctgtacttccacagccagtacacataatcagaatgacaactgataaaaataaactcactaatttcttcataataatattacctccattgttagaatattagtacctataagtgctaacacatacataatatcacacaaatatggtaaagtcaatagtaccgaatggtactaaaacattttctgcaaaattaccaaaaatgagggtagatttttatgtattttccaagattaagggatttgcgagaagataaggacatgaaccaaacgcagatagcaaagcttcttttcacaagtcaaactgtttattcacgctatgaacggggcgttctcactatccccgtagaacacctccttatactagccgacttctatggcgtatccaccgactatatcctcggcaggacaaacaacaaaaagctaaacaaataaaagaccctgccttacaaaagacagggtcttgcttatatttgggtatattacttctcctcagacttgccgtggatagcctcgaacttttctgttctcgccttgagcttcttctcagcgtagccctctttgatagtctctctgccacgctcgatagcaagtgcgttgtcagggatatcagttgtgatagttgagcctgccgctgtgtatgcgcccttgccgactcttacaggtgcaacaaggtttgtgttacagccgatgaaagcattgtcctcgataacagttctgaacttcttgtcgccgttgtagtttactgttacaacgccgcagccgaagtttacatttgagccgacgtcagaatcgccgatgtatgtaagatgtgccaccgctgtgtattcgccgatagtggagttctttatctccacaaagtcgcctatctttgcacccttcttgatgtgtgaattaggtctgagctgaacataaggtcctatcttaacgtcgtcctcgataacagactcgtaagcctgaacattgttgaggtttacgccgtttcctacagttgtgttctctattatgcagttgttgccgatattgcagttctcgccgatagtggtgtttcctctgaggataactccgctgtgtatctttgttccatgaccgatagtaacattgtttccgatagaaacaccgtctgtgcagcagaactcgataccctcgtcaagccactttcctattatctcatatcttgcaatatcattgagtgcaagcagaccacgtctgtcatttgcaccaagcgcaacatgaggatttgcagaaataaatgcgtcagcctttttgccctttgcaataagcagctcgatgcaatctgtaagataatactcgccctgagcgttctctggcttgatgtcgaaaagaacttccagcaggtcagccgtcttgaaccagtaacagcctgagtttatctcagtgatagcaagctgcataggagtgcagtccttgtgttcaactattcctgaaatgccattctcagtgcggattattctgccgtagcctgtagggttctcaactcttgatgtaacaacagttacgccgcagtccttttcagtatgaagctccagcgcacccttgatagtttctgcatcgataaaaggagcgtcgccgcagagtataagtgtgtttccctcagcgtgagccttaagaaaatcagccgcctgcataacagcatgacctgtgccaagtcgctcttcctgcataacagtgcagattttagcctttgactttctctgtgcaagataatcctctatctgctgaccctcgtagccttttacaacgcagatatcgtcaagctctgcattttcgcaggctgtcagcacccactccagcataggctcaccgataacattgcacaaagcctttggcatattggtcttcattctcttgccctgtccaccggcaagaataataacattgttctccataatacaaattcctttcagatacgtcccacaaaataagacttggcactttcgcaccatttccttattattataatacggttgggataaaaagtcaacagttggttcatattttatcgcaatttattcttttgcttgacaacatattgcgacactgctataataaaatgtgtagttatcatgttcatatattgcagttttttctgcttcagatatgggggaaaatatatgcagaaacaattctatcctgttataggaactgaaaaagctctgccattttatatcatcggcataggcgtgagctgctggcagtttcctgtcagcagaccggagggctatgattatcctcagcttttcgtctgtcttgagggcgagggtgaggtaacggtagacggcaagaccgtaaaaataatgcctgacagcattttctatataccaccgcactgtccccacgaatatagagccacgactcattcatggtatcttgactgggtgtgctttgacggcaaacaggctctcgagctgctgaaagaatgggatcttaacaaatttcatgttttcttaaactgcggtgcagagcgtatgcacaagctttttgacagcgcatattacaccataaaaagcgacaaggcatacggcaactattatgcctccgcacagctttacgatatgcttcttgaataccgcaagctttcggacgataagttcccatacaagagccgtgtaaattccgaagccgtcgcaaaggtcatgaaatacactgaggagaattattcaaagcctataaagctcgccgacatggcagcggtggcaggggtatcagaacagcacctttgcagacttttcaagaaaaatttcagcataagaccaatggaatatttaaacacagtgcgcataagccacgcaaaggagcttcttacctactcctcaaagacagttgcggagatagcttcggaaacaggcttcagcgacagctcgtatttttatgttgtattcaaaaagcacgagaatatttcgcctgcggaatacaggaagataaaggcataaggtggcaataaatatggaacaaaaatatatctattccttttctcagatagaggataaggtcaaagctttgcatgaaaccaatactgaggctgctgcagccgttgccctttcatggctgggtctgagccgtgatgagcttaaaacactcagggtatcagactacaacagcacaatgcgaatgctccactctgcaggcagagtggtgtacgtccgtgaagatcttatagcagatatgcttaaagctatatgcgaggaggctcctgaatacagcatgggctttttcatcacagacgtgaactctgcatacgaagccgcagaaaagcaggagctttcccctatcagcgtgcttaaaatgagatacttttacgaaaagcacagtgcaaagctttcaggagagcctgaggacagagtatttctcaaagagatactgcgctcagttggcgaaagcgaagctgatatggaaaagcaattcgccgaatacgaaaaggacgcacctgaaaaaatatagaccattgccactgcacaaatacatcgtctatatgtagttcatttgcctacacatctatttgttataattcacaagacggctttcaaagccgtcttttttatgtcctaacaacaaaaaaagagcaaaaccgaagttctgctcttttgtaaactattctattagtctatcagatcgaaattagatagaagaatggctctttacatagtcaacaacagcgtcaacagttgtgtaagcaagacctacgcaagtgtcagcacagccgtagtaaatagcaattctgcctgtctcagcgtcgcaaagtgttgcgcatgggaatgttacgttctgaacgtcgcctacgcactcatagatctctcttgggttgatgagatactcgccgcatctgtacttaactttccatggctgctccttgtcaaggatgcaagctgagaagctgtatacaaagccgttgcaagactcaagaacaccgtgatagaagcagagccagccctcgtctgtctctattggaataggacctgcaccgatcttcttggactcccagcccttgagaggtcccataacgtgtctgtgctcgccccaatacttcatgtcaggtgactgtgaaatgtacatatcaccgaatggtgtgtgacctgagtcagaaggtcttgagaacattacatacttgccgtcgatctttcttgggaagagtacgccgtttctgttaaatgggaggaatgcgttctcgcactgatagaatgtcttgaaatcatatgtatagcctacgccgatagttggcttccagccgtatgcattacaccatgttacccaatatctgtcttcgatgaagcatactcttgggtcataaccatagccccactgatttacttcttctgtagacttttcagcctgctcgaacatgatccttgttgggttgatgttccagtgaataccgtcctcagagaaaccagcatggagagccatgtttctttccttatcgtcaacacggaatacgcctgcgaacttgccctcgaaaggaactaccgcactgttgaagatagagtttgatgtaggaagaagatttctaggaatgatagggtttctgttatctctccagatcacttcattgcagtcagccggcttatcctgccaaggcatatttgggatagcctgtccgttgattactttaacgctcatgttaaaatccacctttcataatataaaaaaatactgaggctgaccgtcaggtcatgcccttgtttttattcttcccccgaatagaaatgcgaaacttttcccgcttattcaaggcgatatcattcggcttaccttatcggtaaaatgccgctgttattattaaaacacactttcagaaaaatttcaagcccctatttttgctgaaaacgtttaaaatttatatgtaaacgtattcttcttaaatttaacattttattaacagtttgcttagtttcatatttttgcatcgcactaaaaatatgcgactttatccgcctgcacgtccgttctccgcccagtccatgataaaaatgaaatatcaggcagtattttgaatgtaaattataaaagttgcccataatgactacattggtataagcatattcgtgcaagtttctgattttttgcaagaatagaaaaaagcacttgcaaaaacagtgaaaagggtatacaatataagtaaggatatcggatacgttcggcagagtgcggcgaaagtcgggatttgccgaattgttctgtataatagtgtactataatttataatttacaagtggaggacattgatatgaaactaacagaaatgtctgcagaggaactggcatcattcaaagcagaagtccagaaagaatatgacgatttcaaggctcagggactttcgctgaacatggcaagaggaaagccgtctgccgaacagctcgacctgacagaaggtctgctcacagcagtaaagagcagcgaggattgtttcgctgaggacggcacagattgcagaaactacggcggtcttgacggtctgcctgaggctaaggcactttttgctcctatgctcggcgtaacacctgatgagcttatcatttgcggaaactcaagccttaacatcatgtatgatactattgcaaagttcgtgctttttggcacaggcgacggtgagaagccttggaaggacacaaaagtcaagtggctctgccctgttccgggatatgacagacattttcttataacagaaaaaatgggctttgagcttgtaaacattccaatggacaaaaacggtcctgacatggatatggtagaaaagctcgttgctgaggacgatactataaagggtatatggtgtgttccaatgtatgctaaccctacaggcacaacatactctgacgaggtagtaaagcgtcttgcagccatgaagacaaaggctaaggatttcaagatattctgggataacgcatattgtatccaccacctttctgatacacctgacacactgctcaacattcttgacgagtgcgaaaaggcaggcaaccctgacagagtttatatgctcgcatcaacatcaaaggtaacattccctggtgcaggcgttgcaatgatagcttcatctgaaaagaacatcaagtacctcaaatctatgatgacagttcagactatcggctatgacaagataaatcagctccgccacgttaagttcttcggcacatacgagaatcttatggagcatatgaagaagcacagagctataatcgagcctaagttcaagatagttcttgacactctcgaaaaggagatagcacctctgggaatcggaagctgggagaagccaaatggcggttactttataagcttcaacgctcttaacggctgtgcaaagagaatttgtcagctttgcaaagaggcaggcgtagtcctcacaggtgcaggtgcgacatacccttacggaaaggaccctgatgattcaaacatcagaattgctcctacattcccgcctgagaacgagcttaaaattgcagccgacgtgttcgctacagcagttaagcttgcaagtgcagaaaagcttcttgcagaataattcaacaaagtcaagataacaatactctctatataaaaaaagcgatgaccttgcaaaaggctcatcgcttttttgtttgcctataaagcaaaagcggtatcgacctcctaaaaggtcataccgcctgctatggtaaggaaattaaaggcaacaccgcacaaggcacgcctgtcggctttgcacgcaatctgcttgcagattttccgtcatatagcacagaaatttcttgacatacgtcagtattcctgcaaaatttctgcactatctgacaaaaaatctgactgcgcatcttacgcacaatccttgtgcggtgctgccttaaaatagaaataaagcttattcttttacagctcccgaaacaagtccgctgtaaatgtacttttgcagtaagaggaatataataagagtcggaatgatacaaattacgattcccgcaaaaactacctcccactgtacagaagtggcattcataagattgtaaagcacagttgagataacaacgtggtcatcatcaggcatataaagctttggagtgtagaaatcgttgtagataccaacgaacttgatgataagaactgttgctattgcaggcttgaggttagggagaattatgctgaaatatacccttggataagaagcaccgtccataatagcactttcgtccagggaatatgatatctgtcccaaaaactgaatgaaaatatagatagaaataatatctgtaccgatattcaaaatgataggtgcaagcatagatctgtaaagaccaagcttgtaaactatctggaataccgttacctgcattgtgatattaggcagaagcgttgcaataaggaacgctgtctttactactcttgaaaaataggtgttgaagcgctgaacgacataagccgtcatcgtacctgttattatcgaaccaacgcatgatacaacaatgattatagccgtgtttttgaatgcaagaagaatgttctgtgtaaaaaacgctgtctggaagttctcccactgaggcacttccggaagagtgaacaccgtggtgtttgaaagctctttgtaggttttcagcgagcctatgagtacaacaagtatcggtactattactataagacagcagagtataagaaaagcatacttgataatgttcagtacccttgagccgatataaagcggctttgaatctttgttttcattctgtgccattatttcacagccccctttctgctccttttgttctccttaggggtcttgtcgtcctcacggaagaagtatttttgtatgaacgttacgattatcgttatgataagcagcacgatacccattgccgaagcaagacccacctttttcagcgagaacgccgtgttgatagtcttgataacgaatgtggtagtgcccatcatgccctttgttgtgatatatggtatctcgaatactgagatagcaccctttacagcaaggataagctgcaatgagatgataggctttatgcttggaaatacgatatatctgaagttctgccatgggttagcaccgtcaaggtcagccgcctcgtaaaggtcagggctgatagactggatagcaccgatatacatgatgatatcaaagcctatgtatttccatatggaaatgaacaccaagcagcagtttgcaagaaacggcctgtcaacatcgaaccacagtatcgggtcaaggcccagtgtggtaaggatagtgttgagcgttccgtcaggggtaagacccttttgacctttgaggaaaaatctttggaatatgatagataccgcaacgccgttcataagataagggaagaaaagtattcccttgaaaagtccctttgctcttatctttgagcagaggatagacgccagcagcaaagccagtgcctgctgaatgaatgaaccaacaagataataaaggctgttcttgaaagtttcaagatagtccttgtcggtgaatatcgttacataatttgaaaagcctgcatatgtagggttagtgccgtatggatctctgttctgaaaactgaatatgaccatatccagagcagggataaaggtaaacgttacaagcaggattatcggcagtgcaagaaacagtatagaagtatagaactttttacccgcataagtctttgaccactgtgcaatgccttttctattgccgttttgcatttgaggtcctcctgaacacaattatcaggcacaggaacaatgcctgtacctgataagggatttatcttagatcttagccgagaactttatctcttgcagcagcccacttcttgtttacatcagcgatgatctcgttgaaaccgtcgtcgcccttgcctgcgaatgctgcctcagcaagcttgatcttgaagttgtcctcgtcgccctgccatacgccaacgcctgactccttgtcgatctcgtcgaacttaccaacgaggtcatccggagcaacagccttttcaaagaatacagcgtccttgaagccagacagcatgcttggaagctccttgttctgaactgttgagatcataccctcctgctcagagaaacctgaatcagagatgaaccactcaacatatgcctttgcaagatcctgattcttggagtttgcacttacgccgagagtatagtcaggaccttcctctgcgtatacctttccgtcagccgctgtgacaggaacaggcatataaccgatatcgtcagggttctcagcctgttccatgaactgtgaaactgcccatgaacccattaccattgtagcgatcttgccctcaccgaaccatacctttgatgattcccactctgtgttagcgtggtcttcttcaagaaggtcaggctttgagaacagatcatacatcagcttgtatacttcataatagccgttgccctctacaaagaggtcgctcttatcctgaagaagcttgttttcagcttcagcaccgcctgctgctgaaagaacaaggttctgccactgagtaatagtccagcttgcgtccttgaagtttgtgtagtaagggatagcgtctgtgttatccttgatgagctgaagatctgcaaggaactcgtcaggagtcttaggagtttctgtgataccagcctgctcccatatcttcttgttgtaaagaacacctgtagctgttccgcctactgcaagtccgtaaacattgccgtcagccgtcatcttcttgtctgaccagcgatatgtgtccttgaactcatcataagttccgagagatacgaaatatgtaggaagttcctcaagcttaaggcttgaagggatacaaagaacatcgccgtaatcatctgtacccattcttgttgctacatctgtatcgtagtccttgtatgcagtgtattcaactgtgcagttgtaagcttcctcaaacttgtctgtgagagcgtcgagcttgccgtcctcttttctgtcagttctgttcgtaagaacttccagttttgcaccctttgcgtcgaatgagtctttgatatcagcctgcgatacttcaggtgtaacagccttgctgcttgaatctgtagagcttccgcagcctgtgaacgcactcattgttcccattgacaaaaccagtgccattgcaccggcacatatcttctttgctttcatacttgataacctccgaattagcttaattttattaagtaaattaatttgtcttcaacgacaatattaagtatacatcctaaataatattaagtcaatatctttttagaaattaatatctttttaatcgcaaatttgtgaacaaatataaacttaaggacttgaattttagcaatatgcacaaaaaaaatagcgacagtcttaacaaagactgtcgccaagatcagacaaccgacacaaccaacggggtcatgccgcaaacaatagaaaatcatagattagaaaggtgcacttaataagtacagttatattataacttaaaattactcatttgtcaatagcaaaataaaaaaagatcagcaaccgccatgctgatccttttgttatattcgctaataaaacacctatattctctttacagagtcctttataacgaggtcgccctcgatagttcttatcctcggcttgccgtcaggttcttccattctatccataagtgtcattaccgcaaggtccgccatataatctgcgtcaacgtttatagtcgtgatagtcgggtctgaaacttcggagatcaaatagttatcatatcccacgatggaaatatcctcaggcacgttatatcccatgccacggagctgtcttattgcacggtaagccgcctcgtcgcagttgcatacgaaagccgttggcatatcgtcctcagggaaagtcatagtgataaaatcacgcttgtaacgatcgtcgatacgccacttttcgttgacctcatagccatgctctatcatagcctttacatagcccatatatctgtcaaaaatactcgttgtggcaaatttacttcctatgtatcctatcttcttgtgacccatttttataagatatgaagtaagcttgtagcctccgctgtagccatttgtcacaacagcgtccaagtctaaggacggcacataataatcaagcagtacaagatctttcacattgtcattaagaagctttgcataattctttgaaagctgtcccagtgaaataagtgctgaaacctgcttgtcctcgatacaatgcgggagcatgagcctgtcctcatcctcctgatccagattttccattatgcagaacatattctcttttttgagccttgttacaatagcgttatacaatgcccaataaaatgaaccgttaggattaatgaattttgatgggataagcacaccgatagtattacctcccctgttctgagtgcttttcacgcccacataacccatttcgtcagcgacctgctttatcttctctctgagggcatcgctaactccgctttttcctgcaagggcttttgacacagtgacgttacttgtgtcacaggctttagctatatctataagtgtaactgctttcttcaaaattctcaccgctttttctacttaataaacgccttaaaataaactctgataacgttctcatttaattatatcattttatgacataaagtcaatagaatattgcaaaatctcacatttgaacaaaaacgcagaccaaaatcagttaataatgctctctacaggagcgttatccctctctctttgcagtctttttcgctcaatgagttttcttattatagtgcagatgagcagagtcgctgatatgacagcaacacctattataggataaaatctccacatatattccttatccatattctgcaaagactgatctacagccgaattgctcagcttgtcctgtatcctttttataagatatccgcccgctttaagaaacgatatcatgcccccaaggctaagtataaaggaaacgatatattttttgaaaaacgcaaacaatattcctgcaaacatgacaacaacgcctgccgccattgcccacagcacccactttggcggaacgggctctatatacttgcccatgatgcccacgatggttacaccaccgtagaaaaatcccgaatacgcaaacggcactatcataagaagcttcaaaataagataataaacaggctcaccgtttggttttgtgcgtttcgcctttttcatcatctttttcgccgaacggctctgcctttctctggcttcctcacgctctctctgttcttcaagctcctcttcttttctgagcctgtcctgcttttctttctgtgctttaagtctgtctttttttgacataatgtacctcttttatgtattaaaatattatcgtatcatagtgttctcatcagatattttattatatcatagtatgccacgaaattcaacacatacaaatgaatttttcttcctttgcactgttaagaaggcagaataaaattgaaaaaggctttccaagacaaataatacttatgccgacggctgaattaaatttctagacaggtcaacaataaaagcgaaaagaaaaacagaaaggaacgtgaaaaaaaatgtcgtcatttttcaaaaaaacagcctgcgtcacagggataatactgctggggctgtttggtcttataggattttattccacaacactccccgatttctaccttgtttcaaagggcagcgagcttagcgtgaactcctttttcaccatatcctcaaaaccctgcgaaagcaaggtgacagtggcggtgtcaggcggttcgtcaggagcgtcacgatacacaaaaaatatgctcatgctttttggggcagtgccagtcaaggaggttgaatcaaagacaatggaaagaccaatgctttatccctgtggacagccattcggcataaagcttctcacagagggcgtaatggtagtcgatctgcaaaaggtggattcttcaagccctgccaaagattgcggtataagagagggcgatgttatagtatctatcgacggagaaaaagtcaaaagcaacgcagacgttgcaaagataatcagaagctcaaacggtgaagcctgctcagtgcgcataaagcgtggaagcaacgacctgaccttcaagctctgcccacgccttgagaacggaagctacaaagcaggaatgtgggtgcgtgactcctccgcaggcataggcacgatcacattctatgaccctgaaaacggaactttcggaggtcttggtcaccccgtatgcgacgcagacacaaaagaacccctccccctctccgcaggcacagttggcgaaataaacctcacaggcttcaacaaatcacgctcaggctgtccgggacagcttttaggcgagtttgcaaacgccgcctccacaggtgatatcctgaaaaactgcgaaagcggcgtgttcggcacactgaatgcaaacccttgcccaaatgcaaaagagtttcctctcggcttccgtcaggaaatacaccccggcaaagccaaaatactctcctctattgacaatgacgggccaaaagagtacgaaatttctatcgagcagataaatctctcagattctgccgagcatgacctagttatcaaaataactgacaagacgcttcttgaaaaaacagggggcattttgcagggcatgagtggctcgcctatcattcaggacggaagactcgtgggcgcagtgacccatgtttttattgaggacaccgccaaaggctatggaatcttcgctgacgaaatgtattcaaagacctcagagcttgccgaaagcaccatagaaaacgcaggttagcgacctttgccgatcgctgtcgatttatgaaaaggctttgcatagagaaaaatatcatctgcagtcgaacaatgcttaattatcttgttttggcatattcacgcactgatatttgtacactttgcattaataagtcgataatttgttgacgatttttctaaaaaactattgcatttaacaaataaatgtgttatcatttatcttgtgaaagggagttaaaacaaacgctctcaaacaaaaatgacagattatacgacggaggaaatgacaatgacaaacaagatcaaaattcttattggcgacgattcggcacagtacggggtagcatgtgcttcctcactgagagcaatgggttttttcgtgataacacgtcccaaggacggacttactatctatgacgctatcaaaaacgaacagccggacgttgttatcgcagacgcagtgatgccgagccttgacgcaatcgagcttatcagaaagatacagaactcgtcctatcagaaaccgctttttataatcacaagcgcctatgagaactcattcatagaaacacaggtcatgaacgcgggagcgtcatatttcatgctcaaaccattcgacataaagatacttggcgagaggataaagtccatgctggatatcgacaccgatatatcctccgactcaagctatacgaaaaacaaacagagcataaaccttgagataatcgtcacagacataatccatcagataggcgtccctgcccacatcaagggctatcactatctcagggaagctatcatacagtccgtgaacgataaggaaatgcttgaaagcgttacaaagctattatatcctgcagtggcaaaaaaattcgcaactacgccctccagagtggaaagagccatacgccatgccattgagatagcatgggacagaggagatatcgacaccctcaacagctttttcggctacacaataaacacaggcaagggcaagcccacaaacagcgaatttatcgcacttatcgcagacaaaataagccttaaattcaagaccaccatggcggtctaggggtcataagtcatatatgcaaaaagagcagaacgcattttcacgttctgctcttttgttacttgttgataaatgtaggggcgaacagtgttcgtccgtctttgttcgcctgctaaatttgcaataagacaaactttttcgctttgggtgtgacgttgcatttccgaacacaggcgacctcaggtcgcccctacacacaaaatacaaaaaagagggcgaaaatgatccgccctctgcattttcatattatcacagctttatctcttcgctgttcttttcgtccttgctgttgtcatgctctatcctgtcacggtgagtttcaagaggagccgaatcctttacgccctcagtggcttctggtataaagcaggtctttaccgtcataaagaatattctaagatcaagcataagcgactgatgctctatgtacataaggtcaagcttcagcttgtcataaggcgtagtgttatactttcccattacctgcgcatagcccgtaagtccagccttgactttcagcctgtatttgaactcaggcattgttttttcatacttctgcgcgatctcaggccgctcaggtctaggccctacaaacgacatatcgccctttagtatgtttataagctgtggaagctcgtctatccttacttttcttataaacttacctataggagtgatacggctgtcatttttctttgcaagggtcgcaccgcttttcttttcagcgtcaactatcatgcttctgaacttgtataccttgaacaccctgccccccgttgtgagccttttctgagaataaagcacaggaccgccatcataagcctttattgcaatagccgtcactagcataaacggtgacgccaccaccagtgcggcagccgacagcacaatgtcaagtatcctctttatcgcacgctgttcccagcgcaagccgtcatttctcgccaacaaaaggggcgtatcgaaaaggtggaaatcctccgcaccccttacgataatatctgacagcttagggtttatataagtcctgatagaattttcaaaagtaaatttcaaaagcttgtttctcaggtcatttgggatatccgatattataacagcctcgtgttttaatatctcacgctcgatatcctcaagactctcctcacagcttatagaagcgcatatcctgtatttgtcatttctcacgctcatttttgaaacaaggtgcttagcgttcttgtttccataaacgattatcattcgccgtggagggtataccgcctgatatatccaagtgaaaacatagctccacgcaaaggctatgaccacctgaattaccgtcataacaagtataggcgctacgttgagcctgcctcgtccgataagagaaacgagtataaattctataaaattcgcacccagcacacccagcacctgcgagccgaaaagccccgtgaatttatcatatccaagacggaagccgttaaaggtctttgccatggatatatagagcaccgcatagatagccaccataagaatgttaccattatgccagaacgggtcacgcatcgccttgttgtaaaagttgttccaaacggtgtcgaagcacttcataaaggcacagattataacaagtgcgctgagatagttaagtatctttttgaactgatctctgttattcaacaaaaaaccgcctttctctgctgtttttgttatctgctcaatgagtaaagtatagcatacttttcgccaataatcaagcattacacacaattttcaccgactgccacctttttcagcctgatttttcaagataatacctgtatctccattcgatatagttataagctatgatagaccataaaataaaaattattgatttactaggaattttgtgttataatatactttgcagaaaaataaaaaatatatttttatatagataacagaaaagaggaaaataaatgaagacctgcgagcttttcaagaaaaagacaacattatcctttgaggtgttcccaccaaagagttcaacgcctgttgagagcatatacagcaccatatcacagctccagccacttaatcctgattttatcagcgtaacatacggagcaggcggaagcacgaacaatgcgactatcgacatatgctcggctataaaaaatcaccacaagatagagtcggtggcacatcttccatgcctttatcagacaaaggaacgagtattagaacagcttgaagagatgaattctgcgaatattgagaacatacttgctttgagaggtgacagaaaccctgattttgagccggcaggtgattttcactacgcttccgaccttgtatctttcataaaagaacacagcgacatgaacgtaataggcgcatgctatcctgaatgtcacccggagtgcgacagcatagtagatgatataaagcacctgaaggataaagtagacgcaggctgttcacagcttatcacccagcttttctttgacaacagcacattttacgatttcagagaaaaaacagccatagcagggataaacgtgcctatcgaagcaggaataatgcctgtgaccaacaaaaagcagatacttagaatgacaactctttgtcatgcgaccctgccgaagaagtttctgaagataatggacaaatacgagaacgacccaatagcaatgagagatgcaggcatagcctatgcggtatcgcagatagtagatctcatcgccaatgatgtagacggaatacacctttacaccatgaacaatccatatatagcagagaaaatatgtgaagcggtgaagtcgcttttctgatttacacaaacgcaagggcgctgtaaaaaaagcgcaacaaagcccgtggattccctcgatatggaagcccacgggctttaatatatcacacagcaaaaaagaactatctaatcttgaaaaaagggtacagcaaacacagcggcacaaaaactgcgtttttgccgtgttaaaaatgtggaaaatattttaaatttatgccgctttttttattgcaggctttttcaagtggaatttatgaagattaaatccaaatgaaaagctgcaattagttacttaacattattttttgagaagatgtgtcacctatcattgacaactgaacaaaaatttatcaaaatatccttattcactattgattttttgaatggggtgtgttaaaatataagagttgaatattctattgttaagagtatgtgaacatttgttctttttatagaccgccatagcctgcattatatgggcagatttaacgattgcttgggtgtatgttaaatgattttaaccaaatcgttgaaattcttgctttttgcttttattttgcctgtggctgtggtataataatctgagcgtcggcagagagagaagccgacaatctcgttaaggagtgtgtaaacttggagaagtttgttatacatggaggtaagccgctgcatggtactgtgcagataagcggtgcaaaaaacgctgctgttgcattggttgcggcaactatcctgtgcgacgagccgtgcgttcttgagaacgtgcctgagataagcgatataactaagtgcatgaagatcctgcgtgaaatgggcgcagaggtcagacttttagataaaaatactatatattttgacacaaagggcattgaaaagcctgaagtgccatatgagcttgcaagaaccatgagagcgtcatgctattttcttggcacactgcttggaagatttcacgaggcttttgtgccgatgccgggcggctgtgaccttggcgacagacctatagatcagcatttgaaagctttcaaggcgcttggtgcgtctgacgagatagtgaacggagctaatcatgtcacagcagacgagcttgtgggcaatcagatatactttgactttgttacagttggcgcaactatgaatgcaatatttgccgctgtaaaggcaaaggggcttactataatcgaaaatgcggcaaaagagcctcatatcgttgaccttgcgaacttccttaactcaatgggcgctgatatcagaggcgcaggtactgacgttatcaagataagaggcgttgattacctcaaaggcgttacctatgcgactatccctgaccagatagaggcaggcacttatatggtagcggcggctgccacaaagggcgacgttgttatcgcaaatgttatccctaaacaccttgagtctattacggcaaagctacgcaaggtaggcgtaaacgttgaggaaagcgacgagagcgttcatgtttgggtggacggtccgctcgtgaaaacttctataaaaactatgccgcaccctggcttccctactgatatgcagccgcagttctcaacactgctgacgcttgcagagggtacgagcatcgttacagacgatatttttgacaacagattcagatatgtggctgagcttagaagaatgggcgctgacatttctgttgacggcaaggtggctgttatacagggcgttggcaagctcaaaggtgctcctgttgtggcaactgacctgagagcaggcgctgccatggtgatagcaggacttgccgcagagggcactactgaaatagacaatattttctacatcgaaagaggatatgaaaagatagatgagaaactcagagggcttggagctgacattcagcgtgtttacaagcctgacgctaacgaaatggaacttagcggctgataaatatcgataacactgcggcggcatattatttgccgccgttttttacagcatttgagaggacatgatatggagctttttatttccgaccttgacggaacgttgcttaacggcaatgcagaggtgacggagttcacaagagacactttgaacaggctcatggcaaaggggcttaacttcactgccgccactgcaaggacgcttgcttcagcaggaaaaatactttcgggacttgacctgaagcttcccgttatacttatgaacggcgtgcttatttatgatatgacggagaaaaaatacgtcaagataaacagcctttccagggagctttgcggtcttatcataggtctttcaaaagagcttggtttagaaccttttatgtactcggtttcagataaccagctttccacaagatatgagaggcttatttctcctgctatggagagcttttacaacgaacgcagagagaaatattacaagtctttcacgcaggtcagtgacctttctcagtacatcgacaatgtgatatacttcacatttattgcagaaaaagaaaaacttgtaccgctgtatgacgctcttaaagaaaatgaaaaactgaacatcacatactattatgatgtttatgaccccaagctttggtatcttgaagtgttctcttcgatggcttctaaggagcaaggcgtgaggtatcttcgtgagaattacggctttgactttgtcacggcttttggcgacaacaccaacgatctgcctatgttcaaggcggctgataaaagagtggcggtaaaaaacgcctgcaaagaggtgcttgaagactgtgacgaggtgacaggcacaaatgaagaagacggtgttgcagagtatcttctgaaaacttttgaagggaattagttatggcaaggatatatccacttttttcatcaagcaagggcaacagctcttttatcggcaacagtgacggcgggatacttgttgacgcaggagtatcctgcaaacgtctttgtgaggctttgaaagctaacgagatcgaccctgctgtgatacagggaatttttatcacacacacacattcagaccatgtttctgggcttaaagttctcacgaagaaatatcatatccctgtatttgcccaaaagaccaatcttgagatacttgtatctgacggcaaaatagacccagcctgtgatgtcaacgaggtggacggcaatgaagtgtgcataggagattatgccgtaaaaggttttgccacatttcatgatacccctgcaagctgtggatatcagataaagacccctgacggcaagcaggtgtgcgtatgcaccgaccttggcactgttacaaatgaggtggatatgcacctgagcggttctgaccttgttttgctggagtcaaattatgatgagtcaatgctaaagaatggaccttatccatacgagctgaaaaggcgcatcgcttcagaccacggacacctttcaaactctgcctgcggagaacagctaaaaaagcttatgacagcaggtacatataaatttattttagggcatttaagtcaggaaaacaacacgccttttcaggctgaaaactcggctgtgggagcacttggggattacgagcgcaacagcgactatattttacatatagcaaagcctgagggcagcggaatggcggtggcattttgataaggataaatcttattacagttggaaagctgaaagaaaaatactggcgtgatgctgcggcggaatactcaaagcggctgggggcgttctgcaagcttgaaatagttgaactgaacgagtcgaggttatctgacaacccctccgaaaaggagatagcggcggcgcttgaaaacgaagcaaaagccatgaaaagctacactgacatcaagggcgcatacaatattgcaatgtgcattgagggcaagcagctttcaagtgaaaagctgtccaaaaagctcagcgaatgcggtctgaacggattcagcacagtgaatttcataataggctcttcattcggcatttcccctgaaataaaggcgaaagctgacctgcgcttgtcaatgtcggagatgacctttccgcaccagcttgcaaggataatgcttttggagcaggtttacagggcttttcagataagtgctaatactaggtatcataagtgaatttcggatatgacaaaaccgtcctttgtgcctgtcatgtagtgatgaacatcaagattgagcatcttattgttaagttcaaacagctcactttcggtcttgctggtcaaaaaaatcattggcattgataatttcaaggacaggcttaaaacggttgataaaaatatcgttcagcttgtgtgcacagcttttgctgtccatagaatcatctgtaattgaaatatgaggattccttgacttagtataataataacataataattcagtatgctgcggaggtataacatgaaaaaaatatcaatggtaataaatgcagacgacaggctcggacatatcgctccagagatatacggacatttttccgagcatctcggaagatgtatctacaatggtatatatgtgggtgaaaattcacctattccgaatacagacggaataaggaatgatatcattgaggcgctcagaaatataaaagctcccgttttccgctggcccggcggctgctttgcagaagaatatcactggcaggacggtatcggcgaaaaatctcagcgccgaaagatcgtgaacacgaactggggcggagtcacggaggataattcttttggcacgcacgaatttatgcgcttctgtgagcttgttggctgcaagccttatataaacggcaatgttggcagcggcagtgttcgtgaattatccgaatggatagaatatatgacctcagatgcggaatcacctctcacagagcagagaaagaagaacggcagagccgagccgtggaaactcgaatacctcggtatcggcaatgaaaactggggctgcggaggaaatatgcgtcccgaatattacgccgacgtttataaaaggtatcagacattctgccgcaattattcgggaaacagactttacagaatagcctgcggttcaagctctgccgactataactggacagaagtcatgatgaaaaatcttgacagcaataatgttgatgctatcgacctgcattattatacgatgccagtatggcccgaaatggagtctgccaccgattttgacgatgagctttattataaaactatcgctgcagcgaacttttccgatgagcttatcacaagacattcggagataatgaaccgctatgatcctgaaaagaaaataggacttgtaataggagagtggggctgctggcataaggtagaagagggtacgaacccgggatttttatatcagcagaatacaatgcgtgatgctatcgttgctgcaatagagctgaatgtttttaacagacacagcgaccgtgttgtaatggcaaaccttgcgcaggcggtgaatgttctccaatcggtcattcttacagagggcgataagatgataaaaacgcctacatatcacgttttcgacctttttaaaacacaccaaaacaacgaggcagtttactgctatacgcagaacgaaaatatgtcggaaggtaaaaatgctccgatgatctcggtttccgcatcggtgaacgaaaagagtatgaccgttaccgccgcaaactgttcgcttacggaagaggctgctgttgaatgcagcattttcggatttaaagcatcatcagtttcttgcaggatacttacaaacgaggcgcacagctataacgacttcgactgtcccgacagagtgagcattaccgagcatacggcagtcatcaaggacaatgtgttaaagctgaatattccgccttgtgctgttgtggaatgtgttgttgactaaatattggggcatattcacagtgcatttcgtctttataataaaaatataagcataagagctgcgtttcattaaagatgcgcagctctttgttttataaagccataatatgttgggcattgtactcgcaaaaaaataatacataaaatgggcttatgttgacaaaatgtgaatgtgttcacatttaggattttctccttatgtgctacaattgggcaaggaggaaatcgaaggatttgtcagcatgacaaaaccgccgcaaccaaactcggttgcggcggtaattttatgctatttcgtttctagttttaggcttatcatcaataaaaagcacttcgtcactatcattttcaagtcggttatatatatccgacttttacatcaaaaaataagaaaacaagcatttttcggactttttttatttcattcattcaaaaaccaattcttcgatgtgtccccgtcgaactgttaaggtcgatgttttcatcgtcaatataatccttcacatcagaaagaatgatattggtatccgagctttcttcctcgtctgcacgaagattctggttcattatcacctgttcaagaatatttcggacagtacgggcattcgcaaagtttggtcttgccctgtaataatcggtaatatcaagcacaagcacaagtgcgttatcgtcaatagtgtattttttcttttgcaggaaatgctgtgctatttccgaaagctcctcccggtcatagtcaggaaaatcaagcgagaactgtattcttgacgaaaatcccggatttgtgctgataaacttgtccatttctgttttgtagcctgcaaggataacgcagaactgccctcttttatcttccatttgtttcagaagaactgcaacagcctcgtcaccgtagcctgctgttccgctgtcagtgttctgcattagtctgtatgcttcatcaatgaaaagcactccacccatagcatcatttattttgttcagcgttttttttgccgtttcaccgacatacttacttattagtccgcttgcatctgtttctatcagcttggcttcggtcaatacacctgcctcgtacaataatcgtgaaagtatacgggcgacctcggtcttgcccgtccccggatttccgcaaaaactcatatgcagattaatatcaggatctgtcttgttacgcttggcataagcctttatcttctttatcattcgtttcacggaacgcagtcccacaagtgtgtcaagttcttcttcggtggtaagtatcttcttcacaaaaccgttgccgcttgtggggatattgatatgctcgtccctgatgtatgtattcacatctactatttcaagggctttatcagatgtgcctgcacagcgtacattctgacacatgatgaccttatcgagaatgtttctgacctcacgagcatttgcaaaattaaagtctttccgcttgtggtcggtaatatcaagcatacgctccttagcagcatcgctgacggaatactctcttgctttcaacatgatgtccaagatctgcgacaattccttgcggtcgtaatttggaaaatcaagagtaaagcctatccttgattgaaagccctgatttgtagctatcatttcattcatcggatttttatagcctgcaagtattacacaaaatttgccacgacagtcctccatagcctttataagcgtagaaaccgcttcatgaccgtaatcaccgccagtgtcattctgaacaagagaatatgcctcgtcaatgaacagcactccgcccatagcacttttgatgacctctgcggtctttatcgctgtctgaccaacgtagcctgcaacaagtcctctgcggtctgtttcaatgaccttggcagtgggcaaaaatccattttcatatagaatccctgcgataattcgagcaacttccgtcttgcccgtaccggggtttcctaagaaacacatatgcagattaagccctgcgttatccttgtttgcaagagcatacgcctttatttttctgacacttgattttatgctttcaagaccgacaagagcatcaagtttctgttcgtttttccctgctacaaaatagccctttgtgcctgtcatgtagtgatgaacgtcaagatcgagcatcttattgtaaagttcgaacagctcactttcggtcttgtcagtcaaaaattcattggcattgatcattttaaggacaggcttaaaacggctgataaaaatatcgttcagcttgtatgcacagcttttgctattcatagaatcatctgtaataatgccgtttacatttttaaaactgtaagcataggaactttttttcaatggtgctgacatcaggataaaaacagcatcccaagtgactttcagcattgcggtcagttccgatttgccgtcctcgaaaatatcgaccacatactttttggcaatgaccttatcacaggcggaaatgcgttctttgatagctgatctccaatcaaaatcttccgtcttacctttgaatttgaaagccttagtttttatgtcatacgcccgtccgtagatattattgatacggatgaatttatacattttgtcagccagttgaagtattctctctatgagagtatctgccaacggcagaagttcatggttggcgttctcctcatatgcgacacttaccaacggaaaattgaccttttcatagcttgcttcaattccaagtttgggaagaacactgtctaagtattccgcagtggaatcggaaagcactttcagaaactgcattttcccgtcataggttttgcggaacgtatcgtgaaaatattgcttcatctgttcggcacttcgctgtaatcttttataaaattcttccgtcttttcagcctttgacacatgattttttattttatcatagtccggaaagcggtgtatgtccgaatccagctttccgaaatcaaccgactttatatctatcttctgatttattatcgctctaacaaaatccgttatctcgccgataagtacggattttcgctcatttggcagttcatacatcatatatccgcaaatcggacacatacagcgctctgtgctttgtttcacctcgccacaggctatgcacttgtattctttcattacagctctactcccagtgcgatttttgccgcttcaagcggagtggaataaaattcagcagatatttcgcttttcattttgtctgaaagctgttcataattggcacggctgttttcgggaagaagtattttcttagcccctgcatttgccgctgtcacaaatatttcgtcaagcatggtgatgacgggcatagtttctccagacattaccacacgtccgcatatcacaagtgacggcatgacaggacgattcgacagagccgagaaaagacccaccacttccgctatggagacctcttcgctgacatttctgttttgcaagtcgttataatacaggctgtaatcgaaatcgtcatacttgccgtctatcagcttgcggctgttctggataaagtagttgaatgccgctgtgatactatcctttacacttcttggcgcacctgcaagaccctcaacattgcggaaactcagctttccattgccctcaataagcttattctcaaagcggtaaataccaatatttttgtcatcataagaccgaccgacagcatagacatatcccggcttaccgaaggtgtcgggaataagcgttccgcctgaaatttcgggcagatcaacgataaattcctcgttagtatcaaggtcgatatatccgagcataacatcactgaactcggcaggattcatttttctaagttgttccttgaccctgcgtctgcactctatcgcatacacaagcaactcacgggcttcttccttgccgatatgctcatctggatagatcatctttgcaagcccagaaaaagtacgtcttaccgccgtatcatcacgggtgttgaaattgctgttcaatgcaaaatattcaccgaaagaattggtgaaatcatacttgcgcatagcatggcaaaactcggaaaagcaatcggagataagaccatatctgttggtaaaaaggcttgctctcagcttcggagtttcccaaccaggcagatatgcgtgtatcctatcaaagaaagctgaatcgttattgaatccttcgggaaacggctcaaagagatttgtggtgcggagcatatcctccacacttctgaacgtatttccctcaaaggcgattgaagcatctgagcttatggagtcgctgcctctggcaaagcttccgtttgccatatagtttttcatgatctgcaccatatcggcatcactgcccttgataccgccgacctcatcgaacgccacgcagtcccagtttcccacaagtcccacacggtgcgatgccatgttgtaaaacatattggaaacagtcgtgtgtccgctgctcataagtatcgaataaggcgaaagctcactgtaagcatgagattttcccgtacctctcggaccgagttccacaaggttatagttcttctgaataaacggcacaaatcgcagcagatagtggaatttctgcttttcgtccagttcatctggttcatagcctgcactgcggagaagtatggttatccattcatctttggtaaactgctgtctggcttcgatgatctcatcaaggtcaagatttgccatttgtatcggttttaatgcggctatggcaaaaggagattcatatcttgatttcttctttttcagctttttgcgtttctttttgttgccttcaaatatatcttcttcgtattcatcctcttcatcgtcctgttcaagtccgacatattcaattttgataatacaccatataccgcctatcagcagtttttcgttatgaactaccagatcagaattgacctcaaaatccttcaggtcaagatttgtaaagctagctacatacttatcctctttttcatcgagcctgactgttaccttatcgatgaccgtatactgaccattttcttttattttggacttgacataatcgctctggtcggggcgaacgtaattctcgctaagtatcttcttgatcttatccaagccgatcctcatttcatcatcgtcatcggtggtgcagtacattccaagaagatattcaagtacatatgtaggcacatttgcaccctttttcataagtccggtaagatccttgcggactgccttgccgggaaacgcttcgatcacccttttatcaaattcatccataatcattcctccaatcacactccctacaggaatgctcatctctgcttcaagctgtttattggcagcgtaataattaggctctctccgcctttgagcagctcgccagcggtaaatgcgttttttcttttcgggggataagagcagtttcgatccgatagcacaaactgtaacgatcgattttaatgtttctctgttttcacggtcacgcgtagtttggacttcatgtttggtagttccttgcagagttacccatgtgcctccaattccgttctttaccttaaattttcttgttttcataatttatcactcaaaaatcaaaatcatttgcaaacgctatctttacggaaaattctgtgcgctcaatgatagtgcctgcttccttgtcaacaacattcaaataatataccgcattgccgtcaaaatccgcacttttcagcgtgaatcttatcttgaaaactctgtcctgcggttctcctgtcttgtcggctgttaccgtctggacatcactcacaggaactgactgcttgtcacacagatatatctcatacgttgcgggaacgatcttgccgcccactgcttcgggctgcatgaagtcaagcgagaatatattgttgctgatctttcttgtcatgctgataagtctcagcgtgactttctttatatcaacgaatttctttgaattctttgatatattcttgaatatgatgacaggcacacaacattcttgcagggaaataccaccgtgaacaaaattcatgccgccaccctgttttttgatgcgaatattttcataaggtgcaaaacctctaatgctttcagaatactcgtccataggtattttcatcagaatatccgaactgctgtttttgtcagctatgatatatcttctgcccgtctcagatatgttccctgaaacaaggctcgtttcagccttatcgctctcagaaagcggctcattggaatacaagaatccgtggtctgcggtaatgatgatatttgaaccgctcatggagtttacgaccattcgcacaagatttttcatttcctcgactgaatcggtacaggcttcaaatacctgcttttccgtgttcgccttatcacctacagcatctatcttgttgtgatatatatacacgacctccgcaccgctgacaagctctctgcgctgtgtctggttcatcgaaagcagattttcatatgttatggcacagtttttaggtgaacaacgtttcagtatcttgtcacggttttcggtgctttctgtcggcagaccatcgcagagtatcttcatatcatcgttgacggtcagttcatcgtgtggcaaaagtgctgccatgccaaatttcgtaacgcttgggaatacagactgcatcgctgtcagctttgctgttccatttgtttcacgaagaagtttttcgttaagctccatcgccacttcataacgcagggcatcagatattatcacgaatactctgctgtcgcttgctatcggcttaatatttgatttatagaaatccttctgatatgaaataccatcaagggcaaagccatcacaaatatagtcctttatcaggtcacaccactgcccattcagctcggaaagataccagttcttgtatattttttccgcagtcacgattgcacccttgaacagatcatcaagcgtccccgatgtgctgacaaggctcttgcggaacgcaatatgcagacgtctgtaatatgtatccatgatgtacaggtctttgccgtaggctttccacaggtcgtcatatctgccataatgaaatcccgtaatatgctcgtagtggaactcctgcattttggcgatataatacagcccgtcatacagataggaatatctgtcataccattttgatgttcggcggctttcgacaactttgagtatctcctcagccttgataatatcctcaccgatctcgctcataaatctgccgattattacctcatcaatgcaaggcaggctgtcggctttcagcagaatatctgtattgacttttttaaggcggtctgtcaggttatagtgccttgaaatattatccgccatgtcgaacagcttttcgctgtcgtcagaattgttccaatcgtcaagaaaagcatagcaggcggtctgtttttcaggtgagatatactgttccagccccgaagtcacgcggtcatcaccgagggtcgaaaatgccgtcagcaggatatgtgttgcaagatcgtacagcggtattttttcatttgaaaagccgaaaaacttcgctgtcatttcatgcagtgcctgttcgcttccaaattttgcgatacgctccaatgcaccattttcttcattgtcaagcgaatcgcagagtatcgcacgtataacaccattgacggtattatgttttgcacccgaaagcaccgccatgatatcgatgtgcaactgtcctgcggtttcatattttgtggcgagtgccgccagcttgcctacacgctccttgctctcaaagaatttcttgtaatgcttcatggcacggcggagctgtgttgtctggggcattttcagttcgttcatctgcatggaaacgagatcggcacgaaattcctcgctgtataactgtatatccctaagccagttgtcctcacgctttttgtaggtcagagggtcatatacaagataattcgactgcgtgtccgtctcagatagtagcattttcgcttcaaaaaaattgtcaccggtcagctttaatattttcacatcggtcaggtcaagttcatcaagcatggattcaaactcacgctcggaatcgaaccaaaatatgatcctgcggtcgtagcagtcgggcagatctttcgcaaaatgctccgccagactgcggttaatattatcaatcgtcatttgatcctctccagtatgtccgcaaatttcgcatagttgaccttcacaccgtcgtcaaggtcaatgtctatcatcatgtcagcgaggtggtggactttctcctcgtaggtgtttatctcagtgagctgtgcggtcagcttttcctgacgcttttttagcttcacacggtcggactgtgccaccgaatctatctgctcagaaagcaaggaaagctgtgtgcggtagcgttcctgcaactcgtgaacgtagtcggtgcggacggtcgcaacggtggtacgctcccagcggtgcatatacacaagcgccttgaaaccgttctttttgccggagctgaaaagccagtaaatcggccttttctgataaattttgcaatggtcggcatagaaaccgttcagcagataactgcgtatcacctcgcggggcgtaccctttccgccaagggcatctgcgatgaatttcaggttttcgtcaagcgtgtcctcgccataagctttcgccacgaaatccacgatcagcccagtgaggtcggtgggcaggtaatcgtcgtcacatattggcagaacgttgtccttgacgggaattatcgtcttgtatttcgtgctgtcccactcaccgcctgcgtaggcaagccccttgacatcgagggaatatctgccaaaccaacagcccacggcatagcttatcaggctttttatctcacgctgtagatcggcttttctgacggtcacgtccttatcctccacctcgggtgtcagctcgtcctgcaagccgtaaatgtcgatgaaaatgcggttgagttcttcctcgttggcttttagtttattgaaacgctcggtgcattcctgctcccatgcggcgtatttgtcggatattagtgttcccatttcaattctccttggaaatatttatttcaatattatctgaaataatagtcagtaagccagcggaatacatgaactcttgataatttgtattgtatgatccgtggagacccatttttctcatcacattatcatcaaaagcccatataatcgtaactcggtattgcatatacccaacatcatacgaacagtaaacattggctaatccttgatgaatcagttccgtatcatcataaacctcaacctctgctttaatctcgataccatcagttactttacaataattcataaagtctttaatagcatttatactttcgtgtttatccatagtattaccccccttcataccaataagttcccctcaaaatcatatatttgagtatctgtgctccaacatttatcacaatacatagtaactatgactttatcatcaacttcgctccaactttttgcaggcttatacgccgaagaaaaaactgcaaacttttcacttgcatcagttcttccgtaaacataaaacatcttcttagccccacatttcgggcatacatattctctttcaaaaaaatacataatgactcctcctattaaatcagcgggtgcttttcaaagccccatgaagtctcaaagtcattccaatcctgtttgcaaatttcaacattctctttaactatctcatctattttaggctcaatctcgccatttacaataattgggagattttttacatctctaacttgggtactaagtgttgggttaagaattgcaaagtataacggagcaattttcgttccaaatattccaagacaataccatagcttttttacgctaacaatacttggaccttttttgtcaaaaatacaaacaggcggcagatacctaaatgtatttacactacttgtcagctctgtataagtaattccctctttgaacctatacttttcagccagaagatttgatgtagagttagttttatagtattgaacagcaccttccgaccagtcaacaactaactcaatattaccgtaccattttctgaaatctccaccctttgcatagtaaacccattttttacccattccaaccttgttagcatctatttcccaatgaagcctcaaatatttatcattgttcgccgttatatgctgtgaccctgtaaagtcgctaatactgtcaatactgataccacgttcaaacgccctaataaaattctcactcacccaataagccacaggcatacccggaatcttggagaagttttcttgtttggctgcaaaacgcttatcaccgctcaaaaacaggtcacgcttttcattctcgcccacagtgtcaacaagccttgcgtatgtacccttgtagtccttgatatgccccgtcataacaaacgcagttgtctgcacgacctcgccgcctatctcatcaaaagcccttgcaccgaggtgcgccatgttgaccgttgttttcagcatcagcttacggcgtagattttcatagcttgacagaaacatgaaagcgtgctgtgtaatcatcgcatagaaaccgtgcggctttgcaagctgtccgcacttctcgataaagcaggcgaacagatcggatttactgtcaggaaacttactcttgacaaactccgacagcttcgcattcattcccgaaccgcccatatatggtggatttgtgcagactacatcatacttctgtgaaagtatcttgtatatcttcatcatcatgtcaaactgtcgcatattcagcccgatggtgggcataaagtcggaaaaagcggtgtcgatatccgcaggggcggtgacggtcatcagcgagccgtaggtatcggcaaaggcgaactgctccgcaaaacgcctgatactgcccgagagcatatccgtgtcagcacccataacatcggcaaaattcgcaagatttggctgattttcggggctgcaaatgcggcggttgtactgccttgctttcatcatcaccgcaaaatacgcaagctgataggctctgcggtcgatgtccagcccgtagagattatttcgcaggatagacttcgccgcgtcacgctcgccccagccgcaggaacggtaaatgtcgataagcacatcgaaggcatacaccagtatatgtcccgaacccatacatgggtcgattatcttgatattttctggttgaatatttttatattccgccctgatcttttctagctcagccttgacgggatcctcctgttcggcttcatcaagataatatttccagtcggcatcatcgggctttccgtgaccctcagcccaaagccgtccaagggaattttccaccatataacgcactatccagtcgggcgtaaaaagctgggtagccgcagggatagcctgtgcagagatcttgatattcttctttagatcagcgaaaaccttgtctttcggctcggtgttgtaatactgatacagccagccgattatctgcacctgatctctccagtcctcctcgggtatctcggttatcatcttagcaataacgctgtcctcacgcagcagatttcttgggaaaagcaattccgtccagccgcctatctgctcaaacatctcgggcaaacccttgttcaaagcattgcactgcgtgatgataatatatttatataaccgttcgttctcctgattttcgagcagttcaagcacaagctccttgtcgagcccgtcaatctcaacattagctgcgtcggaaagcacctcgggcttgaaatttccgctctcgtccgagaatattctcgtatgggacggcagataattattgacctccatgaatcgcagtgcgatgaaacgattgaaccaagtataggcggcttcctccatcgtctgcgtaaagccgttctgacggatatttgcaataagctgtgaacgctgatttttctccgcagccgtaagcgaccgtccgttgacagactcctgcgcagggtcatttgtgccgttctccgtcacttcaaattcataagcaagctgtgttacagcattgataagcattactctcgcttcaacagcaaaatttttgatagcagttttgttcatattttcacatctcctcagattatatgcagaacatcgtgaccgttcagcttgtccatgagcgtccttttgacctccgcaatatactcgtcaatatcggcttcactttgcagtttcatcgtgtggcaaactgcactgcggctcattgtcacggtatcaatatcaggttcgtcaacgacaacgagtttttgcagatattgctgtctgatattgccgatctgaattttcatcgcatcgagatttatgagtttgtctgcattttcagttgcggttcgcttttctgtcagcgcatcgtccgccctctgcacgatgtcaccctgctttatgtctgcggtctggtgtatctcgcccatagccgcctgtatctcgccgatgacctcctcacgcttttgcgacaacagcttttgataatcctcctgcaccgtttgtataagttcgggcagttcgctgatacgcttgtaaggcttctgcatggcgattatctgctttatcttttcgacaaccgcaagtgtattgtcctctgtctggaaatactctttttcctcattcacacgctccacctgcgaccttgcattatcgaaaatgcttctctgaacacggaaaaacgtatccacctcagacatatcctccgcaagttcaaggaaatcttcctgcatatccacagcctttttcagcagagcgatattgtcatttttctgccccaaaagctcattgcacagcttgataccgttctccacaacacccctgccaggataagcatttgcactatattcttttataatcaagtcattcagcttgttacgctcagtttcaaatttttctatgatataagcaataattccgtcctcatcatcgggtatcgcgcccaaagtgcagttgaaatattcgctcaaaaactccctcgcctttttgataagtgcagtcggaggagcgattctgaacccgatgatcgccttgtctatttccgttctcttgcgaagataatcgggcatttttttatcactcggctgaatgacagcaccgccgtatttgagggtcaacttttgacttgcgataagctcggcagtcacccctgctatgtcgatctctcgccagccgtagggaatagcctgataacgtttctgaatatcccccatagaggtcggcaactgtttcattttctgaatgtcaagatattgatataattctttgacagcctcggcatttggtgactccgcaccatcaagcatcatctgcttatcaccgctgagtatctgcaaaatatctgcatcgctgtcataattctttcggacgtaactcagcttagtataaacgctctccacgagaatcgacattgctctttcaatacgttccttcaccgatgaaaccttcagtgttaatttatcgcctgcaacgtaaactctgccctcagcgatagccgccgaaataagctcctccgcacgtttttcatgtgccgatgcctgattctgcctgcccctgataatactctgtatcatctcggggagctgtgccacgttcttgcttttgacatagcggcgaatcttcatggcgtcttccagttctttaaaatatggctgactttccgcaagcacaacgataacttcattgtccgccgctgatctcatgagaaatacagaatcatctgttgtgtatatctccgatgctactgtaataaaatgtaatgccaccgagcctgtcaactgtccgataacggtttcgtcgatacgctgatcgtaaggaaaatcatatttgccgtacttgaatttcttgctgacaaacagctttccaaagataatatctgaaattgccttggtgattatcgcactgtcaacaggggtgttctttatctcacgggcaatatcctgttcatcatcggtcaggaatgtatatgtatctcctgcgcgggaaacatagttttgagaaacaagcctgtcaagggactgctgtatcgaaagccttgtggaaaccttgtcggttcgtatatcgtccgccataagaatgcttatattgtcaatattcgccttgacatcatcgacatatctcacaaggtacagcagctttaatatatttacatctgtctgttcaataccatcacgattgtcggcagcattctgacatcggtcgataacacggcggatagagctttctaggaaagtatgcactgtgtcatagaaaagatagaacggcacaagagcatactcgtccctgtcctgaattgcctgtgccgcctcctgaaatcccgacagcatggaacgctcaccaccggaaaggtgcttgcccgaattgccgtgcttgcgtatttcggcaaggacgttttgcatcagcctaaactgatacggcacaaagggataagtctcgataaactcgccctcgcccgaataacctttcaggtcaagaacggcattattgaacgtgaacagatttttcagcacctgattatttttctcatattgcaggctaagcacctgttctgctgtatcggtcttggcaaggatacgctttttgatgacttcatcaacgcttgaggagctaaggctcagacgggtattgaatctgccctgaatctttgaaaaatcatcaccgcttatcttggtaatgctgtcgatagcctcctgcgaagtcaccatgacccacactctgccgccgcatttcgtgcctatctcttcaacgatagtctgtaagttcagcatgaggtcagaatccgagccgatgtactgaccaacttcatctatcatgaacataaggcggtagtccctgcccttgctatcgatatactcacgaatttccttcacgagctgttcgatactaagctcaatttcttcctcgccgttgaaccagtttcgtgcagcagtttcactcatatcgagggcttcggacatagcttctacaatatcgtcctcaaagaaagcaaaggaatcacggctttcttcccaagtaccaccgttgatacgctcaaagcattctctgaactgctccgttttacctgactttgcgatgaactgctccagttttgcgactttcagatcgttgccgtaaaagccctgatgttcatagaatacttttgcgaaaactcttaaaatagccgttttatcttttgtcagagggcttttggagtctatattgaaaagaatagtttcggtaggaacttttacacagttttcaagctgtgcgaacatcatggggtcatcgaacttatccgagaaatactgcactgccttttttccaccaaccgtcttattcgcaagcagataggacagcattttcagaaagtgagatttaccgcttccgaaaaagcccgagatccacacacctatcttgtcggtgggctgttccaacgaacgttcataatgattcagaaatgtattgaaatgacggcgcagctccctcgtgataatatactccgaaagttcctgcacgatagactgttcatcatcctgtgcgaccttgataacaccgttaatgtcacggttgatgtcggatttatagatactctgtaaacgcataaaaaaactccttagatcatattgaaagcacggtagtagttgccgtcctcaaattctgcaaacagtgaaagttcctgaccattgtaagcacctggataaagcatcaccacgggaatatccgagaagatatgttggatattgtcaaggatattgtgagaccgcatgaacggataaacttttccgactccggtaatcaacaaaatatccccatgctcatgcggctcgtatttcattttttctacaaaggcttcgggcgaaacagctttttgcaactgtttaagcagacactccgagccttttttcttctccatattgggaatgcctttcaggatccgcttttcctcgcatatccgcaggaaaatcttatacagatcacactccacgatacgaaatggctgtccctgtgcatttatcaggtcagcaaaatagctccgcacaagcatttcgtcctttggttcgtagcagaaaacgtgtatcccgacttcatttgaaagccccttgttgctcagaaacacttcatctgaaaagcgtttttttatctcattaagctggtaaataatattactcatagtccgtacctcaattaaaacaattaaaagctgcaagtgcatctgtgtcgcctttggaacgtatcaattcatcaagctcgggatacaaatatacaggaagcaaggtctgcgacttcgagctttcaagatattcgcactctacaagaaaacgcaccaacacctgcttaagctttttcattgtggattcgctccattcactgacagcaggcactttttcggcaagggacataaagaacacattcacatctttcaccgaaaaatcaagctgctgtgagcgatatttctcaccgattacctcgatcataaagtcatagacgatactgttttcgcacatgatcgcatacaggttcacctgctttgcaacttcggcagatgcatctgcaagcagcctgatggcaacttcattatcaactgcgtctatgcgcttgaaacaggtattggtgatcgtttttatcattcgctccgtaggaaactggaacagattttcgctctgtatctcacgatatatctcatcacggcttcttccccgaccaagtagccctgcgactatttttatctcataaaacaggaactgctcacgggtgagtccgccgctgtaatggtttttgtgcatttattgtctcctccctatatatagcctgaatcgcaattaggattctgagatttttctcaaaatatatgcattcgagaaacagtcaaaaaatacattcttaatgattaattcatgactttccgttatgttttttcgctttctgctttttttacactttatttcccttttcttatctctttttgtccattttgctttgctcctttgttcttttgatataaaaagtgacaactgtgcgtcgctcagctgtcactttggattgattattatattaaggcaaaaaaataaactcacagaacagaagctctgtgagtcattggaggcgccacccagatttgaactggggatcaaggtgttgcagacctatgccttaccacttggctatagcgccatattggagcggattacgaggctcgaactcgctacctccaccttggcaaggtggcgctctaccagatgagctaaatccgcatttaatggtatctacaatattatatgcaagataccgaaacctgatacataaagaatgtattggcgaccggaatggggctcgaacccacgacctctagcgtgacaggctagcgttctaaccagctgaactacccggccatatgagcggactttataagtccgcttggtgggaacaacagggctcgaacctgtgaccctctgcttgtaaggcagatgctctcccagctgagctatgctcccgttagctatcgttttgagttgtatctctcagcgacgatatttattatacactatccaaagccatttgtcaagagtttttttgaaatttctcaaaaaagtttaagtccgcaaacgctttattatcgggcatttgaatagtgtacataaaatattcattaaatattattcttttattaatcctaaaatctcctcaggagtaaagtgatatttcttatcacagaagtgacactcaacgtcagtaccaccgtctttagaaagatcttcaagttctgccctgcccaaagatataagagcattctctactctttcccttgaacaatcgcaacgataattaacctcaaaatcatcaagaacgttcggttcaagaccctccaaggctttcattgcaatagcttctgtggtcataccaccacatataagctttgttacagactccattccgtttatattcttctctatctgatctatagctgactcaggtgcaaacggcaaaagctgaataagaaatccacctgcacaattcactgtaagatctggatttacaagtacgccaagagcgcagacgcttggcacctgctcactgacagcaagatagttagttatgtcctctgctatttcgcctgaaacaataggcacttgtccgcagtacggctctttaagtcccatgtccttgaccacactaagcgtaccattggagcctacagcccctctgacatcaagcttgcctttatcgttaagcggcagttccaccactggattttgtacatacgccttaacatttcccatgctgtcagaaacgcatataagcgcacctgtaggaccgtcaccgtccatttttacagtaattgaatcatctttgcctttaagtccaaatcccatgagcgaagtacccatagcaagtctgccaagtgccgccgtgaccacagcggaagttttatgtatctcctcaatgcgtgaaacaatatcctttccgtcgatagcgctgcacacaacggaagcgtctttacttataactctaactattctacccataaaatcaccctctgtttattctcctgcacacataaagaactctcagcgttttatcattaactggcgagtcctcaaatccgtcatactttcctataagctcaaaatcatttaactttacaagctcgctcaaaaactcgtccgtatatatcctctctgtgaaatcctcactaaaacgacaataagagccgtcctcctgctcctcaaagaagtcaagatatatgctcacgctgtcatcatcattgagctcattctgccatgcacagaaaagcccatcaagatcatagcagaacgcattgtctgcaaggatcactcggtgcttgtacacagtatttacatcaaatatgaaaagtccaccatcgcaggtaaattttgatacacactcaaaagtctttctgacagcttcctcattttcaaggtgatttatgctgtcaagaacacaaacaacagcatcaactgcgccatacagatcaagctcagtcatatcctgcataagatactgtatgttcagaccgctttcatagcgcttatccatggcttcttccagcatttgatccgacagatcaacgcctaccacatcataatcaagacgtgcaagtgcttcactgagcgaacctgtgccgcaggcaaggtccaaaactacctcatgctctgaactgtatcgttttataagctcatgacaccgtgccgcaatttttccgtaatcgacattctctgtaagcttatcatagtaacaggcaaatctgccgtatccgctcattacttatcttccttcttatccaatctgtcaaaaacgatattatatccgcctgagccgtcataagaaagcgagcggttcacacggcttatagttgccgttgaagcacctgtttcgtttactatatcgctgtaaacatgatcctttgtaagcatttttgcaacctgaaaacgctgcgaaagtgctttcagctcaggtatagtgcaaagatctttaaaaaatagcctgcattcctcgacagtttcaagacaaagaactgcttcataaagatcgtctaaatttttgatctcaagtttctctttcatgaaaaaaatctcctttacgtttcatggtgtaaagtgttaaaccataaatatattttaacacaagtcatgaaaaatgtaaaggagaattatgaattttttatttacttactcttaattttttcttctattaggcgttagaaaaccaccgaatgacttcggttcatcagaaatatcctctttatcatcgtaatattcctcttcttcgtcctctgtatcgctttctagtttccctggtggcgttatctcagccccctcagatatatcgtctattattgccctcagttcatctacgccctcacctgtgatagcagagaactccacacaggtgatgtcctcaaagcatggtatctctgtcttgaaagcttccatacgtgcttttctggcgttaggcttgagcttatccgccttggtgaacacgattataaatggtatctcagcgtcaataagataatttatcatcatcagatcgtctttgctcggcggatgacgcatatccacaagctgaaaaacaagtgcaagctgtctgctgccgtcatcaagatagcctcctataagactgccccactgccttttctcggactttgatacgctggcatagccatatccaggcagatcaacgatatagatattctccaccgaaaagaagtttattgtaacagttttacccggcatagagcttactctcgccaagttttttctgttaagaagcttgtttatcagcgacgactttcccacattcgacctgccggaaaaggcaaattcaagtctgtcagacttgggtatctgtgagaattttccaaaggaagtataaaattctgctttgttataattcataggcggccctttctataccgttaatttttttcgctccggctcgttcttgcttaggagttcaagcggaacattatttttgctgtttggaacaagtgcaacgtcaagcacaacctgaatagtctttgcgaacacgaactcgcaacaaagctttactgtatcgtcaacgtcatcaagatcgcccttattagcaaaaggcacaataatagtctttacccccgccttgtatgcagccatagtcttttcacggagaccgcctataggcagtactttgccgctaagagttatctcgcctgtcatagcaacgtcactgcgtacttttatattacccaatgcagagataatgcccgttatcatggtaacacctgcagatggaccgtccttaggcacagcaccctcgggagcgtgtatatgcaaatcttttttctcgtaaaagtctttatcgatgccatatttgtcagcaacgcttctgcaatagcttacggcaatctttgcagactccttcataacgtcgccgagtgagcctgtaagctctattctgccctttccgtcaagtacaaggacttccaaaggcatgacaactccgcccactgacgtccatgccagaccatttacagagccaacagcatctttatctgatacaacatcagggagatatttctcatggccaagatatttttcaagattatccgccttgaaagtaactttcttaacgccgtcttcaactatctccttagcagcctttcggcaaagcgagcctatctgtctttcaagatttctcacgccagcctctcttgtgtagctgtctataagcttataaatagcatcattgcagatgcgtatctgagatgctttaagaccgttcttaccttcctgctttttaataagatgttcctttgcaatatggaacttctcctccctagtatagctagacaactctatgacctccatacggtcgagaagaggtgcttgaacagtatcgagagtatttgcagttgtaataaacagcacatcacttagatcaaatggcacttcaatataatgatctctgaaagcattgttctgctcgctgtcaagaacctcaagcatagcagacgatggatcgcccctgaaatcattgctcatcttgtctatctcatcaagaagaacgacaggatttttacttcctgcaagcttcatggcattcattattcttcctggcattgcaccaacatacgtctttctgtgacctctgatatcactttcgtccttaacaccgcccaatgagacccttacaaagtttcgattaagtgctctagcaacagactttgccactgacgttttgccaacgcctggaggaccaacaagacagaggatctgccccttgacatcaggagtaagcgctcttacagcaagattttcaagtattctatccttgacctttgccatgccatagtgatccttgtcaagtatctgctttgcctttttaacgtctgtcctatcctttgtgacagcattccacggcaatgcaagcactgtgtcgagataatttctcagcacaacaccctcttgtgacatcatacccatcttggaaagcttcctgacctcgcccataagcttatcacgaacttcttcggacagtataagtgaatctatcctatgtgtgtactcatcgatctcatttacatctgagccgtcttcattttcacccaactcattctgtaacgccttgatctgctcacgaatatagtactcgcgctgactttcttctatctgagaatggacctgactatgtatccttctttcaagagataaaacattggtctctcgtgaaagaatagtgatcataagaattagcttatctaaagcagatggggcttcaagaagcgactgtctgtcagtaaaagctaacggaatattaaatgccaaactttcaaaaagttgaacaggcgttttagaaccgagtatctgggcataaagctcttcaggcattttaggaaccaccttaacatactcttcaaactcatctaagaccgaacgaaaaacagcaagttgttcgtcctcgtcaagcctatcctttgaataatttggtacaagtcttacatcagcttcatagcaatcatcatactgataaaactcagcaagtctcgctttacgcagaccttctacatagcatctgtatattccatcaggtgctttaacgatctgtcttacctttgctacagtacccaccttgaacatatcctttttttcaggcatttcaagataaacgtctttttgcgcacaaagaaaaacaaatcgatcgccgtccatggcatttttcatgctctttatagttcttggtctgccaacatcaaaatgcatagacattccaggaaaaactaccagatctctcgttggaacacacggcataatattatttattttaacatcagttttatctttcatagttgctccatttccttacagctctacaaatactgtaatgctttgttatacagctttagtatataatatcacatttatgatacatttgcaagccccactcagaaacttccccttaacaaaaagaggcacctataaaggtacctcaaaatagaaaacactattagtcagctacatatggaagaagtgccacatgacgtgctctcttgatagctgttgtaagttctctctgatgataagcacaagtgccagttacacgtctagggaggatcttagctctctctgtcatgcactttctaagctttgcgatatccttatagtcgatcttttcagctctgtctgcacagaacatacaaaccttcttacgacctctcttcataggtctgcttgtatttctttccttttccatggtaaatttccctccttagagaaatattttttcaaaactcctctgcttagaacggtactccgtcatcggtcaatacttcttcaaaatcatcaaggtcaccaatggacaaagcgtcatttgatggagcattgttatagttattctgattagaattgtttgcaggctgtgaatatccaccattgttctgctggtaattattctgctgataaccaccatttccgtagttattggaatagttacctgctccctgctgttttggttcacctgtgaaagacacactgtcaacattgacctcagttgtataatgctttacaccattcttgtcatcataagaacctgttcttatctgaccttcaagagcgatcattctgccctttgaaaagtatctgttgataaattcagctctctgcccccaagcagtgcaagtaataaaatcagtttgcctttcagcaccctgacggactggtctgtcaactgcaacattgaatctcaaaactgcatttccactaggagtctgtcttacttcaagatcctgagtgatcctacccattaaaataactctgttaagcataacttttccctctttcgcagttttacttgaccgttactaagaaacggatcacgccgtctgtgataccaagaattctctcaagctcagctggaaactcaggcgtagatgtgaatgaccacagtacataagtaccttctgtttcataattgatagcataagccagcttacgcttgccccaattactaagtgtaacgtcacttgcgtttgcctcgatcaagtcattgaacttagctgtgagtgcgtttacagcctcctcgtcaagcttagagctgaaaattaccatagcctcataagactcattaatttttgccattgcatttgcacctccttttggatttcgcctgtgccgcaatttgcacaagcaaggataactcaattattataacacaagaccgattatctgtcaagtgtcacttgcgtttttttatgaactttttgtaaaatcatgcaaatatctttgtaacaccaaaaatgccaaacacaactatcgcagaataaacggcaaagccaagaataacagccccccatgacgtaccgccctttgctactatcttttcggctatctcctgctcagtgccgtcctccgaccttatctcacggatctttttttgtgcaaacttataatacatataattgccgaaaaagcctgccacaaactgaagtgccattgaaacataccatgtcgcagcggaaatgccctgaaaaacccttccggtcacatcgatgccgatatcaagcgagaaacccattgttcctgcactaagatattctatcgcagtagggatattgagcagtgctgtagccacaagcatgatgatacccacaagattcatttttctaaacagaaaatataggtgtggaaaaagaaaagccgcaaagtttatggaaatctttccaccaaatttaccaaaacgtataaagttagacaagaatatgagcggatttgtctttacaaattttgcatagtcatctagtttaatgccttcaagatctgagtccttatcaaatacaacctgtctgccaaacggaccgtaaggctgtccgtcagggccggtctgctgagcgttattttgcgtgtccatgtcgttgaatggacgttcctcagtatcatttttcgtaagcggtgttccgcacttttcacaaaacagcttgtcaggcggattttcaaaaccgcagcgtatacagcgtatattctcactttctacactctcctgagtttgctcccagctctgacaactttcatgcaaagcgtcatttatgcactttccttctttgagataacactcacgatgataaggtgtgccacactcaggacatacaactatatcgtcaccatctttgaatacttctccgcaggaaaagcatttttttcctgtataattagccatatcgggtttcctttcttgctgaaacaggctttttaaagcctttaaataatattatagcacaactttcaggaaaatgctatagttttttatatttttcctttacttttcacaaaaaaagttttataatatataatgatataaaataaggagaaaaagatatggtatttttagaaaacttaaagtcagagcttgaagctcttagacctatcatcagcgagctgcatgacgtatacgatattgaacgttctcaggaaaggattgcagagcttcacgaaaaagccgcagagcctaatttttgggacgacatggagaaatcacagaaggttttgcaggaaacaagaaatcttgagggcaagctggaaaaatacaataaattcaagtcgtcatttgaggatatcgaagtgcttattgaaatggcagccgatgagggtgacgaggacatgatcgacgaaatacagtctgaccttaaaactctaaaagagggtcttgacgccgcacagcttgacactctgctcacaggcgagtatgatcacaacaacgctatcatcaactttcatgcaggagcaggcggaactgaggcgcaggattggagcgaaatgcttttcaggatgtatcacaaatggtgtgaaagccacggcttcaaaatgactactcttgattatctcgagggtgcagaggctggcatgaagagtgcctccgttatcgtggagggtgaaaacgcttatggctatcttaaaagtgaagcaggaatacacagactagtgcgtatctcacctttcgacagctcaggaagcagacacacgtcattctcagcggtggacgttatgcctgaaatagacgatacaatcgaagtagatatccgtcctgaggacattaaaatggacgtttatcgtgcaagcggtgcaggcggacagcacatcaacaaaacctcatcagccgtaagacttacccacataccaacaggcatcgttacatcatgccagacacagcgttcacagttccagaacagggattatgcaatgaaaatgctcaaagcagagcttatcaaaataaaagagcgtgaacatctagagaagatagaggatatcaagggtgttcagaaagagatcgcatggggtgctcagatacgttcctatgtcttcatgccatacactcttgtaaaagatcacagaacgggttttgaaaacagcaatgtaaacgctgttatggacggcgaccttgacggtttcataaacgcttatctcaaagcgctttcacttggcgaaatcgaaaaataattagcataaacaaaggacagttcaaacgagctgtccttatgttttttatgagattgttttgcctttttttctgctctctttggtcttgacaggagtttcttccgccgctctatcctcaaagagctgttcgtcagggtctgcattcttgtatgcgaactcaggattgctttcaccacgctgatcgtagtaaggctggataacgtgttttctgataacaggataacaattgaagcaagtcacgaagcatatgaacgaaagaggccaaaatggcaatatgaacagagaatacggcaggaaaagatacatcataacaataacgataagcgataccagaagtgaccaaagagactgctttatgccaagactcacaagataaaacgagttctttattatctgcttcatgttaaggttagtggagcttatcataagatagatgtaaaagtgcatcatgaagaatacgataagacagcttatgcagataacaaacggaatgtatatcatggagttctgctctgcccaatatttatacattggaatcccgaccataaatcctatagcgaagatgatatctatggcacccatgatagtgccctgcttgaaattcttcttgaaagaatcccagaaatcatgtagcagaaacgcatttctttcctgagaataatttcggcaaacctttgtcattgcagccgttgcaggtcctaccaatactgacggtatcgccagtaagagccatattggatttgatgtcataagcataagtatgaccataagcgtcatcggtatgcagaaaacgaaatacagcaaattaagctccataagcttccacatatgcctgccatagacttcaaaaaacttaaaaataccctttttctcctgaggtgctttaagcacacctctgccaggggtattgtaattaccaaataaagacattacaccgctccttaaaattaatagtccccgaaattgccccgaattttatttcattctttgtatactgtatactaaattcgtcctgcaaaaataatcgtcagcagacattcaagcgcagccgcaacagccgccgctgcttcaagcacaagaaacttaacagcataaagccgcaccgtctgtcgcagaccgctatgctgtccttcagaaaaaacaatgcgcagcaggatatttgacatagcgacagcttcccttgcggctatcataagtgccgccgctgttatgactgcaggaagaagtacaaacatcgctgaaagtaatgcaccatgtccgccgtaaatgctgtaaagctgagacattgcaacaccccagcccgtgccacgcaacagcaatactgcaacagctaaaggctgtcccagtgaagaaaaacctgacaaaaacacaactgctaaaaaaacagtcgaactgaaaaaagacctcacaagaatttcttcaagatcacctgacgacctcacgtcaacaaagctgtttgaaaacaccgacagcattgaaagttcgtcgctgcccataaagcaaaaagtaacagcacccaaaagcgcaccaatcaggatagctcctgcaaaaaatgcaagaactccgcttttgtatatgcctgtcccgctgttcattatacatcactcctttgagtaatgtatatgccacggtgcagaaaaaataactattttgaaagctcgtaagctctcttagtgcaagccttgcagcaatcctcaacagcctttggcagaccgccctcacggagcttttcaagaccagcgatagttgtgccaccctttgatgataccatttcaataagctcgtcaagtgacttgccactgtcagttatcattttggcagagccgataagcgactttgcaaaaagatctcttgcaactgtttcatcgatgtcaacgctcttcgcatactctacgaatgcctgagcatacagatagataaaagcaggagatgagccgtttattgctattatctctttcattttatcctttgatatgacggcatacataccgcatgagccaaatatattgcaaacaagctcaaactcctcatctgttacgctgtcagagcgtgaaagagcagttgcgccctccccaagaagaagaggagtgtttggcataacaagcactacctttgcgccagccacagtttttgaagcgatataatcatctgtaatgcctgcgcagatagaaactatgaccgtatctttcgttaccgcaggagctatctcatcaagcacctcgtcaagctgctgaggcttaattgcaagaaaaacatattctgacttttcaactacctctgcacagcctgaacattttactgttccaagctcgtcaagtctatcaagtatcggagcatatttatcaaaagcgtaaagctgaatatccttactcattttactgcctgcaatgcccttcatgatagcatagcccatatttcctgcaccgataaaaccaacatttatcatacactcaagacctttctgaataaaaggcagaagcctgccttaaaaataacttaattttaattatacactaaatctcaacggatttcaagtgtttcacctaaatttcacattagtaccccatttttcttgtatattttcacgcaaaaaagcagcgacatttctgccgctgctttaaatcatgtatttgtcgctttatgtccaaactgtgttcttactttttcataagcaaacttcacagcaggcaggaataacatgagcaagatcagatccacagggagctggataagatttttcgctattctcggtgtgcagtatgtaagaaaaccgctcattccttctttggtgaggtttgtgatgccaaaagtcttgtttacataaagtgtatacaggaaataagaattaagtcctatattacagaaaagtataacacttcctcttgcaattgcgatccttatgtagctttgaagctttttgttgttaaaatcgcacttatacaacagacagccgtagatgatacctgaaataataactaccattgcaagctgtgggctgtaggctctcggagatttgttctgcactatatatcctagaaagtcaagcacaaatgtagacattccgcataccacaggtccgtaaagcatacctatagtacaggttgcaagaaaagtgaaaccgatcctcaagtcaggcgttacctcaatggaaaatgatctgatagcaaacgccaacgctatcagtattcctgctgttgtcaatgttctaagatctttcagtgacttgaaagagtcatagaacattcttccgaagctcttcataaatttacctccttattctgcgagcttgtcgctttgtgcataacggagcataaaaacagctctgcacactacccatgcgggatgtgcagagccgctataaaaagcttcaattacacattcagcgggatgcgaaaaccgaaccgcaaaggttctgcctttttcgttccgacggcaactccccgtccgacggacacttaacgctcagttttctactctgtaatatgtcaaagtcttaaagactcagacctcatgaaaaattagaatgcagtttcattgaggatcttgtaaagctcttcctcgaaaggcttcttcattgaaagagcctcctgaatatctacatcatatatcttgctgtccttcataccaacaactctgttgccaatgccctgctctagcagttcaacagcgtgatagcccatttcagttgcgacaactctatctcttactgtaggagagccgcctctctgaacatgaccgagaatagtagctcttgactcgacaccagtaatatcctgaagagttcttgtgatatactctgtcttgccaacaccctcagcaactacaatgataaaatgtgtcttgcctgacttctttgtctgctccatcttctgagcaatagcattgaggtcataaggcttctcaggtgtgataacagcctcagcgcctacagcagcagcaacgttgatagcaatgtgaccagcatttctgcccattacctcaactactgaacatctgtcatgtgactgtgctgtatctctgatcttatcgatcatttccatagctgtgttcatagctgtgtcataaccgatagtatattctgtgcatgaaatatcgttgtctatagtaccaggcagaccaatgcatgggataccctgtgctgaaaggtcagccgcacctctgaatgagccgtcaccaccgataactacgataccgtcaagacccatttcaagacacttatctctgcccttctttacgccctcgatatctctgaattcaggacatcttgcagtataaagacaagtaccgcctctctggattatgcctgaaacagttcttgcattcatctcaataacttcaccattaagaagaccgttatatcctctgaggatacctacgacttccataccctttgcaagaccagctctgcatactgctctgacagcagcgttcattcccggagcatctcctccgctggtaagtacaccaattttcttagccatgtaaaatacctccaaaccaggaaacaatttatcctgttactttcctaataatctataatgagcatagcacaaagcccctgaattgtcaagggctttgtttgttttttaacattttattaaacgttttcgttattcagcaggcacaacagccggaactggtgttgtttcagaagagctgcctgtgttcgtatcaggcttaggctctgttgcctttgttgtagtggtcgtagtagtcacaagacctgcggaaactgtaactgtaagcacatcaccatttttaacattcacagtgtttccaacattaacgcttgtcgccataacatatcctgcagaaacagagcttgagaaatcggtaacgaccttatacttgatattataagaatcaagcagctcaaggtaagccttctttgacaggccagagaaatcaggaacaggaacattttcagggcctgcacatactttaagaacaagctcatttttcaaagacggatcaaaatcagtgccctctggtatgctctgctctttaacaacgtccttatcgtcaacatcagaataataatattcagctttgatagtaaaatcctcaccaagctgttttacaacagtattgtattccagacccacaacgttaggcattatagcgccatagccatattctgactgactttcagcatcagtcaccttaggcgtagcaactgtggtgctgtaaacgaatacctcgctatcaactccatctgcatcatcagaagaaatgaccttatcctcagacgaatcattattgctgtccgacggacctgaaaacaactcatatagcagaaaaactgaaagcaaaagcactataacaagcaccgtccagcctattatcgtagccgttttattcttaggcttttcttcctcacgagtctgctgtggcatttgccttgactgcgttctttgtcttggaacatgctgtataggaatagtctgagttgaacccttagggtgttccatatgcgttgtatgctgctcaaaaagtgcagtaacaagctctgaaactgtctgtattctttcttcaccacgaactctcatagctcttgaaagaactcgtgagatatgctgtggtattctcggattgactctgcaagcttcgaccatagtatcattctttgtacgggtataagcgtcaaggggcatacagcctgttagtattctataaagaactgcagcaagtgcataaacgtcagtccatgtgccctgccattctaacgaagaatattgctcaggggcggtatatcctgaatagaactcaggagaaagccctgtattggatgttcttatagaacttatgcaaaagcctgtaagtttaagctcacaatcagttgtaacaataatattttcaggagatattcccctgtgtatgatacctgcattatgtataatgctcaatgttgtaaacaatggcacaaaaagctttttgacctgttcccatgtgagaaagcctgtatttgactgtaaaaatttctttagcgtcacgccctccacatattcgagtatgacataggtcgtattattctcgcaaaacatatcctttgccgtggcgatatgctgaagatttctcatgcgtgaaagaactttgttaacgtctgcaaactcagacataaatgtcttatacttagccagacaatctggattcaccacaagtcgctgactttcgctatctctttcgcaaagagtgtcaggcatatactctcttgccacacacttgcatttgccaaccatatcgtagcaaatgtaagacgcaccctcaccattatatgaaagcatttttccgactatatatctgttgtcaagcactgttctcggtgcaagataagcctgtaaatgcgggatatcgtcggtatagctacaataatgacagcgaccgtcagaaccaagttcgttcatacagcccatacataacttagtactaggatccataccgaacctcctttttacgttattcatcaatttatattagcaacaaaccgagcataagtcaagtttttttgtgcaattgtagaatttacgcaacaatttgtatttcttttgtaacattatgacccttttacagatactcaggataaataagcgtagaagaataatacagatacttattatccgtatcgaacgttacattaagaaccactggttgtttatcacctgcgtcattatcataccaatagcggtatatataatttttagtgtcttttgaccatacgatgccgtaatattcaaggtctatggtatctgacaagccactccactttgcaccttgttcaaacttatcaaggttgatagctttactctttttttcaccgtttgcattgtttttaagcaccttgaaatttgaatattttacggtttgtatacgttcttcatcatcaacagtaacaagtgccgcccattcaggataatttatgccatcaacattaacactgtcatcagactcaatgatataatcaaaattcagtgcattgttcactccctgaaaagccgattcgtccttaaaatgcatatcaagctttttctgagcctttgcaacatctacgccgatatattcagaaatgctctcagcggtgttttcaccctttccgcttataatattcacaacgataaggacgacaagcaccacaaggagcactaccgccactgttataagaataagcttgagcttgctttcagacaatttatgttttttctcacccactatttccacatttagcggtttattctgctttttgaaacgcttcatgatagatgtatttttgtctggtcttaatcttgtgtcacagttaggacaaaaaatgtcatcatcgtcaactgacttgtggcatttaggacactccataaaaacaactcccttttgcaacatccgtgcatttgcacaccttttcaaaacaagtataccataatctctgtaaaaagtcaacaaacgcaaaacagcggacagaagtctatccgctgtaaaaaacatatatcagaagtgcatctggtcagggtcttcgatatcctttgcaaaacagcctgcaacaggtatcgttttgctgcgatattttgaaaggcctgctgctgtctcatcgtcaacgataaacgccttatcaacaactgcattcttcgctttaagtgtcatgacctgaacgcctatagtatctctcgtggacttaggcataagaagcgctgtatcaaatatcattgctctgccgttagttgtgcgaagcattatctcagcgttatcctgcacaaagaacattcccacaagcttagcctttgcagaataagcgttggcaagcttctttctgttggtctttgtttcataggcattgagcggcacttttgccacctttccgttttcaaaacagaatatcatatagcccgaataatctacagtattcaccatggacacaacaccctcaccgtcatcaaaaccaagctttgcaggaatatagtcgccaagagagcttgcctttgtgtcggcaaactgcgataccttggtcttatacacagccgccttgtcagagaagaacagaagctccgttttgttggtgctttccatttcctgaagcggaccgtcgccctctttatacttctgctcgcttgccattctcagtgattgcggagtacatttcttgaaataaccgctttgagataggaaaagcttgcaggcgtagtcagggatatcgtcctctatgtctatctcctcgatatcagtcttataatagaactgagtttttcttggctgaccatacttctttgaaacttcctttaattcggaaatgatgatattctttatttttctgtcgcttccaagaatatcttcaagctctgcaatagctttttcaaggtcctcagtttcggctgttcttttgaggatatactcacggttaaggtgtctgagctttatttcagccacataatcagcctgtatctcatcaatgccgaagcctatcatcaggtttgggacgacttcggtttcttcctctgtctccctgattatttttatagccttgtctatatcaaggagtatctttccaagacctttcagaaggtggagcttgtctttcttctttgcaaggtcaaagcttgttctgcgtcgaacgcaatccattctgaacgctacccattctttaattatatcataaacgcccattattcttggatagccgtgaacaagtatatagaaattgcatgaatacgagtcctgaagcggtgtcagcttataaagcttttgcataagcttgtcagggtctacgccctttttgatatctatacctattttcagaccgttaatgtccgtttcatcacggatatatgatacctctcttatcttgcccgccttaactagagcaattatcttctcgattattgcttcaactgtggtagtggcaggtatctcaacgatctcaagacaccttgactccttgtcatactgatattttgctctcagctttacagagccttttcctgtgcggtatatcttatcaagctcctcctcatcatagagaagtgaagcacctcccggaaagtcaggccctttcagcgtttcaagagcgttgaaatcaggatttttcataagtccgatagttgtctcacaaacctcgctaaggttgaacggacaaactgatgaagccatagaaacgccgataccaacgtttgcattaacaagtattgacgggtaagtagcaggaagcaaggtcggctctgtggtggtgttatcatagttaggaacaaaatccacagtgtccttgtctatatctccgaaaagctcctgacagataggcatgagctttgcctcagtgtatcgagaggcagcatacgccatatctcttgaatatgccttaccgaagttacccttactcattacatatgggtgcaaaagcgcttcattgccctgtgaaagtcttaccatggtttcatatatagcaccgtcgccgtgaggattgagcctcatggtcgcaccaacgatattggcagactttgtgagctttccgtttaaaagtcccattttatacatggtataaagcagttttctgtgtgagggcttaaagccgtctatctcagggaacgctcttgataccaaaacgctcatggcatatggcatatagttcttttcaagagacattgttatcttttcatctgcaacaagtcctgcaccctcgatatatgcgttgttatttggtttagcagtctttttaggctctgccttttttcttgccataaaatctatcctttctgcgccgaatatattttcagatgcaaattatgaaatatccgccatatcaagataatcaacaccattattggtgatgaaatcttttcttccctgcagatcgtcacccaagagcatatcgaacatccattgtgtctgctcgatatcgtcaggttctatctttataagacgtcttgtggcagggtccattgtcgtaaggctcatcatctccgcctcgttctcgccaagaccttttgaacgctggatatcaaactttttattgcctatcattttgagtatcttcgtcttttcgttctcgtcatatgcaaagtaagtcttgtcggaagtcgtaatctcaaagagcggtgactccgcaatataaacatatcctttttcaataagggtcggcacaagtctgtaaagcattgtgagtataagcgttctgatatggaagccgtcaacatcggcatcagtacagataactatcttgttccaacgaagattgtcaagattgaacatagatatctccttattcttgccagtcttgacctcaacgccgcagcctatgacttttataagatctgtgattatctcgttcttgaaaatcttatcatagtcagctttcaaacagttgagtatctttcctcttacagggataacagcctgaaactctgcatttcttgccatttttacagaaccgagcgccgagtcgccctccactatatacagctcacgctgagaaaggtcttttgaacggcagtcaacgaatttctgcacctgatttgaaaggtcgatagagcctgcaagctttttcttcaggtctattcttgacttctcagccttttcacggcttctcttgtttacaagaacctgctctgctatcttcaccgcttcgtcaggattttcaataaagtatatctcgagattgtgcttcaagaactctgtcatgcactccttgataaacttgtttgtgatagctttctttgtctgattggcatatgaagtctgtgtagaaaacgaacttgaaacaagcaccaagcaatcctcgatatcctgaaaagtaataggcttttcgtttttcagatacttattgttgcttttgagataagcatttatctgagatgtgaaagcactctttacagcgtcctccggtgagccaccatgttccagaaagcttgaattgtgataatattcaagacattttacctgattagagaaagtgaatgccacagaaagctttaccttataatcgtccttgtcctcacggtcacgacccttgcggtcgcctgtgaaaaactgcactgaggtcagaggcttttcacctgctatctctgcaacataatcggcgataccattctcataatagaacgtcttttcttcaaaagaattgttctcacgctgtatacgcaggataaatgtgatattagggtttactacagcctgctttttcagaacgtcttcaaaatattcgttctcaatttttatatcagtgaaaacttcaaggtcaggtcgccaatgtgtctttgtacctgtctttttctgctttgtttcttcctttttaagaccgccaacgtttcttcccttttcaaagtgcaggtcatacttatatccatcacggaaaacctcgacgtccataaactcagatgaatactgcgtcgcacaagcacctagtccgttaagacccaacgaatattcatagttatctccgccgttattattatacttgccgcctgcataaagctcgcagtaaacaagctcccagttatattttttctcacgctggttatagtcaacaggacaaccacgtccgaagtcttccacctcgatagaatcgtcattgtactttgtaacgattatcttatcgccatgaccatcacgagcctcgtctatagagtttgaaagaatttcaaaaacagaatgtttacagccctcaagtccgtcagagccgaatattaccgcaggacgctttcttactctgtcctcccccttaagggatactatatcttcatttgtatattcctttttatttgccatttctcatttcctttcttacggatctgaagaattttttacatacaaattatattataacacaaagtcaacgattttgtaaatacattaattaaacatttttcagagcaaagccgaacatttgttttgttactaataaacaaaaacataggctattgattatttgaaaaaaatattatataatataggtagcttaaaaaaatcggaggacaaaatggatattacgataaatgcaccgcagaccgaaagcaactcaaactctgccaaagcaatgtcccttaacaatgggctgatatggttcatatgcttcgttccgcttatcggcttgtttcttgaaaactatgcaaactctgccactgcaggagcgttcctgtggatacttgttccgctgttcatgataggctgttccattgcagattgcaaacagcttataaagcatggcattgatgctgcacaccttttcaaatgggtatggctaacacctttttatgtttataagcgtgaaaagctttgcggcagagagctttacaaagcaataatgtgcggatttttcattatcgctgcactgttcatgaatggttttacgcagagcataaaaatagacaacaactatatgcttatatccgcacagaacagttatgtacaaagccttgacaaattttcgggaaattcagcaaaggtaatcggtgagtgcatagcttcttatctaggcgaggacgcaaagtgggattgcacaaagaacggtcacaactacacagtaacagtaaaaggcaaacatggctctgataactacactatttactttttaatagtatatgacggcttcacctacagaaaattcaccatttcagacgtgataaaaaataaagtttcactccgtgacgatgaatttagtgctgtatgcaaagagatattcacagaagataaaagcgacaccgacagtagcaatgaagaaagttcaaattcacaaacagaataatttcatggggctgtaaaaaaacgcgcaataaaaaaagactgcaaccacccttaaaagggtaggaaagcagtcttttttgtggtataataaatttgatgaaaaaatacttgagcttatggacgttgcagataactgagcttcgcaggaagatatactttactaagatattgtgatttaatacagctaaaagatgcagagaaacccattgatcgggtttctctgttttttcgcacaaaaaaccacccacagccaaatcagtcgtgggtggcaatatcattttaaatatacactattctttattttcccagcgctatcttgcccattgcgtctgcctgcatgatagcgtcataaagttcgataggctgtacgtcgcctgcaagattgtggatagtttcgcctgggatacaagcgttctttgcgatagcttctacctgctcaggtgtagttacaccgatctcctcgagtgtgacaggaagtcccacttcaaggcagaagttctgtacctcttcaaactcttcctttggcgcaccctcaagtacaagctgaaccagtgtaccaagggctacacaacagccgtggtctgcgtgcttgattcccaatgatgttacgccattgtagaacgagtgtgcagccgcacagtttacgttatctgctccaacacctgaaagatatacgttagcctcgcagatagcttcaagggcaggtgtaactgcgtgtaccttgcaagcctcaactgcctgcttgccgtatgttttcagcgtgtcatagcaaagtcttgcaagtgcctgtcctgctcttgtgatgcctgtgccttcaaggcttgcggactctgttcttatggaagctctgccctcaaaatatgtaccaagtgcatcgcccatgcctgcaataaggaactttacaggtgcgtttgcgataactgttgtgtctaccattactgcgtctggattggtaggatagaaaagatatttgtcaaagctgtggtcatcattgtatattactgacagacctgtacatggcgcatctgttgcagcaactgtaggcacgataacaatgtgcttgcctgtgtagtatgctgtagcttttgcagtatcaactgcgcttccgccgccaactgcaactactgtgtcgatgttgtcagcctttactatctcttccattttggctatctcgcccttgcttgatataccaccaaatacttcatagcgtctgtaatcgtcaagctcgccaaagcttttctctatcttgtcatgacaggctttgtagccactgtttgaacatacaaacagccaccttttgcccatatagcccatttcttcatgaaacttaagtgtagcatctctgccctgaacatatttgagcggctcacgcattgctctgagtcttcccatcataatgaattacctccgatttgtttgatttattaactttatacggaattctctccgtattttcaattagattatagcattttgcacaaaagatacaagaaacattttataaatgatatgtgaattatttgttgtggcaacatttgaaaatgtaaagcttggaggacgataaaatagaaaaagcggaggctctttgcgagctttccgcctttttcatatgttcagcattacggaagcgtaaaacattccgtcaccgtattcaaatttagctacgccattgtatttggcggcaatgttcttgacagactctgtgccgatccctttgcctttgcgttttgaggaaaggaaaccgccttctgggtcggtgaggatagttccggtgaaggtgttgtccaccgccaggcagagggaatagctgtcagcctttgctctgattattatttttttattctttgcactgtcagacacgcagccgtgaatggcgttttcgataagatttccgaaaagcacagagaggtcggttatgtctatttttatatcatctggtatgtcagcgctcaccttgtattcaatgccgctgctttccgctatttgagcaaaatatgcaagaagtgcgcttacagatgtgtttttgcagtaaatgcgttctgatatatcgggcatagaatccctgaaagaattgagatattccgaaagcttatcatattcgccctttttcagaagctcctgcataagagcgatatgatgtctgacatcatgcttatagcgtcttgtttcttttatcttatcctgcaaatagtcatattgcaggttctgcatttcaagcaggtggttattttcctgaagccgcagatttttctgctgttcgatgaccagccgtgctacgatgtaatacaccagaaacgcccctgcgtttataaagaacagagctatggtgttctttggctccagagcaagctctaagctgcttttcgtagagttgccgtagagcgtatagtaccatattatatagaacgtaaatgggataagccaaagatagcgccactccagacctgacggctctctttccaccgcaggtgtgtagacctttttcatgtagataaaaagcggtccccataccacggcttctgtcataagcatacaaagggaaaacgaccagcggtatgactcataggcaagtgacgggaacagaatgccctccagacattttgaggtaatgacgataaagcttgcgttatttgaaagcaaaagcagtgtgaagcctgttttgcccacctttaccttcacagcgaaaaagtaaaaagccgcatagagcagggtgctgactgcacttagcagacctgcatttgtgctgaaaaatgccgcctgccaacctaagaagatctgcaccagtgaaagagccacaacaagtcccacggtagctgttttggaaaagcgaagcctatgccggaagggataaagggcaagcaccataagtggcagaaaattcagaagggaatatatgcccacttccacaaggcggtataaaggaggcattactgctcaccgccttttcgcagatcactgaagcgaaactgagcgaaggcgtctagtgtttctctggattttcggcgacttatggggatatgtgtgccgtcgctcattatgaaaaggtcgcttttttgctgggctatctcatagaaattcacgatgacgcctttggtggaggtgtaaaagtatgaatgactgcaaaaaatgttctcgatctcagcgaaagaatttcttgaaactatgctttcaccgtctgtgcaatggattgtcacgatatgtgacgcacagtctatgtagataacatttctgagtatcacgttctgaccgtcgggaagcttaacggaacgcatacgatcaatttcatcagaaccgatccggtcaagcatggtttttactttgtcagcctgaaaaggcttgcaaagatagtagcaggcgttgaggtcgtagctttcgcttgcaaactcgttgcttgaagtgccgaatgcgatatgcacgtttttgtctgtttcacgaagcttttctgcgacctctatccctgtcattttccccatgaatatatcgagcaccaccagatcataagctcccatctgccaacatgacaaaaagctttctccgcttgaaaacgtatctatctgacagctgtgggcggtttgttcggaaatatattcatgaagaagtgcaaggtcgtttttattatcgtctaccaatgccactctcatactgtaaaaatcctttcttatacatgatttcttaatatataataacacacatcaaagcaaaattcaagcattattcatttattttgttaccacttgtgcagatttttgaccgtttgtgccaaatctattgacaaagtgtgtaggctgtgttaaaataatcgagtaaaattatgttctgagtaaaaaagaaatatcagcaacaaaaaatattatggaggaattagaatgaaaaagaaaattttaagtcttttggtgacgggctgtcttttgtttgtgccgacaacggcatttgcagacgataataagacggtaataaaaactgttgacgacctgttggcgttttcaaaagcggtaaacaacggagattatgacaagaataaagacgcagttgttgttcttgaaaatgaccttgacttgacaggtgttgtatggacgcctatcggaaacgttttcgatgaaaacggctatattgaacattgtttcagcggcaaattctacggaaacggtcatactatttcaaacattgattttacgtctatttatggtaaagacgtgttggtcggtttctttggcgatatcgaagaagcagaggtatcaggtctgactatagagggaagtattgatgtgacaaatactgataacgactatactttttatggcactattgcaggatttgcaggtgattgtactatttctgattgtgtgtcaaacgtatctttcaacaataacggcaaatatgtttatggcttaatgggcatggtaggtcaggcagacggcacaacttttgagtattgtgagaacacagcagacataactatctcaggcgacagcggaagtctttatgtgggcggtatagttggatatgcacagaatggaacggaagtccgctattgttcaagcacaggcgatatggtatatgctgcaccagacgccggcggtatcgtaggatgtttgtatggcgattccaaggtcataaacagctatgttacaggaaaactcacgccggttggcaacggaaccacagatgtaggcggtattgttggttcagtagccggcggttctgtaagtgattgctattttgcaggagaaattgacctttcacagtattcagccaaaaagccatatacacgtttcggcggaatagtggggaaggattcctcgtctacacctgactttaaaaacaactatttcacagaaacagaaaatgttgaagcttgcggttcaaataaagaagcaggcaaggctaaatcatatgactatatgacaacaaaagaattttatgacgagctgacagccgacggtgcaaagtatcagtatgttgagggaaaaacacctgtcctgccaactaaggaatatgcagttgattttgaagtaacacctgctgacctgaaaaatgttgtaataaaggtagacggaaaagagataacaagcaatactgcaatgcttacagcaggcacttacactgtagatgtaactgctgacgattgcgagcctctcagcaaggaaataactatttcagcagatatcgcaacacatacacaggcttttgaacttgcatacaagtcagcagactacacagagcttgacaaggcagagaaagccgcaaaggctctcaacaaggacgattatgaggacttctcagaagtcgaaaaggctcttgccgctattgacagaacgaagaacatcacagagcaggctgatgttgacgctatggtaaaggctataaatgacgctgtggcaaaccttgtaaagaaaacacctgcttcttcacagcctgatagttccgcttctgacagctcatcagccgacagcaaggcagacagcagctcaaaggcagcttcaaacgcttcaaacacaaacccatcgaccggcgttgctggaggagcattcgctcttgcacttctgagcggtgcggctgtggtcatggctaagaagaaaaagtaatatatccattaaatagatatataaaggaagtaagtgggactttcatatattatttgtttaaatgaataccgcttgcgcagatttttgacggcttgtgtcaaacttgttgacaagtgtgtgggttgtgttaaaataatcgtgaaaaatctatgctctgagtaaaaaaatatcaaccccgaaaaatataatggaggaattagaatgaaaaagaagattttaagccttttggtgacgatgggtcttgcggcaagcttagtgcctgtttctgtttttgctgacggtacagaggtctgggacggctctatagcggagtcttttgcaggaggaaaaggcacaaaagatgacccttatcaaatagctaatggctcacagcttgcgtattttgcgaaaagagtgaacgcagaggaatatggtgaaaaatatgcagacacatactttgagcttacagaggatatcgacctcggtggaaaagagtggactccaataggagaaactgtggcagaccttattatgggtggtcatgaatattttgttttctctggcaactttgacggaaatggttatactatcaaaaatcttaccattggaacagaaacatcgccatacagtggcgatgtatgcggcttgttcggtgcgaccagcggcactatcgaggacgtagttcttgaaaatgtttctataaactatgttggcggaaatcacagcagtggatatggcttccgcatgggaggtgcgcttgtaggttattctatgggcgatatagtaaattgtactgttatcggtcttgacatgaaggcaggctctgacggcagctatgttgctcttaacagcataggcggattagtaggcattcaggacggagatacaacagtgagccacagccgtgtttccggaaagatagaggaatcaacaaaaaagggcaatgttggtggctttgttggtacgctcgcaaaaggctcatctgctaaatattgcggtgcagacgtttctgttgaggtaacaggaaatggtcgtggtatcgcagtaggtggcttcgttggaataggtaatggagtgacaattgatgaaactttgatagaaaattgctatgccacaggcaatataacaggtgcagaatatgcaggcggctttgttggaaacatctcaggtcttaacatcagcaactgctatgcaaagggcgatgtaagcaactgttttgttggtgcgtcattcttgggtactgacgctgcaagcaataactattatggcactgtaaagaattgctatgcaacaggtcttgtatctgatatttcttcttccgcttatgcttttgcaatgcaagatacgatgaagagaagtacgattcaaaattgctactacaacatacaaaatacagcaaaaaatacggaatcagcagcttctcttactattgacgatatgaaaacagacagctttttaaatgtgctcaacggctcatcaaacgtatggactaagcgtgataacgatactcctgcctgcggtgctgagcctgctgactacagcaatgtttatgaagtgctgggtaatattcctgccgacctttctatctacacagatgaaagcgttgcaaacttgtacagtgcagttgaggctttaagagggtatagagatcttgcacagcagtcagatgttgacaaaatgacaaatgatataaacgacgctgttgaggcacttgtttacaagtcagcagactatacagagcttgacaaggcagaggaagccgcaaaggctctcaataaagatgattatgaggacttctcagaagtcgaaaaggctcttgccgctattgacagaacaaagaacatcacagagcaggctgatgtggacgctatggtaaaggccataaatgacgctgtggcaaaccttgtaaagaaggcacctgcttcttcacagcctgacagcgtaagtagttctgatgcttcgtcagatacgagcaattccgcttccgacagctcatattctgacagcaaggcagacagcagttcaaaggcagcttcaaacgcttcaaacacaaacccatcgaccggtgttgctggcggagcattcgctcttgcacttctgagcggtgcggctgtggtcatggctaagaagaaaaagtaatatatccattaaatagatatataaaggaagtaagtgggactttcatacattatttgtttaaatgaataccgcttgtgctgatttttgaccgtttgtgtcaaaacagttgaaaaattattaccgctctgctatcataattataagcagggcggttttatatcgcaatgcaaatatgatatgaagtcttatatttcgggaggataaaatatgaaaaagacaagaatttttagcacaatgctcgcaacggtcatatgtatggcatctttgcctgcaataaatgtttttgcggcaaatcagcagagaactacaactcttgaccttacagtggcaggatttcagaacgatcagaaaaatgaagacgagggctggagctgggacgctgatactctgacgcttactcttgacaatgtagatttttctacaggaaataagtcgagtataaaagttgacggcttaaagtctacaacgatacttttcaagggtgaaaacaagcttgaatcatcagcaactattattagcaggacggatagaggctcaaaagatactggtttgactttaaaaggcgaagctaaagaaagtaagcttagccttgttgaaacaggcaatcttccttcaatggatcagccaaatatcacctttgagtcaggtacagttgatattcagggcggtgcagccattactttgtataccataaaagtaatggaagcggctgtgaatattgatacaactatggcagaccctgaagatggttggaacgatggtctgtatgctaacggttctatcgagatatacggtggagaggtcaatgttaaggccggaagaataggtctgtttgttgttggcataggcgctcctgagccaaagacaggtcttagaatagagggcggcaagcttgatcttgagggtggcctcgctgacgtatatctgggttctggtaatgttaagaatggcattatttcagcgggcgatataacgcttaaagtcaaaaaaggtattttcctctatgattgtgaaaagtgcgagataacaggcggaaccttccatgttgatgagtgcgaggatccgtttatggcacataagaacagctcaggcgtttttgagatagctgacgctgactacacaaaagtagacaaagcagaagaagctgcaaaggctcttaataaggacaactatgtggactttacagccgtagaaaaggcacttgaagctatcgacagaactaaaaaccttacacagcagtcagatgttgacaaaatggcgaaagacataaacgatgctgttgaggcacttgtttacaagtcagcagactatacagagcttgacaaggcagagaaagccgcaaaggctctcaacaaagacgattatgaggacttctcagaagtcgaaaaggctcttgccgctattgacagaacaaagaacatcacagagcaggctgatgtggacgctatggtaagggctataaatgacgctgtggcaaaccttgtaaagaaagcacctgcttcttcacagcctgacagcgtaagcagttctgatgcttcgtcagatacaagcaattccgcttctgacagctcatcttctgacagcaaggcaactgacagcaagtcagacagcagctcaaaggcagcttcaaacgcttcaaacacaaacccatcgaccggtgttgctggaggagcattcgctcttgcacttctgagcggtgcggctgtggtcatggctaagaagaaaaagtaaataagatctcccctattgttgatatttcggagaagggcagttccttgtggactgccttttttctgtttgcaggaaagcggaatttgcctgcataatttggggcgtttttttgcaaagaagcataaaaatgcaattattttatattgatactgcaaaatcgtctgcgcaagcttagactaactattgataatagtcaatatcttttattatctattttataccatgaaattacatttattcataaaaaatcgttatagatttaagcgaaatgtaaaaaatcagctcacaaaatctgcgtttacccttgcaattcagaaaaatatgtggtataattatattgctgtaataggagcacagcatgaaatgctggcagtgtgttttcaattgtcagatgaatttctgtatagcttatgctttataataaggaaagaaaatgaatgtgccggcgtgtgctgtttcattatagcgcctattaacgatatttttttttgaaaaggagttattgcaacatgtcaaagatcgatttgagcaagtacggtatcaccggaactacagaagttgtttacaacccttcttacgagcagctgttcgaggaagaaacaaagccaacactcgaaggctatgaaaagggtcaggagagtgagcttggcgcagtaaacgttatgacaggcgtttatacaggccgttcacctaaagataagttcatcgttatggacgaaaattctaaggacactgtttggtggacttctgacgagtacaagaacgacaaccacccagcttcacaggaggcttggaagtctgttaaggaactcgctatcaaggaactttcaaataagagacttttcgtagttgacgcattctgcggcgctaacaaggatacaagaatggctatccgtttcatcgttgaggttgcttggcaggctcactttgtaacaaatatgttcatcaagccaactgctgaggagcttgagaactttgagcctgacttcgttgtatacaacgcttcaaaggctaaggtagagaactataaggagcttggtcttaactctgagacagctgttatgttcaacatcacaagccgtgagcaggtaatcatcaacacttggtacggtggagagatgaagaagggtatgttctcaatgatgaactacttccttccactcaagggcatggcttcaatgcactgctcagctaacacagacaagaacggtgagaacacagctatcttctttggtctgtccggtacaggtaagacaacactttctacagatcctaagagacttcttatcggtgacgacgagcacggctgggacgacaacggagtattcaacttcgagggcggctgctatgctaaggtcatcaaccttgataaggattctgagcctgatatctacaacgctatcagaagagatgctcttcttgagaacgtaactcttgacgagaacggcaagattgactttgctgataagagcgttacagagaacactcgtgtatcttatcctatcgatcatatccagaacattgtaagacctatttcttctgcacctgctgcaaagaacgttatcttcctttcagcagacgcatttggcgtactgcctccagtatctatcctcacaccagagcagacacagtattacttcctctctggctttactgcaaagcttgcaggtacagagcgtggaatcactgagcctacaccaacattctcagcttgcttcggtcaggctttccttgagcttcacccaacaaagtatgctgaagagcttgttaagaagatgcagaagagcggtgctaaggcatacctggtaaacacaggttggaacggcacaggcaagagaatctctatcaaggatactcgtggaattatcgacgctattcttaacggcgatattctcaacgcacctacaaagaagataccacactttgactttgaagttccaacagagcttccaggcgttgatcctgcaattctcgatcctcgtgacacatatgctgacgcttccgagtgggagacaaaggctaaggatcttgcaagcagatttgttaagaactttgctaagtatgagggcaacccagcaggtaaggctcttgtatcagcaggtccaaaggaataatcaataactctgatactattatatagtataaaagctgctgtgccttttggtacggcagcttttttgcgctcttgaaaaagtgttatgaaggtggtataattggtatggaggcggatttagtttggaaaagaagaattatgccgcaagggcggctatatatgccatggggcttgtgatacttgccgcagggataacgatgaacaccaaaacagggctaggtgtatccactattatatcagtgccatttgccatatcgagtatatgggacgtgaatttttctcttgtgacttttgctacatatgcactgttcgttgtgatagaaatgataataaaaggcagcgacagaactgttatagactggctgcaaataccattcagcattgtgttcagcctgctgctgaatatgttttcaaagctgcttgattttaatttcggacatttgtggcaaaacacgctgtatcttgcagcagcgataatctgcacgggtgctggaatgtcaatgatgatagccatgaagttcgtgccgaacccagccgacggtcttgctcaggctataggaaaagcctttggaaagaacatgggctttggcaagaatatacttgacgcatcgtgtgttgccattgcctgcgtgataggtctgctgtttgacaagcggataataggtatcggtatcggaacggtggcggcaatgctacttgtgggaaggtgtgtggcagtattcgaccatttctttaaagacagaatgaaaagtgccgcagggcttgcataataaaaaacgccgcagaggacagatatctctgcggcgtttgtgtatttacataataaaaaatccgctctacataacgtaaagcggatacaagcaaaagcttaaacttttgctggcgcggattgagagatttgaactctcgcgcccgtttccagacctactcccttagcaggggagccccttcaccacttgggtaaatccgcaaacctgtatatataaaaaatgtggcggacagggtgggattcgaacccacggtacgttgccgtatcactggttttcaagaccagctccttaaaccactcggacacctgtccacattaattatttgtttttgtgtcgttctctctcagcgacttaattattatagcacagttcatctgtcttgtcaacccttttttcaaattttttttgcgaaatttttttgaagcataaatattccttcgtatgctaacgatacttgacgaaatcttataaatatggtataataaatcacagctttgtatgttttatcactttatatgataatttatacagaaaatttcttatggaggcgactttattatgaagatgactgtaagtcaggctatggttgaatgtttgaaagctgagaacgtaaaagtcgtctttggctatcccggagctgctatctgtcctttctatgacgctttgctggatgctgaaaacgacatcaggcaggtgcttgtgagacaggaggctaacggtggtcatgcggctaacggctatgcacgaatttcaggcaagcctgcggtctgtatcgctacatcgggtccgggtgcaactaatcttattactgctattgctaccgcttatgcggattctatacctatcgtgtgcataacaggtcaggtgaataccgaccagataggctctgacgtttttcaggaggctgacattacaggctcggctgagccgttcgttaagcacagctatcttctcaaagaccctgaggacactgcgagagtgttcaaggaagctttctatatcgcaggcacgggcagaccgggtcctgtgcttatagatatccctatggacgttcagaaagctgttatcgactttgagtaccctgaaaagtgcgagataagaagctataagcctaccacaaagggcaactacgttcaggtaaggcgtgtaatggcggcactggaagaggctgagaagccgcttatctgtattggtggaggtgtttttgccgctcacgctgagaacgagataagagagcttgccgaccttatgcagatacctgttatcacaactatgatgggcatttctgttttccctgatgacgaccagcttttctgcggcatgataggaactcacggtgttaaaatggcaaacgccgctgtgaacgagtgcgacgtgctgttccttgtgggtgcaagagttggcgacagagccgttaaaacacctttggctctggagaaaactactaagataatacatatagatatcgaccctgcggagataggcaagaatatcggtgctgacctgcctctcgttggcgacgcaaagcttgttttacagcaaatgacggagcttgcaaagcctatgaagcacgatgagtggatagctcacatcaagacccttgggggcgagagaaagtatgttgagcctgcaaagggtactgtaaatccgagggtgtttatcgacaggcttgcaaagaaaatgcctgccaatgttactgttgtggcagacgttggacaaaatcagatatggacctgcactgaatataagttccgcaaagagggcagacttcttacctcaggcggcatgggtacgatgggctattctgtgcctgcggcaataggtgcaaaaatggctgacaacagcagagcaacagttgctatatgcggtgacggagcttttcagatgtcgttcatggagcttgcaacagccgttcagttcggcgttgatataaaggtggtagtaatgaccaacaaccgccttggcatggtaagagaacttcagacaaatggctatcatgacagacagacagcagtttttcttgacggctctcctgactttatcaagcttgcagaagcttatggcatacctgcaatgagagtttatgacgatgatactatggaaaagggcgtggaaatgcttgctgaacataaaggcatttgccttgttgaagtcgttgtggataaggatatgccaacattataaggctaatattttaactatctgtagcgtttacagtatatagcgtttacgttcaaaaaatcttaataataagctggtataataaagaatcaaggaaaggtttccttatggaggttgatttatgaaacatacgatctcagttcttgtagaaaaccacagcggtgttctatcaagaatttccggactgttttcaagacgtgggttcaatatcgagagccttgcagtaggtccaactcatgaccctgacgtttcaagaataacgatagttgctgacggtgacgagcatacagttgagcagatcgagaaacagctcaataagcttatagaggtcatcaaggtaaagacatttgaggctaatgagtatctcgcaagagaacttatgatagtcaaggtgtctgcggtcgcaaacagacgcagtgagataatgactattgcggatatcacaggggctaaggtcatggatataacgcttacgacaatgacattggagctttgcgacacttacgctcacctttgcagatttgaggaggtcatagcaccttacggaataatcgaaatggtaagaacaggcactatcgcaatagagaaaggctctgacacattcaatgcaggcaaataaactttgattatatagccgaaaggctacataaaataaatcttaaatttctgaatttggaggaattaacaatggcacaggcaagaatattctatcagcaggattgcgacattaacgtactcaagggtaagagagttgccattatcggttacggttcacagggtcacgctcatgcactcaaccttaaggagagcggtgttgacgtggtagtaggtctttacgaaggttctaagagctgggcaaaggctgagcagcagggtcttacagttatgacaactgaggaagctgcaaagacatctgacatcatcatgatccttattcctgatgagaagcaggctgcactttataagaaatctatcgagccatacctcacagagggtaagactcttgcattcgcacacggctttaacattcactttggctgcatcgtaccaccaaagaatgtcaatgttatcatgatcgcacctaaggctcctggtcacacagtacgttctgagtaccaggctggtaagggtacaccttgccttatcgcagttgagcaggacgcaacaggcaacgcacaggatatcggacttgcatatgcacttggtatcggcggagcaagagcaggtgttcttgagacaacattcagaacagaaacagaaacagacctcttcggtgagcaggctgttctctgcggtggtgtttgcgcacttatgcaggctggttttgaaacactttgtgaagctggttatgacccaagaaacgcatactttgagtgtatccatgagatgaagctcatcgttgaccttatctatcagtcaggttttgagggcatgagatattctatctctaacacagctgagtacggcgactacatcacaggtccaaagatcgttactgaggacactaagaaggctatgaagaaggttctgtctgacattcaggacggtacattcgctaaggacttcctccttgatatgtctgacgcaggttcacaggtacacttcaaggctatgagaaagctccacgctgagcatccttctgagaaggttggtaaggagatcagaaagctctacagctggaacaatgatgacgagaagctcatcaacaactaatttgcagataaatattattgcataaaaagagaacgacttgcaatgcaggtcgttctttttgtcttgttggcattttatcaatttccgctgatcgcacctttggagtatgaatagaccatataaccatcaactgtcacatctacgcttttgacattatatgcacttccgtctttgtctttttcaaagtatattgaaaattcaaacttggatagatcaaggtcgccgtactctctgtcgtgtgacagcatttcaagccacaatgcatatgcgaaaagctccggcgtgatgttatcttctttgtccatatctggcacatacgacattgcaagctctttcgcaaggtcgagtgaggtcacattgtcaaagtgaagcttcttgccgctggtgttatactttgttacaagcgcctgcgccttttcaaaaatatactgcgccgtggctgacgggtcagcttccacagtgctggtgcttgaaaacggagcggaatcatacaccgcccagcttccgtcattggcgtagctatacagagtaaatctgtttgtgaacatatccacagtgaaataatctgtcgccatattgaactgtatgtccgaatcgttgacgatattcagggtcaggaggttcagactttcgtttgtgatatatccattttgcgcatagtctgactttacatattctgttgtattgttgctgttcatgatatcgttgtaataattatagtcagcaggggagtagctaaaaatggcattgtctgggtttttcatagagctttcgtcatagatatccagcaggtcatttttgagggtttgagctataattttggcattttcagtgaagctttcgccgcttccgtatttgagagaaacgctgttatcgctgtctgaaatggttatcttgcagttgttattctcaatatgggcttctattctgcaattcaccgccttgttaaaagcgtcctcatcaagggtttttatctccgacaggatatcgattaccaaagaatttggctcgtagctgttatcatctgtcaaaaaatccacgcttggaagtccgctgtcggttttctccagcaggtcaacgtaataccttgtgctgtgttccttgccctcgatattttcgtcatagttgccgctgtagactatatcgcagtatgcagggctgttttgtattatgtcgagatttcctaccgtagaatttgcgctttcaagcactgtgtctgcaagctttataaagtctgctgaacacaactgcagtgtacctgtatcgccggatacactgctgtttgcaggtggagctgtgcctgcgttcggctcgtagtcatggatatttcttgtcatgtaaattccgcctgacattacaagcgccactgccgccgctgccgcaactacctttgcacccttgtgtcttgcgactatggcaggctgtgtcggctcggtttgtggtgtgaaagtatccgtatttatatctccgttttgttgtggaaaacgctttttgagcgtttctttgagctgtgtttttttctgctcagaaaggcttgcgcctgcgaaaaattgttttatatctctttcgttcatacgctcatctccttttcgtagtctgaaagtgaaagctttagtttttctcttgctcttttcagccttgatgtgaccgtgcccttgcttgttcccaaaatgtcggctatctcatcggtcttgcagccttgataataaaaaagataaagcactatcctgtattttttatccagcctgtttatagcgttttgcacatctatctgcatatcaggtgatgaaaaatcgctgcttgcacttacctcattttctgcacgcagacgtctgcctgccgaccttagcaggtctttggatagatttatcgtcgttctcagcagccacgctttaagatgctcgtcatcattgaagaaaagctcaccctgccttgtgaaatattttattatgacctcgctgactatatcctccgcctcgtgaacgctgcctgtgactgccagtgccgctcggtagatatcgtctgaaaatttgtcaactatgtagtcaatatctcttgtcaaagctgtcacctcctttgttgttttgaaaagcctttcatctataacacgaatgtaaagaccgtttgattgcataaaaaatggacaaaaaataattttttcgtccataaaaaatcagcttttgcttgtttttacataagaccacccgtcaccgaggttatcctcgccccctgatgagcttatgggtgagcggtaaatatagtaatgatcataaatggtatagaatttcactgtcaagccgtcgctgtcgatgtatgtaacgttcctgcgctccaactcctcaagttctttcttcacagacttgcaggcattgttttcagtgagcgatttaatggagcatttgccctttggtagtgtcggcttttcgcatgaaatgctttctatcataaactccgcagtggtctgaaagttagccttattgtcattgaaaacggcttttatctggctgtcagagcgcatatagtgctgatgccagaagccgagtgctgctgcaagaataacgactatccaaattatccacttggcttttctgcctgttgaccatttgcgaagcttgccgtcagcccccatatctttctcgctgacaattggatttatctgctcgctcattattttacgaacgcctccaatctgtagataggcatacccatgtctgagaatttcttctcatattccgttacgatattgccctcgaagccgctgttgtgaaggtcgagagaaatgtttttaagtccgtaatttgccgcagagaactcctccaaggagaactcaaaaaagtgcatattgtcggtcttttggtatatctcgcctttgtccacaagaatacgtctgtatatttcaagaaaagctcggtatgtgagcctatgacgtgcatatgtatttttaggatacggacagctaaagttaagatagatacactccactgacttttcggggataaagcaatccagatattcagcctcgccccttgcaaatctcaggttcggtatgccctcgtctatagccatttgtgcggcgtcaactataacattactgcttttttctactgcaaggaaattcttgtcaggatttctctttgctatctctcttgcaaactgaccctttccacagcctatctccagcacaaggggattgctgtttccgaatatcttctcaaagtcaataagctgtttgtttgatttgtcctgaaaattcttctcgtcacggtcaagatataaaatataatctccgcaggcttcaagacgtgcctcaagatttttctttcttctcattctcatatgggataaactctcctgttatttattagaatatttgtgcagaaaatagtccttgtcagacgtgacctttagccactgcacagccgaccctgtgagcatattttcataaggataaactgtgagcatgacttcgggtgtgtcctcaccgctgaaatgaggtgtcaccttaaaagctatctcgcagttgagccgttggacgacctcttcctcggtgagctttctgaaaagcactgaggtgtccttttcggtgataggtattttggtaaacttcgcctgataaattttcttgccgtcctttttggtgacaagtgaaaagccatgcttcacaagagttatctttccgccatggttttcgtagtattcaaggtttgaaaaggtaacacgtccgtcattgacagcttcaccggatatcgaaacgcaaagccctttgtctgacgctttccctgcactctccactccgaaagcaaagggaagtccgtctatcattatctctccgcaggtggaaaactgcaacttcacctgctttttcttcaagcctgcaaatggatttttcatgacaactcctatattaaaggtcgatctgcacgccgccaacaggtctgatagacagcacatagcacgagccttcaccgaatactctctccatttcagccttgaaagcttcaagcttcttttcaggtacgaacgcttggatagttcctgcaaagccaccgccgtgtactctgcaagcaccctcaccgccaagagcctgctttgcaagatacagagcaagtgaaagaccctgctcgtttggggcagaagaagcatagatgttctgaagatatttgaatgatgaatctcctgattcattgataaggctcaggaaagcgtcaaagtcgccttctgaaagtgcggaagcttccttgccaactctctcgttatcgtcaaagaagtggagcgctctaagcacagctctgtcactgcacttttctctaacggcgcagatgttttcaagaagctgttcctttgttatctctctcagcacctttttgccaaagaaagccgcaacagacttcatttccgcaggaatagccgcatactcaggggtgaggtcggcatggttgccctttgtgtcaacgatacacagtgcgtgaccgctttttgtgaaatcgaactttacagagtcgataacagggtgcttttcgtcagcaaagtcgatagtgataaatccgcctactgatgaagccatttggtccataagacctgacggcttgccaaaatatacattttccgcaaactgagctatctgagctatttccacagcagaaacatcgccttcgttgtaaagaccgttgaggatagtgccgataagcacttcataagccgcagatgaagaaagtccagagcctttgagtacgtttgaagtagcataagccttgaagcccccggcattgtgaccattctttttaaagcctgcggacatacctcttataagtgccgctgatgtgtttttctgctcctcgtagatagtgtcgtcatcaacgttcacagtgtccattgggaagccctcggactttattgtaataacgttctcttcggtgtcaggagcgacagcggcaataacgtcgagtgaaacgcctgccgcaagaacacagccgaagttgtggtcggtgtggttgccgcctacctcagttctgcctggagctgagaagaaagcagttggcttttcaccgaaaagcttttcaaattcatctgcaactctgttatatctttctctctgaaacgctgtcatatcggctgtgtagacctcgtcaagtgtgtattttttcattatgtatatcctccgaacgtaaatataagtatactttgttattatacaacatttatgcttttttttcaagtacaatttttttaacaagtgaggaggtatgttcagttgtcaatgataggtgacacatcttctcaaaaaataatgttaagtaactaattgcagcttttcatttggattcagtggcggcagcgtttagaccatattcaaatgattctgaaatctcgcccaacttacgctgttcccaagcgtcagtaaatttgtttgcaattattcattcaattaataaaaccagttaaaaacggctataagccgaaataataggaggtataaaatgttaaagtcaatcaccaaggacgccttattccatgaatattatgcacagtggataagagtttacaaggagggagcaatacgcaaggtcacgatggacaagtatcttatgacgcagtcctggcttaagcgtttagcacccgatttaaaggtgcatgaactctcgagaatcacatatcagcagttgataaatgattatgcggtttaccacgagaaacagactacgatggattttcatcatcagctgaaatgtgcaatacttgacgcggtggatgagggtttaatcgagcgtgatccgacgcgcaaagtaattattaaaggcagaccgcccaaagcaaagaaggtaaagtaccttaatcagtttgaattgcatacactgcttaacactcttaatcttgagcctgaaattaattgggactggtttattcttcttgttgccaagacaggaatgcgtttttcggaagcgcttgcacttactcccaaagattttgattttccgcgtcagacactatctgtcagcaagacatggaattataaaggtgacggcggttttctgcctaccaaaaatcagtcatccgtacgtaagatacagatggactggatgacggtaattcagttctctagattggttaagaagttgcccggagacgaaccgatatttgtcaaatgcggctcgaaaatatacaattcaacagtcaatgacattttggaaagacactgtaaaaaagctaatgtacctgttatttcggtacacggacttcgtcatacccacgcctcgcttttactttttgcgggcgtttcaatcgcaagtgtagcaagacgacttggtcacgcaagcatgacaacaacacagaaaacgtatttacatatcatacaagagctcgaaagcaaggatattgaccttgtgatgagatcactttctgaactgtcataacaaacaaaaaggcggatgtttagtccgccttttgctatggatatgcctatgaagtactacatccttctcgccacataacaatgccgaggcggctcgctcttgtcaatctcgcacacaagcttgccctcgtcgcatagcttttaattaaaaattaaccgcctgctgtcattacgcatacggtactcttcctggtagaaatgcaccactttcaaccacttgtttgccacttatttgtgctaaaaatcaccgaaatcggcttaaaatcactacaattgcattgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccactttcaaccacttgtttgccacttatttgtgctaaaaatcaccgaaatcggcttaaaatcactacaattgcattgctcaaaaacgtcgcaaaatcgaagtatttttctgcaaaataagtatgtaaatccgaagctccgacttcagattttttgctgttatgagccgctattgaacttcaaagcgtttgcaacagcatcgcaagctttgacctgatactcctgaaacatatgactgtagacagaaagcgttgtcgtcttgccaaatagtaacacactttcatatgctgggtaaataacgtaaatacgcctttaaataggcttcttttatctttcagaggttcgtcgagcagcttgtagtagatgtagatttcacgaggctgcccctccacataggcatcaagggtgatatactcgatcagctccaggcacatctcacgggtaagctcatgcaaacgaaatctgccctctgtgaacttcttggtgtcaacggaatactactcctcgtggtgcttcgcctttcgtacaagaaaatagccaatccaatcaatgacccatggatgagctatgatcttaccgacaatctcgatatgaaccttgttccgagagagaaggcagagggcagcggagagtatcttattgccgaatattaccacgccaagcgactgcaatcgcttctgaaagttgattttttcaaaggtcttatggtcgggcatcagatacgcaggtgtctgaactgcaacagattttttattgtgaacggcggctataagacaaaatactgcgatatgccttcgcctgaaaatccaaacagaacgtgcaatcagatggattttgccaagaaaaagcccaaagagaaaaatgccgagaagcgaacacttttggctaaatcagagaaactttaccattccgctatgacctcaccggaatttacaaacgatgaatttgaacaacagttaagctctgcgagtttgtacaggttatgtggcatggaacctccaaggaaaggacgatcgggtcaggctgacgataggcgcacctgcaagcagggcaaggatattacccgttatgagtattccgattggctgaagaatttacatgtggctaagtctgagttttctgtatctttacgcttgaaatatttaacttttagtgatatacttgttatatactaacaaatgaagttaaaggggtgatattatgttagccatttgtctggcattgataaacgatgatgaagataaaaaaagttttgaacaactagtaaaaaagtttgaaaaaaagctatataccgagtcgtttaagattttaagatcacatgaattagcggaagaagctgtatgggaaacattttatagaatagccgataattttcataaaattcacaatttacccgtgtacaaaatggaagcttacttgattataactattagaaacgcttcttatagactttataacaaagaaaaaaagcatttctacaatgacattcatgaagaaatgagagatattccttccgccgatgaatttaacgattataatgttgccgatttatctaaggcaatcagcgaactggaagaaaaatacaaagtcgcaattacatatttttattattacggacacaatgccgatgaaaccgccaaacttatgggagtttcacggaacgctgtatataaatatctgagaaaggctgaacagattttgtttgaaaaattacgaggtgatattagtgaatgaaaatacagcattgtatagagctatcgaacaagcggtaatactgccgtgtgcaggagaaatggaatctatcgcagatgtcgaatgtgatttttcagagacttacaaaaagaaagtaaacaggctgataaaggacagaagcagaccgtattatcctttgataaaaacaactctgaggaagactatttttattatagcggcagttttaatgatgagtacaattacagttgccgctgttccacagttaagagaatggttcgtaggtttgtttgtctcgcaaaatgaaaataacgctgatgtgcatgctgttcaaggagctattcccgcagatgatatgaacgatgaatttatctattatgagccgacgtttattccaaaaggatttgtagaagaaagcagaattaaggatattgcacatttaggcattgattatcgtttcaaaaataaaatcattttttattctcaaagtccattaacggcaacccataatattgatactgaaaataggaaaacagaatatgttaccgtatcaggctgtgaagcgtttttatcctatgatgacaactcatctatcattgtttggaatgatggaaattatgtatattccataaacggagatttgtgcaaaaatgacataattgaaatggcaaattcggttaatcctacaaaataaaatattttttacgaaaagtgtgtacaaatttactcaaacttgtatctcagtatataaagggaacaaaattttgaggaaaggagtgcacattttttatgaagaaaatgatttctgcgataatggctatatgcattatgatgtgttcgcttagtatgagtgtttcggcgaatagcgtaatcgattatgtagaaccgggtatagaattaatgtatctgtacacagacaatgttagtacaagtgtatatcgttcaggctcaaatatagcttataaatgtgatgctaagggcaaatccacagcaacaaagataagcatttatctgtatctacaggaatattcaaacggtgcttggagtaatgttgatgttgttacaaaagcagtgaacggacgcagcgcatacgtcagcgatacctattcatcggcggtatcaggaagaaaatatcgtactgaagctcatgtatatgtttacagcggaagtaaatacgagtatctggaagtcaacagcggaacgttgattttctgatacataactggtgtaataaaaatagaaaggtttggtgaatccaatgaagatgtgaatatttattttgcacaattattcattgcaataattgtgtgatatgatgaaattaaaatactctgcaacaaaacttaaagaaaattacacttatattgagataggacgtttaatatgaaaaagatcgttaagagaattgcagctatgggtgctgctgttatgatgatggcatcgatgtcggctataggtgtaaacgcttatggtacagcttcgttcagcaatgaacttgcacattctgacgactataaccctattacaactacatcaggctattcaattgactatgcgtatggtgtatgggcaacatcaatttcaagcgtaagcggctatagcaaaggaacaccccgatttaaggttaagacggggggctattccgattatgttgatgtatataacactaaccagttatattcgtttgattcatccatgtgcagaggtaataaaacctattatggatatgttaagaacaagacttcaggctgcaaatgcaaggtgtctggtgaattcaggtttatgtattaatataaacctacggaggcaaatatatgatcaaaagtatacttacccaaacaaaaataatgcttaacaaaaagggctttatgttcggcttttcggcaatgatgatgatatgtctcttagaggttgttttcagttcatacggtgttaccgccctacgaatggaaggagacggctttcccgggaacgacccatcgtcggtcataacttcctttgaagcatttatcctctgtgtaccctcaggactgctcagctatcttgagctgctgttcccattcctgtgtgctttgcccttttctttttcgatacttaccgacaaggcagccaacacggatactctgttgtgtgcctactgcggtaaacgaaggtacatcatatcaaagatcacagctgcatttatcggctcatttctgatatttttcgttccgctgatgataaacggctgtcttaattatctcatcttcgataattccatgggagcaaatctattcaacccgaactggcgttttaacggcttcggcgttatgcgtgccacagactaccccaatgctccctttggagaactgctggcggctgcgccctttctgtacagtatgcttcatgcttttatgttttctctgatgtcgggagtgttcggggtgcttgctcttgcctgttcggtgttttgcagaaggaacaaagtgctgaccttcggggtcggatttcttatcataaacataatgcagttccttgaaaactacagcatgaatgatgatatagataaaaaatataccgcactcgatccattcaaatatgttacttactattactgtgacggcaggagtggagtgaactatttagcgtttttcattgctatgggtgcggtgatagtcgtgagttcggctctgctgcttttctgtggcagaaaagactatatctagggagtgagagaatgaagaaaatgcttctaatgatcgcatctattgtcccattgtcactgatattcaacggtcgtaattttttcaacattctcgcagagcgcagtctgggagaatacgatgagagttttgatcttttgtttatcggaaacgctttcggttttacagcacttcgtgatgcaagcctgccctttatgctgtacacattgactgtggctgttgtctatctttttatgttcggacataccatgtctgataacctgaacgtcagcgatatttatgtttttatccgagagaacaagagaacaaaatggttcgtcaaaaactcggctcgtatatatttgcagagcgctgttatagtccttgtcaacgtggttgtgatatggttaatgactgccaaaatgggcgttgcaaatcagcccggggatataggaaaaatagttgggataaccatgatgatgatactgtacatttggatacttattaccaccacaaatcttttctcggcattgttcggcagtactatcggattatctgtcggagcggcagcacattatgcctttgttatatctgcaaggtacggctttgagaataccctcataaaaaacataaaccctttggctgtcatttttaatatgtcagaaaacaggcggagcattgtaacgtcagtaatagtaatgggagtgatcttatttgcggtgtgtgtcatattctgcacctatgtgaacagatctgatgttagccttaacaacaaagagatattagtgtgaggggatagaaatgtcaacgataacagttaaaaatgcagttaaaaaattcaaaaacagcacagtgatcgacaatgtgtctcttacactggagggcggaaatatctacggatttgtagggcgaaacggcagcggtaagaccatgcttttccgtgcgatatcggggcttatacatcttacaagcggcagcattgagatagacggcaaggtgctgcacaaggacattgacgctctgcccagtgtgggtattgctattgaaaatgcaggactatttccggacttgtcgggatataaaaatctgaagctgctggcagggataaaaaagaagataagcaaagacaaaattcgtgagactatctcggaggtagggcttgatcccgacgataagcgcccgatcagaaaatattccctcggtatgcggcagaggatacttattgcacaggctattatggaggaacccgatgtgctgctcctcgatgaacctacaaatggtcttgatgacagcggtgttgacgaaatcagaaagctgatctctgcacaggcaaagcgaggggcaatagtctgtgttgcaagtcacaacaaggaggatatcgcccttctgagcgataagatattcagagttgacaatggcgctgtccgggaggaatgatatgaaagtatttttgaccttacaggcggctttgattgcagtcacccttctgctttgcttacatgcaaggggcttgtcagaggatgtaggaataacccgcatggacactatcgagaagatacataacagcaattgtgactatattgctgtgatccatgatacagaggaactgtatgatcgcttttctcagtttgacagtgagaatgcagactacggcattgggctttacggaacagccatatttgtaggaactccacaggacagcttttccttttcaaagggcagtaccttctgcacccttgatgtggataaggtcataaagggtaatatcaaaacagacagcattgatgttgaaatcaaaggcggctttcactacgaaacagaggctgagttcaaagagcggttaatgaatgctgaggacatggagatagagacaccttctgaaaaactattctcgctggattttggcggcatgaattttatggtaccagggaagaaatatctcataattgcgcagactcttgattttaaagaaaaaactgtttacaggataaacggttatcagataagctggctgtgtcttgatgaaacggagagcaagattatgaaagaagaatatgtttattcagaatgttgcaataatgagatattttcgccggatcatagtattatcgaagcattttacgctaaaaaggacgatatacttaaaacttataatatagtactgtgatttattcagtgattccttaatatgtggtcatctctaaattctgttggcttatctgcggcaaatctttatccgtcatattgtccaaaattcccatgacatacgctagtatgcctgcgaaaatttagtacaatctgccgaataaatctgcaccgcatccaaacgacatatgaagtttatgcattcacacgggatgatgtgattaaaagttttgaattatgacatagttttatacttgataaattaaagtgtgatcgtgaagctattgctatggaattatttgaagaagagaaagaagatggaaaacaattggtttctgatctcacaaaaaagcagtattaataaaaaaacgaccgcctgctgtcattacgcatacggtactcttcctggtagaaatgcgccactttcaaccacttgtttgccacttatttgtgctaaaaatcaccgaaatcggcttaaaatcactacaattgcattgctcaaaaacgccgcaaaatcgggctttttcgcattttactaaagaccacatcaggtgtgcggtttaattcaattcccgtacgggtcaccaaagcttaaagctcggagatagcacattgtgctgtttccgagcttttgttatctgaagtttcataccttccatattctgccctacttttccccgcacacctcactcttgagttttttcgccaccttgaaatactcatgcattttcacgtccgcagggtctatctgcaatgcaaaggatatcctgcccagcagcgaatttatgtacttctcaggcgtaatgtcagcacctttgaaaaacaggctttgggaaactccgtatttctcacagtaatatatttcctgacgtatctcccgacgctgtttcgacgagatctgcgccttttcgttgactactatccccgttacctgctgacgttgcgatgagccgataagcgtcgtttttttcatgttcagcttaaaccccattttccgcaacgccctgctcacaagttgcgttatctctttggcgttaagcacagcttttccacctgaaaatgtcatatcatcacagtatcttgtgtaatttatgccacgctctccacaccacttgcctatcctctcatcaaatcttttcatcaccaaattcgatatctgcggagacgttggcgcaccctgtggcagtatgctattataagtgcatatatttgtcagcagcgttgtggcaggcttagaaaatccaagctcgcacatgaccccatagaccttgccaaaatcaatgctgtcaaaaaaacctgaaacatcgagtttaagcactctctgttgaccaatatgcggctctgcatttttcaaaagcgaagagtttttgcaatatgcagtggcatactcagatacggacagcgtgtaaagatacctttcaagtatccttctttgaacgagcttgagatattcgttcggcacttttaacaccctgtttttatgccctctgccacgatgtattatcaccttgcggtaatttgaataacactttttctgatttcgtttatgatagcgtattcggttgttgctaagcatataaagcttttttaaaggaacatcaagctcctctgagatccttatgatatcattatcaatatcattcattttgtcacctcaaaaaaataataacaagcgtcagcacaagattcaaatgctttggagccgaattttatttaatggaattaaatccgattcggtgaaaaagcttttgacaaagctactattccctgaaacttccacagcgactcgctgtagttatgcgttttgcaatatcgctgctgacgcttgtcatattttatcaaaccatgttatgtactcattatataaacaccttgtttattttatgagataattatatcacgcgaaatgcacaacaattggtgcatctcgcagagtacaacgaaaaaaatggctgtatataaacactctgatatcattttaccaatttatgcacgacacgtcaatgggttatcctgacattttacgccaagcgccaatattttatatgaatacacaaaaaaccacacgaagataggaaaaaaagccgagccttgcttttatcacctctcaattcccccacctctcgagctttttcctttttatcactatccccaccgggctatccgttttttcgtcaaaatattcctcgcagacccaccaatgatactcttgccttggcagggtcgcccacgtcatatagcaaaagctccactggcgaagcaattccttcttcttgccgtttttcagactttcaggtaaatagtcctccataagcttcactatcgtatcatagcttataaatctcatcttgttctttctttttattatggacagcctgtaggcaagataaaaatgcaaaacaactttccatatgctgcatttgtattctgggtcaagtattgactcttttttcattctcctgatgatcttaatacgttcatcgggatcattcaaaaggtcgcacagtgctgagatattagaacaatcgaaaccgtcctgcccactgtccagcttgaaatatctccgcccgtctagtttgtataaaggcactcgtgctatctgcccctcctgcgcctccactgcatatgtccacaacctcgggcaggactttatctcatagacctctctgccgctggaatcctcgcccctttgcacgttgataaaacgttcccaaatgccgtcacttactttctgcggagcattttcagtgctggctataaagatcctcagcctttggagcttttccacgctttctcttagcttgtctttaagtgcatttcgtgaaaatctaatgtcctcgtttccgctgagaagttcccatatggtgttgagataaaaatcctttctgttattgttccatatagtgcaaacagcgtcaaaaacacacatatcaaagtatgtcagcggtgctttttcataagccgtgccgtcttgataccataaggtacaacagatatcatttcttcgctgacctttcacaaaagctactctgtagttatagtcctcttgatcgtttcttttgcctgacagcccgtcataaagcccttgtatctctttctctcccaaaagcctgtttattttcttgtctatataaccaacgatccttaattttctttatgactatcactttttctcagcaagcaaaagtccagacaaatggacagatagtatgatataatataggcataacaacaaaaagtgaggtaaaatcgttatgcctaaaagaaacacactcaaaagcaagctcagcatcatagtttttttagatgaaattgaactcaaaagacaaatgccttgagtttctatttgaattgcgttttccataaggttttgtttgtctggaatgtgactgcacagagtattatcatatcaaaaagcgtggtcggggaactaccaaaatgaagatcatggtggctgtacagtgggcaaaatgctcgccactgtgagggatactattccaagcaactgcgcatacatgatattcgaggagctgatattagcaccgttcagcattgcccgtatgcgtgaaaatttcaaaagacgcagaagacgtcaacaaaacaccaagaaaggagtggaataaaaatgccacaaacagaagatatagaatacatcaagaaatatgaggcgtatgattgtatcaacacctccgaggacgatgattttgacccactggacgagctttacgagcctgatcctgtggagattcaaaacacgagccaaaatccatttacagcaaaggtatttgaccccgaaacaatgcttttcgaccttgccgaagcaagaaagacagaaacaaaattcagagagaacatactctctatgatgatgtctgttctcataagctctgacaagcccaacgcactgctctgcggtcctgcgggctgtggaaagaccaagatagtggaggagcttgcctacagactcgaaaacagcgagaacatcgtaccacagctcaaaggctataggatatatgccctccagctctctgatatcgtggcagattcaggtcttatgggcgaccttgaaaacaaggtcaaaatgctcataaactatatgagcgaccagaacgagaagcgaattttgtttatcgacgaaatacatatgctttttcaggaaaaggcatatcggattgtcgctcagatcttgaagcctgctctgagccgtgggaaaataaagctcataggagcgacaacgacccaggaagcaaatctcatcgacagcgaccctgccttttgcaggcgtatgacaaagataatagttgacgaagcagaccatgagcagacagtggagatccttctcagcatgaaccagcattttgcaagccactataacatctcattcgctttgagcagaagcaaggcagagcacattgttgatatcgcagacgaattttgctactcaggctcacaccgccctgacaatgccataacgctacttgaccgctccatagcttccgccgtggtgaagaacgcttctgacaagaagatgaaaattactctcaccgaccgccatataaaagaaacagctttccgcatgacatcaggtcacagcacgccgcacacctttaacgagagagcctttcgccgtgacctctcagccgtctgcggtcaggaagctatcatagacgaccttgtcaatgtgcttaagctccattctcttcacatcagactgaacaaaaagccttttacaatgctttttatcggaccaagcggagtgggcaaaacagaggtggcaaagataatagccaaaaactgtgcaggtgagaaacctatcacactgaatatgtcggaattctattatgacgcaggcataaaccgcattataggctcgcctgcaggctatcttggaagcgacagcaatgttgaactgccctttgataagctcaaatcaaatccctatcaggtgatactccttgacgagtttgaaaagtgcgacagatccgtgcaaagactattcatgtctgtctttgacgagggcattctcaccacaagtcaaggaaacgttatagacttctcaaagtccataataatagccaccaccaacgcaggctgtaccgcaaagagcagaagcattggattcaactcagacagcacatcggaaacacaactcataagcgacctttccgactattttgacgtcgaacttatcaaccgcttctcacagaaatacactttcagcgagatatcaagatcggtgtacagaaagatagttgaaaaacggcttgcgagcgaaataaaagtcatcaaaaggcttcaccctgagctgaatatggactccctgttcagtgcagacgagcttgcaaaggcagtagataggataacatccgacacctacaacatcaaatcaggtgcaagacctgccatcacagcagtaagcaagttcattgacagcaagctcctttcacacttctcacgcatggcaaaaacatacagaccaaaccaaaactaacgcttcgccatacaaaaaaatcaatgaccgcacctttcacgggcgcggtcatttttttattctgacaattttactcttattaaacagatataaagaaaagaaagataaaaaagctcgaattatattattaggatatgtcacacccacaaaatatcacgctaaacagccgatattacgatgcgatctttgcatttgatgtgcgggaattggattttttctatatgatcttaccgtcagacacttcgataacacgactgcattgttctgcgacttttggatcgtgagtaacgataacgactgtttttccctctttgttaaggcgtttgaaaagctccattatctcggccgaggtctttgtgtccagcgctcctgtaggctcgtccgcaagtatcatggcaggctcgttgacaattgctctggctatagcaacacgctgcttctgtcctcccgaaagcttgttgcaaggcttcttagaaagatcccccataccaacagcttttaatgcttcaagagctttttcttttttattctttatctttttctttgcaaaatccaatggaatcaatacgttttcaagggcagaaaaatcctcaacaagtgcaaagtcctgcattacaatgcctatcttttcattccttatctgtgcatactgcccctctgataaattttttaccaaagtgccgtcaattgtgtactcaccgctctgatagctgtctatgcaggcaaggatatgcaaaagtgtggattttcctgcgcctgattttccaattatcgctaccatttcaccgtctgatatctcgcatgataccccatgcaaagcctcatattcattggctttctttggattatatatctttattattttatcaagctttatcattataatgcctctcttattcatttatcatcaagatctcatttggtgtatttcgtctcattataacgcccggtatcaaaagtgagatcagaatgttcaagataacgatacatacacagccaatcaagtgcagccaaccaaaacttatcactgtatttcccataaattcgctcatagtaagaacatttgaaatacacactgcaatggcggctgccataactgcggtcataagatcacacacaagatctatcttgatatatgcgttccactttgctccgcagagataatagataccataatctccaagtctcttttttatgttcactgccgaagccgaaactgagcttacaataacaagaactatcacgcatataagcattggaacaagcttgataagctgaccattaatatagacaagcgaattttctctgaaatcctcaaagtcaaaaaccctgccataatccctcaggtataattcaagctccttaaaacgctcattgcttacattatcctttaacgttactatttgattgccgcaaggatatattttacagtttatatctttaagacagtctgtcggaactatcagcatcatgttgccatgcttattgacattagcataaagatctctgaaatcaggcttttcttttatactatcctcagtgcctaaatatgcagatgaaaaccccagcaactgtgagccgtcagctatgacaccgacaatttccaccttgttcttaacatattcatacttataaggatcagcatagtcaaaatcctcatcatcaggggacatctcccctactttctctttgtgcataatggtaactatgtcgcccgttttgtagttgctgttttcagtcacaacagcaggtatcaaatctccgttagccgacgcattagacagccattttcccgaactcatctgcggcgtaaatgactttatcatatcttcagataaagcattaacgctcattctatcgtcaccaagtccattagatagatcttttgatgacggagaatagtacaagcttgtatcatatccgcttgtcaccgactccacatcatcaatatttttaagctcactgtcaagagaagtagcatcatatatattacatatatatagtcccttgccatcaggaaagtatttctttacaggagtatacatctctattcttgaaagaacagaagaaacagccgccgacattataataaatgcaatggcgagctgaacagcgataaaaatattgctgtagatatttcttgcaaattctttcaaaccatattttatcatattattttcccctctctttcatcattttcacaggggatcttttattggtaaacaatatcacaatgttaaggaacaaataaatagaaataatatatattccaaatatggtcatatataccctgaaattatatgcgaccttgatatactcaaaaaacaaagtaagcttaggaagcagcgcataattgaataccaatgcaaatatcacatatatcgtcactgatatcatacctatctcggctatatacatccgtcttattttatttgacgtgcagccacacagcatgaatatagcagtctgtttagcacgggatcttattatgtatctgaaaagcattgcaagatttattgcagaagctatcgcaacggctacggacataaatataacggaattgtagaattttatttcagtcatatcgatcgtgtctatcggaggaaaattaacattacacgttagaacttcgctgaaagcttttttcagcttaaaaaagctttctgtatcgagagcattgtcatcaagaaaacttatgcttgaaatagtgcagttatcacccaacgttttaaatggcacctgaaattcctcttgtacagtattaccgaatatgcctatgaccttatagcttttgccaagcagttcaacattcttgccgatcatatcatcttttgcgccgctaggcagcacgaccagattttcgtctgaagcatattcttccttagtaaaatatctgcctttgcgtatactcatgttgtcgacatacgattcgtataaactataatcattcaactcctcatcatattgaatgcgcaccgcagacataagatacggttgaccgtcgtcaaaacactcatcaattttaagctcgttctgatcaaaatttatactaaaatacatacccggtattgacgctttagaattatcatcaagcttgtcaagcacctcccgaagctgaacaggagttatagaatctgttccaaaataagacaagatcctgccatcactgtcttcctgagtatctattatatcgccaaatgaaaaagtatagttaaatacatacttcttttgcttttcaaaatccttgcttgctttaaaattctgaaatgcaccatgtgaaaacaatattataagcacatcagtaacggcgcaaacaataaatagaataaagataagcacattctttacggcaaaatttttcaggttaataaaaacgtatttcatttagtcctcttaatattacttattttgatttatacgataataaacatcgtctatagtatactgattatccttatcggttttaacttttacacgatggatataataaacatatgaattattcttgtttcttttaattccaatacctgttccggcattttttgttgttatctcatttgtctgatttgatataacagcattatttgctgtatttctgcattcaaccgatacctttatgtaacgttgaaacttactttctgtttttcccgcagtagtcattgcagttgaagaatcgcccttaatattccagctcacataactattatttccaagctttcctgaataagcatatgactgaccatatacctctttggttgctgacgtagttgctaatgcagtagtaacagccatagtgcttacaatagccaatgcaacaattcccgtaacaattttcttaataatcatacttatttcctttctcgtttcgcaataaatcacgaatttttaattatacaactaataattttatgacctgtgcttaacttagaatatcttcatgctcacttgaatttcatcaaaaattcaacacagtactatgaagttctaagtattctgacttacttccactgtaggtatacacctgtaattccgtacgatatttatgacctgagatcgcactagagtaggaatcagttgctgtcaagtatttcccgttgacctcttttcttaaaacgtgaacatttctccatgaaccattcacattttcctgaagataaagataaactgttatctttgttgccgttgattttcctgtaacggaacaatcatatgaaattttcttagaactggaacgtgtgatgtttgtgctgattttgttcgtatataaattcattaatgctatttcatcatcaactgttgtttcagcaaaaacattaaaactaaagcagcaagtcatcacacatataagaacaagtgtagaaataaatttttttaacataagatcacctcctttcccataaaaaccttccacataaattaaaacatgaaagcacgctgtttttgacaataattatcaaaaatatttttaatttgtagactcaactgaatttgccatacgaattatgtcatctttgcacaaattaccgtctatttcaaaagcataagttccatctgtccatgcaattattgtatattcactgtcatatgaaatgaatgcttttttgccattaatatctacccattcagtcttcatattttcggtatctacctgattagacactgtcaaagaactttgcgaatagtttatgtatttatcgcctgatatataatgtatttcatgccttgtatcggtagtgacaacagatttgatttcaaattcgctaggtacgaatgtcggtacatacttaacaaaattataaatgctaaaatcgtccaaagaattatcttttatatgcgttatttcagcgtttctattattatcctgtacaaaaactccaacaaaccattcacgcagcggcggtacggcggcaactgtcacagagccgactgcaagcaccgcagctattatcgccgcagcaaatcttagagtgatctttatatgtctgtgaccgctttttctgttagtttttatcagctcgccaattctctgctcatatttttccgaaaaatcatgtggaattttctcaacagccaaataatccttatagtcttcatcaattatgcctgtttttattgcccgtcttaacttatcattcaaaacgatcaccaccgatcaaatctaaaatttgtcttttggctttgttcagataattaaataccgttctcttagaaatgcccatgatctgtgcgatctcatcagcggtcagatcataataaaccttatatgctatcacagactttagtttatcatccagctttcttaccgcatctataagcagatctaagtcaatatcatcataaaaatcctcactcggctcatcttccaccttaagatcaaatatagacgatgttggattttgattttccttattgtagatcgcataacaggcgtttctaatagttctaataagatatgcgtccatatcgtgcaaagaataattgtgaatttttttaaaacattttgcgatgctgaaaaaagcatttgcacaagcctcttctgccagcgcagaattattcaagatcttgtatgcaaaagcataggctatctgacgatttctgaaataaaaatcttcaaaagacgtctgatccttatcgttgtctatcaaggtcatacatacagctaacatttgattccccctgagttacttatgttactaagtataacacatattgacatacttttcaagataccaacaaataaacttataacccgaaattataatacatttttcaatttatacttgtataaaactaacatgattgagccattcaatttagttaaagctacaaaaattcaaatataaatcaacaatatgatgcacgaaacgactactttcgctattatttatagtgtaagactaaaataaataggaggtttttatggtaaacataaattctataatgtcccccttgtcaagacacaaatgaaaaaaattatcgtgacagcgaaaactttgtatagccatccaaaaaactcctgtttctttcttttattataccactgtcacgatgttttggcaattttgtgttcagtttctagggtacattatatgtaatcactgtgtccagtggtattttgacaattgaaaacagtgactatacaaaatcacacaatttccaaaagaagtataatttatatgtaaatgattttttttgaattttgctccgtttaaaatcatactaattttagcttttaatttttttcattccaaaaaccgccccatttcgttctataaattacctcttataatcaaatcatgcagacatataatattattgcaaacccgaaaaacaaatgaaaaggagatacgaaaatgaaaggtatcacaactcaggaaggcagagaaacactcaacaagttcaagatggaagcagctaacgaagttggcgtaaacctcaagcagggctacaacggcgatcttacagctcgtgaggtcggctctgtaggcggtcagatggtcaagaagatgatcgacgcttacaagacaacaggcaacaagtaatttctcccaaaagccctaaaaactccgccgtggcattcgctgtggcggagctttttacttgaaatcaggcaaaaaagtagtataatatacacatagggtcggggtaaagatcatagtaaagagggataaatatgttgactaaaaagatcgccgccggacttacagcttttgttataacagcttctgccgcactgcttccgcttccagaaagcattaacggcatattggggaacaccgctatatcagctcaggcttattctgcaaacggcgccgtaaaaatgccgtcagattttctgacttttaacagctccgatcaggttttcgtaaacatggtttctgccactaaaaacggactatactattatactgtggaaaactacaagaagctaattaaattctatagtttttccaacaactccgtgagaactgtagcaacgcttggtgacattataaatgtatatgccaataactccaagatctattatatcgaaagagataccagcacatacaattccagcgtgaaggactcgtcatattcttattacataaagacctttgacaccgatacggaaaaggtgaccaaaagcgttaatgtgagcaagtatacccccaatggtattttaaattacccaaactgttttggcgttgacgataacggcaggatatattactatgtaacagacagcagcggtgctgaaaaaggcgataatctattcctgctggactcaaacggaaataagctgtcctcctgcagcaccgatgttgccataacaaagttctcaggctttgacagcacaaacggaaacttctattttgaaagaaacgctgattacgtttattggggctatagtcacaaaatgaacgcccttggctttggaaatatttcaaataacaaaataaccgtgtctgataaatctatcgactatttctatcagaaatattacgattatcattatgacaacgcacaaatgcttggcaacggcaagcttgcgtggacttcttctgcaagcggtactgtaaacatcgtggactctgccaaatttcatacatcaacagatgatacattatatctctttggaagcgtttcaagagcggaacatgaaaacaaaaatgatctctacaacagcgttggaacaagaactgtatacaacggcgaaaatgacagcactatcatgtatgtaaacaacaacactcttatggagttcaacaatgatttcaagcaggtggcttcatataaaacagcttatcctgttttcgctttgtattatacaaacggcactgtgacagctatagagcgtgatactgacggcaatttctactcagagaatattgcttggaaaaagcctagcagtgttacgatttcaaattcttctgccacgctcaaaacgggcgacagccttaaactttctgcaagaagcaattccgatatagactacggcttcacatggtcaagcagtgataattctgtggcttctgttacaaaagacggcaaggtgtacggaaacaaggcaggcgtatgcacaataaccgctaccaccgacaacagtttgaaagcaagctgtacagtgacagttacgcctatggatagcgacacaaaaggctctgccactatactcagcggacgtgcaacagacaatgcttcagataaccattacatcacatggtcatctgtcacaaactcttatcttgtacaaaacagcgacggaacgctcacaaggcttgaaaacacatcaagcggcattgtggtagaaaactactccgcagacggcaaaaagcttatctcacaacgcactatttcaaaagagcttaacctatttggtggattctattcaggaaaagactataactatctcgtgttcggtcagaacaacactgccgaaagcgacagcaaggaagttgtaagagtagtcaaatacaccaagagctggagcaaggtaaattcatgcagtatctcaggtgtcaatacaacaaagccgttctcggcaggctcactgagaatggaagaagcaggcggaaagctttatgtttacacctgccatgagatgtatgctgacagcgacggcataaatcatcaggcaaatatgcttttcaccattgacgaatcctccatgtccctgaccgactcaatgtatgacgtttcaaatcttacagacggctatgttagccactcgttcaaccaattcatcaaagctgacgaaagcggaaaatacatctacagagttgaccactcagaatcaagcaactacacaatgaacggctcttacctctctgtaaacggcattactctcacaaaatataaggctgacggaaaatcaaccgccgtgaacgtttctatccctgttaagttcgatatgaacaaaagcaactacacgggcgcttcaataggcggttttgagcttggcagcggaaactgtctgatagcctatgcaaaagacgtttcaagcaattgtaagacaagaaatgtttacataagcgtcacagacgagcttttcaacggtacacagaacattgccctcacaaactacggcacatcaagtaaagtgacctgccgcacccctcagcttataaagataaatgacaatctgttccttgttatgtgggaagaatacaacagttccacaggcaagaccgccacaaagacaatgacagttgactcaaacggcaaaactgttaccaaagccatttctcactccttcggactttcagattgtcaacctattgtatgcagtgacggcatggtaaaatggtatgtcacaaataattcagcaccgaccctttacaagctctcaccatttgcgcttgacgattatcatgaacacagctatacaaaaacagttctcagcaacgccacctgcaccaccgcaggcacagtaaaatacacctgctcatgcggtgactcctacaccgaaactatcccagccacaggtcacaaatcaagcggttggatagtcgacaaggcggcttctatcggagttaaaggctcaaagcacaaggaatgtacagtctgcaagaaagttcttgaaacggctgaaattcctgcactttcaagaattagcatttcaaaggcaagcgtgacactttccacttcgacctatgcatatgatggtaaggcagaaactccgtccgttactgtaaaagtcggtggaaagactttgaaaaaggatactgattacactgtttcctacagcaacaacaccaaggtaggcacagcaaaggtcactatcacaggcaagggcaattacacaggctcagtttctaagacttacagtatcaaaaataacttcaagaaagccacagtttcgggcatttccacaaaggctttcacgggcaaaaatatcactcagagcattactgttaaatacaatggcaaaacgctgaaaaatggtactgactacacagtttcatactcaaacaacaagagcataggtactgccactgtaaaaatcgcaggaaaaggttcttacacaggcactatcacaaagactttcaagataaatcctgccaagcaggagatacagaagctcacagcaaagtcaaaggcattctttgtggattgggcgcagaaaggttctgctactggatatgaaattcagtatgctaccaactcaaagttcacaagtgcaaagaaagttaccataacaaacaacaagaccgacaagaccactgtttcaaagctttcaggcaaaaagaaatactatgttcgtgttcgttcgtacacaactgtaaagggtacgaaatactacggcgcttggtcggcttcaaagagtgttactactaagaaataatttttatcgtttatgaaagtatcccccatgcagagggttttctgcatgggggagttttttgcgttaaagcgtacattttgtcggcaaagccaccctgaaatgttacgaccgaccataaaaaaacaccgcacaaagtcttacctctgtgcggtgtaaatatctactttattacttcctcttagaaaccaccatagctgcacctgcaagtgctgccagacctatacttatgcccattgccgcatctgtattagggtttgtggtgctgttaggatttgtcgttgtctttgatgatgaagccgctgcgctgctgtcatttgttgcttcagaagaagcctcggaagatgactcctctgctttgctctcgctgctctcctcacttgacgactcctcaacaacgttattgaactcaacgtcgtcgtcctttgtcatttcgtcaacgccgtcgttaaccaactcaactctctcccagccgtaaatgccttcaatagcatttgtaagctcatcagctgctgtcttctgtgaaacagctgatgggtgatagtcaactgcataaccattgttttcgctgtcctgaacgctgaactcgaaaactgataccttgctgtcgcctgtttcagtcttataagtgtcaactgcatctgtaatagaaggataaagctcctgtcccataataccgagtgtacaaagtatctcagaatttggattcttagctcttatctccttgaggaaatttacatagcccttttcaaactcagcacacttatcagcgtcaccctttgtgtatgagttatcgtttgtaccaagatttacaacgataagctcaggctgatactgtgagaaatcccaatcataattagctgtctgctcaccgtcgaaccagctccatgtaaagcagaacttatcatagaaatttggcactagcagtgcgtcatttatcttgccgttgcctgaataaccagagatcacacctgctccgcttactgatacaaagctgtagtcagcgccaaaattctgtgctgccttgtaagcatatgtctttgcggcgttctcgttgtagatagaaaatgactttccaagtggatcgtcaacgccgtatccacaagtgatagagtcaccaataaactcgatagaatgctttgctgcctctgttggctgtggcttgccgtctacctcaaagctgtcaattgcgataacgctctgtgcagcttctgaaagctttatgagcttaactgtgctttcgccctcaggaagatctacctcaactgcgtttgtcttcttattttttatgtagccctgcttaacaagcttgccgtttacaaatacgccaattcttgcctcacctacgctgccgtttacattgaaaacagcctttgtgcctgtgcatttgaactcgataccgcttgcagaatagccaagtatcgttgtgtcgccctttctgtaagtacgaccgataagcttaacattgtcgcttgttgcctcgtaagaggtgagcttgtccgttgcttccgtgtctgccatgactgtcattcccatgcatcctgctgcaattgccgcagcacagaagcctgccaaaaacttcttcatactatgatttcctccgttgtttaatttttttgtatcttttgccttaatatttctcgatccaataatttaattatactctatctgcaagatatatacattaatttattattaatatttattcactattttattaacgggtctgttagatattctttatcctcttataaaccacagccgacagcggtggacagacgaaactgcctgaaacgggctgtttgttcatcttgccactttcatcaagcctgagataaaagcttccctcaggcagaccgaagcccctgttctcgtagtaaggattaagtgcgataacatagcattctccgtctttttcaagcttccagcttacgcagttccaatcgtcattgtgcataaaatgaagatgtgcgttcacgtcctctttagtatacattcggaaaagcggacttccctttctcagccttataagagccttgtaatactcaaagacctctttatattcaagctttctgttccactttatggagttagtgtagtcaggcgcattgtagctgtcatgggaatagatattcacatcgtttggcgcttcgccctctttgagtatcctcggctttgacctaaggaaatcctgaccaagctgtatgaacggcatgccctgtgaaagtatcactatcgccgccgcaagcttatccatttttatccttacgccctcactgtcattctttgccgatatacaaagcttgtcccacaaagtattgttgtcatgagcctcacagtaattcaccgcctgagtaggttcaaaagcccagcaagcttcttttgcgtcatttatctgatagtgtggcacagagccggctataccacgccttagggtagaagccgcatttctgtttccgctgacaaagcccttgtcatatggattgaaagtaccgcccttaatagaatctctgatgttatcgttgaaaagtccaactcttccaaattgatatgagttccatttatatgcaagcctgtcagcagggagcggtgactctcctcccgtccagccctcgccatacattagtatctgagggtctatcttgttaagctcgtcccttatgatgttcacagtttcaatatcgtgaagtgccataaggtcaaagcggaagccgtctatcttatattccgttgcccaaaatctgagagaatctatcatgaattttctcatcatcatatggtttgaagccgtttcgtttccacagcccgagccgtttgaaaatgagccgtcatttcttattctatgataataatatggaaaagaacgctcaaaggctgactcctcggtatagtaagtgtgattgtataccacgtccattacaacgccaatgccgttctcgtgaagtgccataacaagctgtttgaactctcttatcctgcacttagggtcataagggtctgtggaatatgacccctcaaggcagttgaagttcttagggtcataaccccagttatattgattgagccaaggcttgctctcgtccacagtggcataatcttccacaggaagcaggtgaacatgggttatgccaagctctttgagatgctcgatacaggtattcacgccctgatatttcgtacccttatcggcaaaagccacatactttcctctatgctcaggagcaacgcctgatgaactgtccgcagaaaaatctctgacgtggcactcatacaccactgcgtcgcaggcatttctgcacttaggcttcttgaccttgtcccagccctcagggtcggtggtcttgaaattcaccaccgcaccaacgtttccgttgactccgcaggcttttgcatagatatctatagtttcatgctttgttttgtggtcaaactcaaatgtataggtataaaaaacaccgtcaaggtcacggagtatctccacataccaaacaccgtggtcaagcctttccataggcaggctttcaagacggcttttgccctcaccgtcaagatacagattaagataaactcccgttgcaagcggcgaccatgttttgaacacagttttgccctctttcatgaccgcacccagatcgtttcctatatattgattatctctgtcgaactgttcataattcaatctgtacatcaaccatgccccttgcctatatttttttacgtcttagatatttttacttcagactttcgccaagcaccgagccttgaagaagcttagtttcaaagccctccctcgtatttttgagcaggtcatcgcaaagctttaccttgtccttttcaagaagcagcaggatagttgagccgccgaactcgaaatatcccttttcttcgccctttgtgacctttacgcccccctcagtgtgcagattagttatcctgcccaccataagagcaccgacttccatttgaataatatctccgaactgctccgttcttatcatgcaatattctctggaattttccttgaaaacaggcagataattgttcaccacagggttcacagtgtgaaggataccatttatctttctgttgtggctctttacaccgtctgcacaatagcaatagcggtgataatcgtccactgaaagtctgatgataactgcatagccaccctcataacgctttgcaagcttgctgtccctaagaagcgaggcggtattatacactgcgttctttataataaaggtatcagactgtgttatcttataagctgtgacctttccgtctgaaggtgacaccagcagattcttgtccttagtgataaaacgtctgcctggctttatttttcttgtgaaaaaatcattgaaagagcgatacattctttcctcatagtcaaacatatctattccgttattttctgcaaagccgaaaataaaaggcactgagaacttgctgtcaagtatcactcttgcacactttgaaaatatcggacagccaagaaatttcataagcgccctgcccattgccgagctgtaggcagccgcaagaaagctatcctgagatgtggtctgttcgtattctctgccctgtctgtcacgatatttcatttgtttctctccttttatttacattattgtaggggacgacacccccgacgtcctgtttttcacacacctgtccggcaaaaacattttccattcaggtaacttttaccttagattatatgctgcattttaagatagccgagaaggattatcgcacctatagtaaagagtatcagcacgcctttcatggaaagcttcttgacatttattttcaatacaaagagtattgaaataagtatcataaagctatggaaaacaaatggaaaaatattttttggtatattgtgctgacccatgaacagcagaggaagtatcatagcaactgttgtaacaggcagacccttatattcttttctgttctctgttgtgtttctctgacgctcttcctccataacgttgaagtagccaagtctgataacagcgccaagaactatcataatgcttgcgataagacgaagcggatagaccgagttgtagtgatagcctatgacagcagggaaaacaccgaagcaaacaaggtcgcacagagagtcgatctgtatgccgaacaccttttcatgctctgttctgtttttcatgcttcttgctatcttgccgtcaaaaaggtcgcagatacccgaaagaagcaggcagagaaaggctatggacatatgattttcaaagacctgtgtaatgccgaacactgacgaaacaagtcctatgtatgtgagtattaccgaataattataaaaaccgatcattttttcttttcctctcattctttttcgacttcttttttaacttcctgcgacccctcaagaccattcttcttatcattcctcataacgataaagtgagccacgaatgttaccaatgcgctcattatcagcagtaaatagaagctgagtccacggctcagtagcattgcaggctttacaagctctgcggtgaaaatgctcatgaacatatatgtgaagcagccctctgttacgcctgccgcaccaggcaatggcagcatttcaactgcaacgcctatcatagtctgaagtgcgataatattccaaaaacctgttccgctaaggccgtaggacttatacacaatccatgtgacagccagcaggaacagtctctgcaccagtgtgataagaaaaatatttatcacagtatgcacattgctctttatatattccgaaccgatcatgtaattgtcgcagatacgttttatcttgtttatatatttttcgttgttcttttctttgagtatccttatgcgtgtcagaagatttataagctttatgcccatttttctcgcccacaaaggcttatagaaaataaacacaagccctgcgatataggcgatattcagtataaagccgataagcagaagccaccaaagccgtcccacatgaagctttataaagccaaagttgaaaagcaggaacgccactgcaagaagcacctgcacagccttgaaagctatggtgatgataagcattatcaaggtggaaaagcctatctttatgccgtctttcttcatgtaatacatctgcgcaggctgtccgccggaagcagacggcgttatacagctaaagaaaaagcctataaacgaatatttcaaacaacgcctgaaaggagtttttacttcaaaaagcctcagcatatactttattatgaccgactcccctgccacatagcagaacacgcacacagcacccactgcaagccagcttttctttgcaaggtgaagatccgccactatgtcggaaaattcttctcctttgaaaagcagtctgactgtcagccagcctatgaccacaataaagaatatattaagaacatatttcaggttcttttttattttcatcatctccgaattttcagcctgtccattaaaaggtcagaccgtttttgtcccacacatattttttacagcacgaatgccataaagcacagatttactattatctgcaaaattgtaaatcttattactacctgagtatcagaccagcccttgttctttcttgcatggtcgtgaagaggagttcttatgccctccataaaattctttattttcaggaaacgtctgaaagaaagcttgagaagtccaagtccgccgtcaagtatgataactatagccatagggataaatgcgaacggtgcggcagtttttaagaacatcactgcaaggaaaacgcccagcgctctcgagcctgcgtcacccatgagcatctggctaggcgagcagttgaaccacagataagccgcaagcgtcacgaacattatcataggaaggagcatatcagccgcaccactctttgtcaccataaatgcaagtggcagaagaactgtcatgaccaatgaaccgcatagcccgtcaacaccgtctgtacagtttgtaacgtttatagccgtccaaacgagaacgcctgcaaggatgatgaacagcggtgcagggatagtgaaagtggaatctgtgatataaagtttcacctgcgagccgttataaaaatagtatgtaaacgcaatgccaagagatataacaaggtcgataagaccctttttcaggttgccccaaggagtttcagcagcatcatcaaaatatccgctgagcatggcggcatacacaagcacgagatagattatgttctcgatatcgagaggatagaaaagcgctgtgcaaagtgtaaaggaagtcacgaagataattcctgcgccacgaggcttgccctcagaaagtgcgccgttcacagcaaacgctctgccctgatctttaggcaaaatgcgtttgaagaatttcaggctgaaaaaagcaataagaaaactgcacagcattggcacaaatagcaccaatgtagtattattagtcttagccaaaaggttataaaacattgtcatcgtccttttctgtttcaattcatacatatactattatattatacaacatagctgtgcaaaatgcaaatattattatccgtcattttgcacaattttttcttaatggtttcttaatgtggaaaatttaaggtaagtgccaagcaaaacaaaatgcacagcccatataagactgtgcataggttcattctgtttcattcaatatattcatcatttctgacggcgtaacaataaaatctttcatgggataatgtttcttatttcccgtgacaacataagcattattatcacgcttttccattgctacctcgtagaaaataagatcgtccatatccacgagtatctcccctgtcggtttcgggtcaactttaattccatttgaaataatagaatttatcattgtttggatagtttcagcttttaggtgaaacttaggtctgttcaagacttccgcatattcatctattatgtcatcatgaaacagcggcgttatcctgccgtcaagcacctcacgaagcaccatacacggcggagattgcgaatttttagtgataagagcagatacgataacatttgtgtcaataacagcgcagactttcatttatcattttctcctgttctttctcacttctgctatttcagcgtttatctcgtccaaagacatttcagggacgtcagttgcctgctctctaagcttttcaaacgcttcaagtccctctgctcttgtaacagcattttcaggaagaactgtttcaaatggtattccacgcaccattttgctgcgcaccataaacattctgaaagctgtaggaagatccattcctaatgcactgtatatctcgcttacctcatttttaaggtcactgtcaacacggaattgaactaaagtctgattttttgccatacaaaacacctccaaatatattaaaatgtatgtgtttatctttcaattatattatatcatcatttatatatattgtcaacacagtacactacaaaatacattatcatgaaaaaatatatttgctcctaaagattgaaaaaaacattattttgtgctataattatctcattaaggaggcattttttatggcaataaaagacaaagtgctggaacttctcgacgataacaagggcaaatatctttcaggcgaacagcttgctgacacgctgggctgcacccgaggggctgtttggaaagctgtgaaagctttgcaggaaaacggctaccctatctctgcggtgacgaacaagggctattcccttgatgaaaacaccgatatactttcccttgcaggcataaaaaaatatcttgaccctgaccgtcagggacttgaaatagaggtatacaaggaagtaagctccactaatctggtactcaaagactatgcaaatcagggtgtacccgagggcaggatagtcattgcaggtatgcagacccaggggcgtggaaggcttggacgttctttcttctcgccctctgattcgggactttacatgagcattcttctccgccctgacatggctgcagctgacgctgttaagataaccactgctgctgcagtatctgttgcccttgctgtggaaaaggtcagcgatcagaagcctgacataaaatgggttaacgacatttacataaacggcaggaagatatgcggaatactcacggaggcttctttcagcatggaaagcggcggacttgactacgctgtgcttggcatcggtgtgaacacctacgagccggaaggcggttttcctgaggcaataagagatatcgcaggaccgatattccacgaaagaaaaagcgatatgcgaaacaggatagccgcagagataataaacaatttcatgcgtctttatgacagctttgaagaaaacagcttttacccagaatacagaaaacgcttgctgtgggtaggcgagaagataaacgtcataagaggaagcaaaaaaactcctgccacaatgcttggggctgatgaggactgccgcctgcacgtcagatatgaggacggcagagaagaatatatttcctcaggagagataagtattcgcaaggcttaacatagggcacgaaatgtcaggtatatccaatgaaacaaacgtctatgattttttataattaattcagtttatcaaatagtatcagcaggtcgagtcattgagaaatggctcgattttttatgcattataactatataaacgttttcgtttatgtgtatttctacaagttagtcaatacttattctaattatatatatcccatgtaaataaaaacattattcattttgtgtcatatagtatataattatagttgacagtatgtcttgattattgactttgtaatcaaatttaactttaattatatggaggaaattttatgacaaaagaatttgattattcaccgatcgacaaaattcttgaaaatcatgaaaaaacagcggtcatagccatattgcaggatattcaggagatatatcactatcttccaaaggaaatattcccatatcttgcaaaaaagcttggcacaggcgaagcaagaatatacagcgttgcgaccttttatgagaatttttctctcgagccaaagggcaaatacgttatcaaatgttgtgacggcactgcctgtcatgtaagaaaatctatacctattctcgaatatctcagaggagagcttggtcttagcgagaagaaaaccaccactgacgatctgatgttcacagtagaaactgtttcatgtcttggtgcttgtggacttgcccctgttctcactgtgaatgatgttgttcaccctgagatgaatcctgacaaggctgcggctctgcttaaggaactgagagaaaaggaggctgaataatatgctgctgaaaacgaaatacgatcttgacaacgcccgtgaacagtatggtaagcttgttgacaagcaggctagaaaagtgcttgtttgcgcaggtacaggctgtgttgcaggcggttcgctgaacatataccagaagcttatagaaactatctccgcaaagggattggagtgcgtggtagcacttgctgacgagccacatgatgatgatatccacgagggcgctatcggcgtaaaaagaagcggctgtcacggcttctgcgaaatgggtccacttgttagaatagaaccagagggctggctttacaccaaggtgaagcttgacgacgttgacgagatagttgacaagactatctgcaatggcgagtgcgttgaaagactgtgctacaagaaaaacggcgaaatatatcgccagcagtcagaaataccattctataagatgcagcagcgtatcgtccttgaacactgcggtcacattgacgctacttccataaaggaatatcttgctataggcggctacagagcctttgaaaaggcacttctcgatatgtcacctgaggatatcctcaacgaaatgacagaatctaatcttcgtggacgtggaggcggaggattccctcttggcagaaagtggacaagcgttgcaaagcagaaaagccctacaaaatacatagtctgcaatggtgacgagggcgaccctggcgcatttatggatcgttctatcatggagggcgacccacacagacttcttgaaggcatgatgatagccggtatcgcaacaggcgcaaaagaaggatatatctacgttcgtgcggaatatccgctggcagtatcacgtcttaagggtgctatcgcacaggctgagcagtttggtctgcttggtgacaatatactcggcacagattactcattcagaatacatataaaccgtggtgcaggcgcatttgtttgtggtgaaggctctgccctgacggcttctatcgagggcaagcgtggtatgcctagagttaagccgccaagaactgttgaacatggtcttttcaacgagcctacagttctcaacaacgttgaaacgctggctaacgtgcctgttatcatcaacaacggtgcaaaatggttcaggagcataggccctgagaactcccctggaacaaaggctttcgctcttacgggcaacatctcgaacaccggtcttattgaagtgccaatgggaacttctctcagaaaggtaatattcgatatcggcggcggcatgagaggtgacggaaagttcaaggctgttcagataggcggtccgtcaggcggctgtcttgttacgcctaacctcgatatccagcttgactttgactcgctgaaaaaagtcggtgctatgatcggctcaggaggacttgttgttatggacgataagtcctgtatggtagaagttgcaagatttttcatgaatttcacccagaacgagtcctgcggaaagtgtgttccatgccgtgagggtacaaagagaatgcttgagatacttgagcgtatcgtaaatggtaacggtcaggagggggatatcgaactgcttcttgagcttgccgacactatctcctcaactgctctctgcggtcttggaaagacggctgcattccctgttgtatctacaataaagaacttccgtgaggaatatgaagctcacataagagataagaagtgtccatcaggcaactgcaagaagcttgtgacatatcagatcgaccctgagatatgcaagggctgttcaaagtgttcaagagtctgtcctgtgggtgcgatcagcggtgagatcaaaaagccgttcaagatcgacacctctaagtgcataaagtgcggagcttgtatttccaactgccatttcaaagctgtcaaggaggtttaattttagctatgaataaagagtttatgataatcgacaatatccccgttgctataaacggtgaaaaaaatctgcttgagcttatcagaaaggcaggcatcgagcttcctacattctgttactattctgagctttcagtatacggtgcttgcagaatgtgcatggtggaaaacaagtggggtggcatggaagccgcttgctcaactcctccgagaaacggtatggagatatacacaaacacaccaaggctgagaaaataccgcaagatgatattggaacttcttctttcaaatcactgcggcgaatgtacgacctgcgataaaaacggcaagtgcaaattgcaggagcttgccgcaagatttgatatccacagggtacgttttgacaatccaaagtccaagccttgtatcgatgattcttctgtatctatcactagagacgccaacaagtgtatcctctgcggtgactgtgtaagagtgtgcaacgaggtgcagaatgttggtgcaatagattttgcattcagaggctcaaaaatgaaggtagcctgctcatttgacaagcctataggcgattcaaactgcgttggctgcggtcagtgtgcggcagtctgtccaacaggcgctataatcataaagaacgacagccacaggctttggaaagagcttaatcaggaggacactattgcagtggctcaagtagctccggctgtaagagttgcagtggcaaaagagttcggctacaacggcgagaacgttatgggcaagatagttgcagcacttagaagaataggcttcaactacatttttgacacctcaacagccgcagacctcactgttatggaggagtcaaaggagtttgcagacaggcttgcaaacggcggaaagctcccgctgttcacatcatgctgtcctgcatggataaagtatgctgagaacgagtatcctgagatactgcctaacatttccacttgtcgctcaccaatgcagatgtttgcttccgtaataaacgagaagttcaagggtgagggcaagaagatactttctgttgctgttatgccttgcactgccaaaaagggagaagccgcaagagatgagttcaaggacgagaacggcaaaccactggttgattttgtcatcacaactcaggagcttatcatgatgataaaagaagccggtatcgtgttcaacgagatagagccggaagctgttgatatgccgttcggcactatgacaggcgcaggcgttatcttcggtgtaacaggcggtgtaacagaagcagttatcagacgtgtttccacagacaagtcactcgcttccctgagaaatcttgcattcgagggtgtaagaggcttcgagggcataaaggagcttgaagtacctcttggcgacaaggctatcaaggtctgcgttgtaaacggacttcgcaatgttgaggtcataatgaacagaatgaaagccggcgagcatttcgaccttatcgaagttatggcttgtccaaacggctgtataggcggcgctggtcagccaaaggctactatcgacgagaagaaagagcgcagtgttaatctttacaatgctgacaagctttgcactttgaagcgttcagaagaaaatccgcttatggataagctttacgagggtatcctcaagggcagagagcatgaactacttcatgtaagctatgtaaaataacaaaatagcataaatagcgaaaggggctgtaaaaaaacgcgcaataaaaaaagactgcaaccacccttaaaagggtaggaaagcagtcttttttgtggtataataaatttgatgaaaaaatacagagccagaagacgtggcttaaatgccatgaatttagaaattgcgatgatttgctgtggttttaatctgcataaatttcacttgaagaagatcgcaatcagaaaagcagcctgaaaaagatatttttcaacattttaataatcggcaaaaacgcagtttttgtgccgctgtgtttgctgtacccaaaattcagccaaaatagttatttttgcgatttggcataaaaaagagtcgagatttcccgaaaagtaggaaatctcgactctttgagcgctgtttttttacaacgcctttttctgaatgaatgaaaacagccgcagaccgccagccttttgcaatgtgtgattatttatcctgtgtggaaagtatctttctagtctgaggtatctcaaaaagtgcaaacgtaccgatagctgtgaatatcatttcaggaagcatatatgagccgttgtaaagcaggctgtagagtatgctgttgtctgttgagaagccgtcccacagtgcgccgaatgacttccagataacaacgccgctgatgaagtggcaaacaaatctcaggaaaactgctatcatcgttcctgctatccagcccactgcacctttttttctgaacattcctgccacaccgagaactgtgtaggctgcaagatagtcaatgaatatgcaggcaacgagcattacaggagaaagtccccagccgaaaagtccgtctgtgataccctgaatgaactgaatgagagagaaaacaaatgccgctccaagaccctttgctacgccatgcttaatgctgaaaacggctataggaagcatggagagcagtgtgatagagccgccccaagggagcttgtatactctgataaagctaagcactgttgccagtgccaccattactgcaccctcgacaattgtgagtgtttttgaatttttcatattataccattcctttctgcgtacaaaaaatgcgtatgcctgataaaagggcatacgcatagatatacacactattttcctacgctggcattacccatatcaggtgcggtcagaacatctatttgctctttctcagccgaaaaacattcagctcccgtgttgttttatgtactattgttattatactgcttttttcgtgggttttcaatagcttttctgattttccccacctaaattgtatgaaaacataaatatctgtcacaaaatcgcattttattattagttttgtacatctttgctgagtatctcctctatgttctcaaaaataaattcctgcgcctgctttggaaaaagtatcgtcttgtagctgtttccaagctgtgatattttttcacgctctattatgcctgcttcaggtgaaagtattgtagtttcaagaaagcccctgccgtttgcaccgccttttgcaagataattttcacctatgagccattcttttatggcaagttttatgcttcttatatcgccgtctgtgccgagctgatagaaaatgctgtcgcatacttctgaaagggtcatatcctgttctttgcctgaaagctcacctgcgtgggcgattatatattcctttgtgctttgaccgccttctgccatctgtttttgcagatagccctctgggatatatttataacccgaagcagcgtcaggattttccttgagatatttctgtatctcagctataaagtatcttccataacgttcctgctttgacttgcccacccctgagatattcaaaagctccgtctgcgtcttaggcagctttatacacatatcacgcagtgaagcgtctgtaagaatgatatatgcaggcagactcgcctgtgtcgcaagtttgcttcgcacagctctgagccgtccgaaaagctccttgtcgaatgtcgtaacttcgtccctgccgatctttgtgaccgtttcgctctttggctttttctttggaaggcgtattgtaatagtctttttgtccattaatatctctgcagaccttcttgtaagagtaagcacagaaaaatctccgtgtgaagtctgtgtgatgtaatcatcagcttcaagaaaagctatgagccttcggatatatacctgcgtggaatctttcattatgccgtaggttgaaagagtggaaaggtcaaaacgctttaccttttcggagtctgaacctttaagtatctgtgctatgacacctgctccaaaagaaaggtttcgctggtgaagtctataaatgcaggaaagcactttttggcaatctacagaaacgtcaacttcttctgtttctccgaaatcacccaaacagcctgagcagttctgacaaggcttgtcctgcttctcgccgaaatatccaaggataaactctctcagacagccgtttgagttgcagtaatcggtcatctttttcagacgcataagatcacgtttgcgtatcatttcaagagtgtcatcgtcaaggtcgggattgtcatgagaattgtttataagaaacttgttggtcgcaacgtcctgaccgctgtagagcaaaatgcactttgcttcgttgccgtcacgtcccgctctgcctgcctcctgataatagctttcaatattcttaggcatattataatgtatgacatagctcacgtttgatttgtctattcccatgccgaaagcattggtcgccaccatgacctggacacggtcaaagataaaatcgtcttgatttttacgcctttcctcatcagaaagtcctgcatgatagcgtgaagcgttgtagccgtcggcacagagcttttcacacacgctctcaacattttttcttgtggagcagtagattattccgcagttgtccttgtatttctcaactatcctcactgtttcactgtatttgtcatgagggtgagaaacgccaaagtagagattttttctgtcaaagcctgtggttatggtgaaagggtcacggagttcaagcattttgataatgtccgcttttacttctgcggtggcagtggcggtgaatgcgctgacgataggacggtagggaagtttgccgagaaactcgggtatcttcatataggaaggtctgaaatcctgtccccactgagaaacgcagtgggcttcgtccaccgcaagcatggatatcttcaccgacgaagccagtgacagaaacgaacctgtcatcagcctttcaggtgcaacatatattatcttgtacataccacgggcggcgtttgatatagccatttcatactgtgccgccgtcagtgacgagttcagatacgctgccctcactcccgattgtatcagcgagttcacctgatctttcataagggatatgagtggcgaaacaactatagttatcccgtcaaacataagagcaggtatttgatagcacatagatttgcctgcgcctgttggcataactccaaggcagtcacgccctgcaagtatgctgtctattatctgctcctgaccgtttctgaactgagagtgtccgaaaaagtcctgaagcaccgaatacttattgcgaaaatctgtcattttatcctaactttccattgtgtgtatgcttatattatactaccaaaaaccagctaagtcaaacagatatacaaaattccatgcacgattttgtaacatcttttccttagtcgctattgtaattttatcgggattatgttataataggcttgataaataattagttataaaaatataaaaaattaacaaatctccaaaggaagggttgtctgaacacagtcaaatattcaggcatggtgaagatcatggatatggaaaataaattgtggcaaagctattttggtgctgtctggggaaaggtttgttcaatatggcacaatatcggcgggtttgttatggacgagaaaagcggagagttttatgccgatgaaaactgtcgtgctcttatgggacttagagagaacacagattatgacaagttcagagatatagttgcattgaacggcggaggacgagatcttggcctgccgttgtgtatagaacttcttgacactccaagtggcattaccgccggaatagtgtatctgtcgaaagaatatatgtcaaaaagtgtttttgaagggctcgacattataccacaatcagagcttgtaagacttcttgatggaatgacacgctcatcattgcttgctcttgtaagatttgatggagcagggaagcttttggattcagactactgcataggggaggcacttaaggcggctgttgcggttttgcctgaaaatactgtaacggcattcaattcagacggtcagttttggatatatgttccacgctttgtaggtaagcctgaggaatttgctgacaatatacgtaaagcggtgaaggagtgttgcctgccagatgaatttggagtgagatcgtcttcaaatcattcgctgtctgtgacggcaggcataagcagcggctttgaagtgccagcaagactcatgcacgcagcaggctttgcactttatgaagctaaggcaaagggtgcaggcagtatttgttgctttgatcctgaaaaatatgcaaagcagaagagtgatatcgagaatatcagggctttttcagagcttcttgataaaaatctgtttacatatcattttcagcctatcgttagttcttcaacaggcgagatagtcgcttacgaagcgcttatgagaacaaagggaaatatagcactcaatccgcttcagatactcaactgtgctaaaaatttcggcagactttacgatatagagaaagctacactgaaaaatactcttaaatatctcagcaagcatcagctcgattttgaaaaccgcaggctgtatataaattcaatatcatctcatgctcttgacgataaggatttttatgcgatcgtcaatgattatggcgaacttcttgaaaaggtcgttatcgaaatgacagagcagacagagatcagcgaggacgacctcgatagaataagggtgcgtcttgaaaagaacaatatgagccttgctattgacgattacggcacaggctattcaaatacatcgaatcttctgcgatatgatcctgaggtggtaaagatagaccgttctctcatttccggtattgaccagaattctaaggctcagaagatagtttcaaaaatggtggaatatttccattcaagcggatataccgcacttgcagagggcgttgaaacaagcgaagaacttaaaaccatgatatatttcggcgtcgatcttattcagggttattatgtttctaagccgaagcctgtgcttatccatgatatctcggaaaatatccgtgaggagatagtggcttacagtatcgaggctggagataatgataaaaaggtctatcacgctgaggataatgacgttatcgaccttgctgagatgtataaaaaaagatattctgacatttttctcggcacaggtacatttactctttcgggaaaggctgaggacgatcgtgcagtgcctttgtccgtgacaattggtaatggtgttgattgcgtcattcacttgaaaaacgcatggctcactatatatgaggatctgccaatcataaagctaggcaccggttcgagagtcaggatagtgtgcagcggtgaagatcgtatagacggcagaggtatttatgttcctgagggatcgtcgttagagcttgtaggctcaggtgagctttatgtcagatcagagtcgaaggattgctatgcaataggcactgacagcaagcagccttgcggaaggataactgtcgcaatgacaggtattcttgatataactgcaaatggcgacaagtgcgtcggaataggcggaggaggctgcaaagatggtattgtcattgcaggcggtgatatagctgtaaattgcagtggcgataggtgcgttggtattggaagcatcgacggcgacgcagatgtgactatatcaaactgtggctgcaggctaaagcttgcggcaggaatgtcagtgggcgttggtgctgtaaagggcagtgctgatataagcatttcagactataacatgagttgtgagctttctggaaataacctgactgcagtgggagttatgagtaacgggactggaaggatatgtattcttgatggcaggctcaacatttccatgaagggaagaactctcaactgtgtgggaacaaggggcggcgagctggattgtgagcttaaaaatactgtctttaagctttattgcgagggcggttctgtctcaggcattggagataaaaccggtaaaggtgacgtgacagcacaaagctgtcagttcgacgtaatgttccttacaggcgatggctggtggcttggaagtccgaatggtacgctttcagtagtcgattgtaagaaagatatcaagataaacaaataaggcaaagcccataggcgtgtcttgtgtgacgctgctttagatcgtctgaagcagcacggctgatttgtacggaggatcatgagatgatgaatgatactgctaaacgcagacgtataaaaataggatttttggtgagccaccttgaagatgattttgacgatgcggttgcggagggcgcaatgataggcgcagagcagtgcgacgccgacctcgttatttttccaggcagatatatagatggaatctatgccgacaagctgagaacggtgtatgagtatcagtataatactttgttcgatatggcggcggcaaataagttcgacgttctgcttgtgcttatcggcacacttggaacatatcttgacaacgagcataaggttcagtttctgaaaaaatttgctggaacgcctgttataactataacggcacgtattgatggttatccttgtatcatgctcgacaacagaacgggaatgaaggaggctatagaacatcttataaaggtgcatggctgtaaaaagataggtatggtaagcggacctaaaacaagtgatgatgcccttgaaagacttgacgtttacaaggagactcttgaggaaaatggtatcatctatgacgaaaagcgtgttgcatatggtaatttttcgaaattctgtgttgacgaagtcggaaagcttattgacgataatccggaacttgatgctatcgtttttgcaaacgaccagatggcaattgcaggctataaggctatggaagagcgtgggatacgtcctggtaaggatatccttgtgacaggctttgatgacgatccagtggctgaggagcttaatccgcatttgacgactgtcaaggctgacccttctgagcttggctatcatgccgttcaggaggctgtgaactatgttataaataaggctataaacaacgataagatctcttcgggaatggtaagaagaaattcctgcggctgtcagggcaactcaaaattaaagaccatatcttttggtcgcatatcagatgatccggaagcgtttgcaagaagaatgagccagtttttgttcaataaatacagtgcaagtgaaacaactgcgaaaatgcgagaaaattatgtcaagataatatatgctcttgatgattatgcccgtgaggaaaatcttgataatgaggtcaaaaaagataaagtattagaaatgatctcaactcttgccagtgaagaattttttaggtttgtgaacgttgatgagctttatgcttctgttgagtatattcagcaaaagcttatctctcgttttgataacgtggagaagcatttgaagttaaatcagacttttattcagatatacaagatactggcagaacgcaatgcgaattactgtaaggaaaagcttgaggataatgagttccttgcatggcaggcaaactctatcacaagggatatgcttgtgtttgaagcttatgatgacagagcatatgagaccgttgtggataagcttatgaggcttcatatggaatcaagctttctgttcagcttcgagcctgccattattcactttggtacagataagtggcaaccgccggaatatatgtatctcaaagcctatcacaatggttctgacgctatccagctcccacatgaagagcaggctgtaaagtatacagagctgttgtcgaataagtatctgccaacagacagacgttatacattagtggtatcaccattgttctctaacgaggagcattacggaatactgatgtgtgagataaagcatgagtattttaattatttgcagtcggtgacagttcaactttgtgcggcgcttaaaataataaccttgatgaagcagcaggctgttacccagaagcagcttaaaaagagccttatcgagatcaaggagaacaatgagcttcttcgagatctttcaaggcaggacgctttgacgggatgctacaatcgaaggggattttttgaggagcttcgtaaaagactcagcaatgacaaaaacgagggtgaaaaggctatcatggtctttgccgaccttgactgtctgaaaaccataaatgataaatttggtcacgaggagggcgactttgctatactatctgcggcaaagatacttaaacactcttttggcaacagtgagatagtgggtcgtataggtggcgatgagttcgttgtatgcgcttttcttgataatgcaatagatatcccgtcaatgagaaaccatatagaagcggtcacaagagaatataatattaaatatgccgccgataagccatatataatccatacgagcgtaggagtttatccgttcgtatgcagtgccacgcttgagataggagagcttctcagccatgctgatatcctgctttatgaggaaaaaaagcacaagagaagtattcttaaaagcgattatgaataacatttgcaggctgtctgaaaaaggcagcctgctttttgtttttatgcttgacaaaatatcatggctgtgatataataaaacatattttacgaaaggagcgtcggatgacatgagaattacaagaatatgggtgagaaactattaaaccgaatatcaggcaggtgcattggcacaagccgctccgactcttccgtataacgttttggttacacgcctgagggtgtgtttttttatgcctgaaaaagccgaagagcggcttgataacagacattaggagtgattaatatggcagaaatgtttgacaacacaataaagaaagaccgtgtgctgcttgcggcagtggacacaggttcgtatgacgtggagctttcccttgacgagcttgaagagctgacagaaacagcaggcggtgaggtgatagcgagagtgacacagaaaaggccgtcctttgacagcggaacttgcataggctcaggcaggcttgaagaaatggctgagatatgcagaaatgaaaatatcgacaggatagtttttgactgcgagcttacagccacacagataagaaatatcgaggacgtgtgcggcgttttcactattgacagaactatgctcatactggatattttcgctcagcgtgcgactactcgtgagggcagattgcaggtagagatagcacagaacaaatacagacttccaaggcttgcaggcatgggaactaatatgtcacgtcttggcggtggtatcggcacaagaggtcctggtgagtcgaagcttgaaactgacaagcgacacatcagaacacgtattgcggcactttcagacgagcttaaggagatagagaagcgtcgtgggcttatgagaaatcgtcgcaagaaagacggtgttcttacagcggcgatagtgggctatacaaacgtgggcaaatccacactgcttaattatcttacagaagcgggcgtgcttgcagagaacaagctttttgcgactttggaaacaacatcaagggctatagagcttcctgacggcaggtcggtgacgcttattgacacggtaggacttatcagacgtctgccgcatcagcttgtggaagctttcaaatccactcttgaagagacgtcaagtgcggacgttataatccatgtgtgcgacgcctcggctgatgattgcgaggagcaggcaaaagttacccttgaactgctcaaagagcttggctgtgagggaatacctgtggtgacagtgttcaacaagtgcgacaaagtgccttatataaacgagcttgacacaacaggtgaagcggtgaagatatccgccaaaaacggcacaggcattgacagcctgcttgcggctatacaaaaggcattacccgaaaacagcgtaagatgcaggcttcttctgccttttgacaaggcgggtcttgtgaacaccataaggcaggagggcaggatattcagcgaggattataccgctgagggtatcgttcttgacgctcttgtggatatcaaggtatatcatcttgtggaaagctataaggtaaaaaatgaagaataaagtgttttgcaggcgttaaaaaaatgtaaactctcggcatggctattgacaagccctgcctgtgagagtataatgaacgtggttagcaataacaaataaatcgaaaggaaaaaacagaatatgtctactgttatcatgtctgcagtctttacatacttctttatgagcttgagctacttttatggcttcgagtttttttggcgtgtgaagaaagcgacgagatcagaataggcgtatagagaagtttctgtttttatatatgcgtttattataagccgtggctttcttgtaaaagaatgtcacggctgtttttattgcctatacaaatttgattttcggaggaaagtaacatgatcatcgtattgaaaaacaattcacaggaaaaacaggtagaagagcttttgaactggctcgaccagttccacgtatcgacgaatctggtagagggcgttcattcaaatgtaatcggtcttattggcgacacaactcagatcgatatagaagcagttcaggctaaggaatgtgttgaaaatgtacagcgtgttcaggagccttacaagaatgctaacagaaagttccaccctgataatactgttatcgacgtcgcaggcagaaagataggcggaggaaaacttcaggtcattgcaggcccttgctctgttgaaactgaggagcagataatcacaactgctatcgctgtaaaggaagcaggtgcaacaatgctcagaggtggcgcattcaagccaagaacttcaccatattcattccagggtcttggcaaggagggcatcgaccttcttattcaggctagaaagataacaggtctgcctatcgttactgagatcatggatctttctgatcttgactgctttgctgacgttgacgttgttcaggtaggagcaagaaatatgcagaatttcacacttctaaaggctctcggcagaagcgacaagccagttcttctcaagagaggactttcatcaacacttcaggagcttctcatgtccgctgagtacataatgtctgagggcaatcagaacgttatcctttgcgaaagaggtatccgtacattcgagcctgccacaagaaatactctcgatctttcagccgtacctctgcttcagcagaaaacacaccttcctatcactgtcgaccctagccacgctacaggtatcgcttcacttgttgagccaatggcactttgtgctgtaacagcaggctgtgacgcacttgagatagaggtacacaatgaccctaagaacgcatggagcgatggtgcgcagtcacttactcctgcacagttcgctgaaacaatgaagaaagttaaggcactttccgagttcatgggcaagcctcttgatgtaaacgaataaacaagacattgaaaaagaggtgttttcgcacctctttttctttacaaatattcagttatgtggtataatgttttagaactgtaaatggataaagtacaaaggaggacgaacgatgaaacttgtgcttaaacaaaggcttttttcatggtttgacagctatgatgtgtgcgacgaatacggcaacgcagttttcagcgtaaaaggcagactcgcatggggtcacttgctggagatatacgacaacatgggaaacaaggtcggcgtgctgaaagaaaaggtgctgaaattattccctacctttgagatatacataggcggagagtatatgggctgtataaagaaagagttcacctttttcaagccaaagttccatatagatttctgcggctggagagtggacggtgatattttcggctgggactattccgtttatagcggtgctgaacagataatgtatgtgtcaaaggagcttttgcaccttactgatacctatgtcatagacgtttatgacgacagcaatgctttggcaggattgctcattgcacttgcgatagacgccgagaaatgctcagacggcaattaggcttttatgatagctgtgtaaaaaattgtactgaaaggttttgatattaatgaaattcaactgcgagcttaaaagggtcgtggacgattcttatgatatagaaataggcagaaaattgcaggatacgctggtcagcgactttaaaggcggtctagtggggaagacaaagaaatttgccattgtgacggattctatcgttgtggatctctatggcagagatatttacgacaggctcaacgccgcaggtctgaaagccgagctttttgtaatacctgagggagaaaagtccaaaaccaggcagatgaaagagtttgttgaggactctatgcttgaaaaaggctttcgccgtgactgctgtgtggtagccgttggcggcggagttgtcacagacctggcaggctttgttgcaggaacattcggcagaggagtgccttttgtgaattatgccacaacgctccttgcggcggctgacgcttctgtgggcggaaaaactgccgttgatacgccacttgctacaaatcttataggtctgttcaatcagcccaagaaagtttatctcgacatagacacatggaaaactctgcctgaaaaacagctttcaagcggcctttcggaaactataaagcacggctgtcttggtgataaggagctgtttgagtatcttgaaaaaaacgtggaaaaggtgcttgaatgtgacggtgaagcctgcgagtatatcgcaaagaaaaactgcgaagtcaagtacaaagtggtaatgaaagacgagagagagtcgggtctgagagaggtgcttaatctcggccacactgttggcagagctatcgaaactgtgtctgattatagactatatcatggcgaagctgtagctatcggtatggtggcacagtcaagattgggcgagaagcttggctttatatcccatgaaaatgaacagcgtgtggaaaagcttcttgaaagggcaaagcttcctacaaaaatacctgactatattgacagaaaggctcttgtgaaaaagctttatacagataaaaaggtccgtgacggaaagctgagatttgttttccaaaaagaaataggcgagatgatgtgcttcggtgaaaatcagtacggcaaagagatatccgaggagcagatagctgaaataatcacagagatgtaacggaggatagcgatgaacataactgtatttccgaaaaaactcagcggacaggtgacagttccgccctcaaaaagcgttgcacacagaatggtgatagcggcggcgctgtcaaacggcgtttctgagataacaaatctttatccctcggtggatatccttgcgactatggattgcatgagggcgcttggggcgaaaatagattttgacggcgataaggctgtgatagagggcataaaggatattcctgagagtgcagttttggattgctgtgagagcggctcaacgctgagatttctcatacctgttgcttgtgcgcttggggtggatactcagttcatcggcaggggcaggcttccgcaaagacctatcacaccatatcttgatgagtttccgaaacatggcgtaagctttgaatacaacaacactatgcctttttccactaatggaaagctcacagggggcaagttctatgttgatggtggaatatcctcacagtttatcacagggcttctgtttgctctgccgcttcttgaggaggacagcgagataatactcacttctcatttggagtcaaagccatatgttgacataactctcggcactttgagagagcatggctgtcaggtggaggaaacagagaacggatattttgtaaagggcggtcagcgttatatgcctttcagcggcagagttgagggggattattctcaggcggctttcttcaaggtggcaaattctttgggcagtgatattgatatcgaagggctttctgaaaaatcttttcagggagataaaaaaattgttgaaatatgcgagaaaatagtgtataataaaaatggtggcttgcggccttttgacctcgactgttcggatatacccgaccttgtgcctgttcttacagtacttggaggcttctgcgagggaaaaagctatatacgaaatgccgcacgtcttaggataaaggagtgcgacaggctttcggctatctcacagtgccttaacgcaattggcggaaaggtaactgagcttgaggacggattggagatagagggcgttggctcactgaatggcggagaggttgacagcttcaacgaccacaggatcgcaatgtcaatggcggtggctgccacaagatgtacttcaccactgaagataaacggtgcggagtgcgtcagcaagtcatatcccgatttctttgaggtatatgagagcatcggaggagagataagccgtgagccttaacgtgggctagtacaaaaatttgtactgatctggcgggtatctgccgttatttatacaggctttataagctgacaggaggaagtaaaatgtcatcaacatggaacaacaatataggctttaccgttttcggtgagagccacggccctgcaataggtgttgttatggataatgtaccgccgggggagagcatcgaccttgacaagatatatcaatttatggcaagaagagcgcctaagcagaacaagacctctacacagagaaaagaaaaggatatgccgcagataatgtctggctattttaacggcaagactacgggtactcctctttgtgcgcttatagcaaatacagaccagcattcacaggattattcaaatctttcaaggcttgcaagaccaggtcacgctgattatacaggtgcattgagatacagaggcttcaatgatgttagaggcggcggacatttttcaggcagacttactgcgcccctatgctttgcaggagcagtggcaggtcagatacttgaaaaaagaggtatctatgtaggtgctcatatcgcagagatccatggcataaaggataaggcttttgaccctataaataccactaaggatatgataagggaagttcgtgagaaagagttcccgactattatcgacgttcagggcaacgaaatgataaaggagatagacaaggcaagaaaggataaggacagcgttggcggaattatagaatgtatcgctatcaatgttccagccggtatcggctcgcctatctttgacggacttgaaaactctatagctcagcttattttcggtatccctgcggtaaagggtctggagtttggtgcaggctttaaggtggcggaaatgacaggttcggagaacaatgatgagttctatgtaaatgataagggtcacgttgtgacaaagacaaacaatcacggcggaatactgggcggaatagcttctggtatgcctatcacacttagagttgctttcaagcctactccgtcaatagcaagaccgcaggcaactgtggactattcagctatgaaaaatgaaactctcgaagtaaagggcagacacgacccttgtgtagttccaagagctgtgccatgtgttgaggcggctgttaatatagctttgctcaatcatatgcttgaatacccaaatttttagagaaatttccaaaggaggattgatagcttggtacaaaatcctgaggctcatatatcagagaatatgaagaacatttccgacgtgtatgaggttcaaatacttctggcttattttctcggtcagataaatcagctttgtacgcctaatcagcttactgagatagccacgggcgaaggcgttgtgaattattttgtgtacactgaggctgtcagcagaatgttggaaaacggcacgctggagcttgcggaaatagaaggcacgaattactatcggctcactgaaaagggcattgagggcgctgagaaattcaaaaaacttgtgccgaaaagttttagagataagatatatgcggcaggtctaagactgttcgtcaagcttaaaaacgatcgtgacgtaagctttgatataaagcctgcaaagcgtggttataacgtgcattgccgctgctgtgacgatgatatggtgcttatggacataactctttacgcacctgatcaggagcaggcaaattatataaaatcgaaaattcagatgaatcctacagatttctattgcagagtggtggactatataatcgagaacgaggaatatgtgccgtctgctgcagaggagcagggattgttctaaagaaagtggagccgtctgggcatatgctcaggcggcttttgaaaaaaattttattttttgtgacatttcgggaaagaaaaagtatttattataaaggggtgatcaaatggacgtcaatttgaaaaatacgccttcagagatagacaggcttatagataaatataaaagtaccgtttatggaatcgctatagcacgtcttggttcaaaagcagatgcagacgatgtttttcaggaagtgtttcttgcagcttatcgaaaggggataacagtcaaggacaatgatgaggagaagttctggcttatcaggactactctcaatcagtgcaaaaagataacattgtcaagctggcgcaggcgtacagttccccttgaagaaagaaaggaagaggtaagctttttcagaagccgtgaggaaaatgatgttttctgcgctgtaacggaactgcctgaaaaatacagaatggtggtctatctttactattttgaagaggtgtctactgatgagatagcagagataatgaaagtacgcagtggaacggtgagaatgcagcttacaagggcaagagaaatgttgaaagaaaagctgaaaggaggatatttctatgaataaggaatttttcagaggcatgaaagagcagatagagcctgatgaagaacaggtcgaggagctgaaaaataagctcaaaaatactgcggcggtaagcaggaaacctatgtggataggcggagtatgtgcggcggcactgtgcgtggcagttggagcaggtctgtttttatccgacagcaaaactgataaaaacagcataaagacaagcggcagttcatcagtgcagtacaatgacagttggtcgcctgaccttataaatagaaatgggaacggctctgacgaaaatcagacagtagctggtggcgaaacagaggacagcattgccgacagtacacatgattcaaagatcgacaacagcaagacagacgatacgcataatacaaacaacaatacgggtggaaatacgcacataacagacaatgaccgcataagtgacaacaatggcggaattatttcagacaatagtaatacagaaaatacagatagtaatgcaaacgacagcaaatcggagaccacatcgtccaaaaatgaaacggaagaccctatagagttcgatgaaaaagaccctgtataccctgagatatatgtgcaggacgaaaggctttttgatatgacattaaagggcagggcatttgcattccctgcaaagtatagtgatgtagcggatatgggtctttgggcggcaggtctaagtggttattctgagagcgttgacccgaaaaattatgtgatagcggaagatgatatggaaacttttttcagtaatggtgcaacaggatattcaggaagcatgtcaattgacaataacacttatgaggaagcgaaagcaagcgattgtgatgtcatgggattgtttttggataactgtcctgagttctctataggcggaataaagactggatcaactatagaggaagtgaataagacattcggtgttaattatactaatgaatgcagaacgcttactgtacgttctcagaacggagcttttacagacagcaagggtacttttactttaacagttgtatttacattcagtgacgggatagtttataatgtaggcgagtcaaaaatatattcgacgttcttctgatcgtcaatattgtgtaagttttgtactgtttctgtgcaaaataatgaaaatatctataaaaaacatagaaacggtacaaatgttatgttacaatagatagttgacaaaacaaattgaaaaacaacttccaaaatgatataatgttaagtaccaccaatccaaatgaaaagctgcaattagttacttaacattattttttgagaagatgtgtcacctatcattgacaactgaacatttttgccttaatgatttaaagcaaaactcttgtattattataaaaagtatggtataatcaaattacgaatttttttgtatatttctaaggaggaaataattatgagtatgtatatcacttgtcttgaccttgagggagttctcgttcctgagatatggatagcttttgctgaggctacaggtatccctgagcttaaaagaacaacaagagatgagcctgactatgacaagcttatgaaataccgtatcaacattcttaaggagcatggtcttggtcttaaggaaattcaggatactatcgcaactatcgacccaatgccaggcgcaaaggagttccttgacgagctgagaagcttcacacaggtaataatcatcagcgatactttctcacagtttgcaggccctcttatgaagaagcttggttatcctactatcttctgcaacacacttgaagttgccgacaacggcgagatcacaggcttcaagatgagatgtgaaaagtcaaagctcacaactgtaaaggcactccagtctatcggctttgaaactatcgcaagcggcgacagccacaatgaccttggtatgattcaggcgagcaaggcaggcttccttttcagaagcacagacagcataaaggctgaatatcctgagcttcctgcttatgaaacatatgatgagcttatggctgcaataaaggctgctatggactaatagtctttaataaagaaaaaacatagatgaaaaaggtaatatcacttataatggcagcggctttgtcactgtctgcgaggcattcatgaaacaattcgcagagcttttaagcaaataatatttgttttttacggcgttgtgtcttttgacacttcgccgttttttttgcaaaacaataccaaacataatctgcgatatgtaacgcatattatatatagtatcttcgcttttgccgtgaatattttatcatatgaaaagtttatacttctgacataagtttcccttgacaaacggggttagtttatgctaatatgaatatggttagtaaatactaacctaaattaatgaaaaggaggagttaagaaaagtatgagcgttataatagtaggcggaaatgaccgtatggcaacacgctataaggatatctgcaaatcatatgattgcaaggctaaggtgttcatcaaatatcctacaggttttgataagaagataggcagtcctgatctggcagtggtgtttactgatacagtgtcacataaaatgctcaatggtcttaaccaaagagcaagcaaacttgattttcccgtggctatatgccattcatcaagctgctcggctttgaagaacgtgcttgaaaaatattgtactaaaggcgttgtaaacgcatagatctatatgtataggttatgaatttctaaccaaaggagggactatgtcacagtctgagctgagaaattttgaaaaaagcatggcttatcatcttgcccctgcaatgcttggaataaagcctgcctgtcttatgtcaatggaaaagaacaaggacgggcttgaagagaatgtcgagcttttcaacagcagggcatatacaaagggcatgaagctaacagtgctttgcgagtgcaaaagcagaaagctgctttttctctataacgaaaagcttttatctgacagacttgcagacaacagagtaagaaagcttcttgaaagctttggctatgacagccgtatgacccttgaacagcagcttgaaaggctgtctggaagaatatccgcaagtgaggattttcctcatgagataggtctgtttctaggctatcctgttgatgatgtgacagggttcatacagaacaagggaagaaactatcttctttgcggatattggaaagtctactctgacgaaaacagagcaagacgtattttcagcaattatgacaagtgcagaaattatctgtgtaataaacttgctcagggcgaaagcatttaccaagccctgaaaatttcttaggaggtaatcataatgaaaacagcagtaatttattggagcggtacaggcaacacagaggctatggcaaaggcagttgcagagggtgcgggcgcagagtgcttcgcagtttctgagttcagcggcaatgttgaggattatgacgcaatagctcttggatgccctgcaatgggagcagaggagcttgaggacagcgagttcgagccatttttcgcaagcatagagggcaagctctcaggcaaaaaggtagcactcttcggttcgtacggctggggcgacggcgagtggatgcgtcagtggcaggacagaattacgggcgacggtgcaacacttgtaaatggcgagggacttattgtaaacgaaactcctgacgacgacgatctcgcaagctgcaaggctttgggcgaggctcttgctaagtaagcatatatctctaatgtaataatgtaaactgcaaacgcaggcggaaaaaggcagttttgcttttctgtctgcgtttgtgcagtaatcgagttattaaaaactaactaaagttatatttaactaacttatgtttttgtgcaagcttacaaaattgaaaaaacggcacatttagtcttgacaaattcggttagccgtgctaaactatattacgggttagaaaatgctaacccttttaataagcctgaaagttagataagtctaacttttgatactgacaaaagaacaggagggtctgaatgatgccgctgacatttgcaaacgtaggggaagaaaacatgataaagaaagtaggcggaaaacctgaaacaagaaagtttcttgaaaatctgggttttgtcgcaggtggaacggtaacggtagtaagcactatcggaggaaacgttatcgttaaggtcaaagaatcaagagtagctgtttcaaaggaaatggctgcgaagataatggtataggaaacatttggcggtcaagccatgataaatatgtttgaagatattttgtatagttaggaggatcaggttatggcaacattgaaagaagctaagatcggttcaacagttaccgtgaagaagctcaacggcactggtgctgtaaagagaaggatcatggatatgggcatcacaaagggtgttgaagtccatgtaagaaaggttgcgcctttgggtgaccctattgaagtaacggtcagaggctatgagctttcgctcagaaaggctgacgctgagatgatcgaaacggtctgatacatagttcaggcaaacagcaaaaaatttcatcggcagagctgatgtgtacttagaagatgaggatatatcagagtgccgaaattctgaaaggatcaaattgtatggagatcaaaattgctctcgcaggtaaccctaactgcggtaaaacaactcttttcaacgctcttacaggttcaaaccagttcgtaggtaactggccgggcgtaacagttgaaaagaaagagggtaagctcaagggtcataaggacgtagttatcatggaccttcctggtatctactcactttcaccttacacacttgaggaagtagttgcaagaaactatcttataagcgagcgtccggacgctatcctcaatatcatcgacggtacaaaccttgaaagaaacctttatcttacaacacagcttgttgagcttggtatccctgttgttgttgctatcaacatgatggacgttgttaaaaagaatggcgataagataaatacagaccagcttgctaaggagcttggctgtcaggtctgcgagatatccgcacttaaaggcaccggtatcaaggaagctgctgagcttgcagtaaaggctgctgagtcaaaagttccaatggtacctcagcattcattcaatggcgttgttgaacacgctatcgctcatattgaggaagcatttctcaatgatgttgctgaagaacagcagagatggtacgctataaagatattcgagagagatgagaaggtcatcgaacagctcggtatgtctgagcaggtaaagacccatatcgaaaaggatatctgcgctgctgaaaaagaaatggacgacgactcggagagtatcatcacaaacgagagatacatttacatagcttcaataatcaaggattgctataaaaagaaaaatcagggtggtcttacaacatcagataagattgataagatcgtaacgaaccgttggctcggtcttcctatctttgcagtggttatgttccttgtttactatatctcaatggtaacagtaggttcagccgcaactgactgggcaaacgacggactctttggtgacggttggcatctgttcggtatcggttcatctgacgctgaggacgctgctgacgaatatggcagctcgcttgacataatcaacgcatttatcgagcagcagggcggcgaggctatcgacaacgaagctgatgactttgacgttgacgctgctaaggcaacagcagacaatctgcttgctacagtagataagtctgcaactgctgattatacagtagaggacgaggaaacacttgaagaaacaacaaaaacagctaagtatgctgatctgaaagctgcagttgcagccgctgagaaatacagctttgctgatccagacccagcggattacggcgtatgggtaccgggtatccctgtacttatcgaaagcggtcttgacgcagtaaactgcgcagattggctcaagggtcttatccttgacggtatcgttgccggtgttggtgcggtactcggatttgttccacagatgctcgtactcttcattctccttgctatccttgaggcttgcggttacatggctcgtatcgcattcgtaatggacaggatcttcagaaagtttggtctttcaggaaagtcatttattccgatccttattggtacaggttgcggtatccctggtatcatggcttcaagaactatcgagaacgagcgtgacagacgtatgactgtcatgacaacaacatttattccttgcggagctaagacaccattcatcgcaatgatcgcaggtgctatcttcggcggctctgcttgggtagcaacaggcgcatacttcatcggtatcgcagctatcatcatttcaggtatcatgctgaaaaagacaaagatgttcgcaggagatcctgcaccattcgtaatggaacttcctgcttaccatatccctacagtaggcaacgtactcagatcaatgtgggagcgtggctggtcattcatcaagaaggctggtactatcattacactgtcaactatctttgtatggttcacttcatacttcggctgggtagacggttcgttcggtatgctcacagaagaccagatggaatacagtattctggctcatatcggtaaggctatctgctggatcttcgcacctcttggctggggcaactggcaggcaactgttgcagctgttacaggtcttgttgctaaggagaacatcgttggtacaatgggtatcctttacggcggcggagatggttcagtttactctgctatcggtgctgcattcactggcatcacaggtatgtcattccttatcttcaacctcctctgcgcaccttgcttcgcagcaatgggagctatcaagcgtgagatgaacagcagaaagtggttctggttcgctattggctacgagtgtggttttgcttatgttatcgcacttatcgtaaatcagcttggcaacctcttcactggtaatgtgaatgttatcggtcttatctttgcaatagctcttatcgctcttatcatctatatgctcgttagaccttataaggaaagcacaaagcttgaaaaggacgttaaggtaggcgcaaacacataataaaaagcaaatatcatcactgatcttgcataaacagttgggaggataattatggacacagtaggcggtacgattctggttgcagtgattcttgctgctatcgtggcagctataatttacaagctcgtaaaggataagaagcagggcaaaagctcttgcggtggcagctgcggctgttgtccaaattcttctcgctgtcacagattatgataaaacagtaataaacttcggggaggtcatctgaatgctgactaaatcacagaaaaggtatttatttgccatatacagactgggtcagaacggcagacctgtcaagtccacagaggtagcttctgttctgggcgtgacaaaggcaagcaccgtcaagatgactcagaagcttatagacgagggctatataatcaaagagccttaccgtgagatcacactgacatctgagggcataaaggcagccaatgagctttatactccaagtgtgatacttcaggattttcttgaaaaccgtgtgggcgttgagagaaaaaatgccgagaatgactcggtggctattgtttctcaaatatctgatgacgctctcgacaagcttgtaagctttgctttgcaaagcacgacaaacggctaaattagtaatatttatatcgttagatcccgccttttttggcgggatttatcagatatatcagttagttgcaattaaccacaatgcgaagtaagttatggcatacaaatatgtataatatgacgtttaaaaacggcaaagatacattattaaaataaatagttagaaaggggaatgaatgtgtttcttgaaataaagaacataaaaaagcattttggcgagggcgagagcagggttgaagtgcttaagggcattgatatcgaaatagaaaaaggagagttctgcgtgcttctcggaccgtcaggctcaggtaaatcaacacttctgaacattataggaggaattgacgccgctgacgaggggtatatctcaataaacggcgaaaaaacagccgacatgaacgaaaaggcattgaccctttacagaagaaagcacttgggttatatcttccagatgtacaaccttatacctaacctgaatatcaaggagaatatcgaggtaggcgcatatcttagcgacaaccctcttgacgttgacgacctgctgaaaacccttgggctttatgagcatcgtcacaagcttcctaatcagctttcgggaggtcagcagcagagaactgctattggcagagccatcgtcaagaatcctgatatcctgctctgcgacgagcctacaggtgcgcttgactacaatacctccaaggagatattgcagcttatagaggacgtaaacaagaagtatggcaacactatcataatggtaacgcataatgacgctatcaagcaaatggctgacagagttgtaaagcttagagatggtatgataagaaagaattatcttaatgaaactaagctcacagccgcagagcttgattggtaaggagggtcagcatgaaaaaccctcttatcaagcgtttgcccagagagcttaagggcgaaataggcaaatacatcgttctgtttttgttcatcacaatgatgataggcatagtatcaggctttcttgttgcggcaggcagtatgtctgttgcttatgacgaaagctttgagaaatacaatatcgaaagcggaaattttgaacttcttcaaaaagccgatgatgatgctatcaagaagatagaggatggtgaggagaagataaaggtatatgaaaatttttatcttgacaaagaaacaaaagaagttgacagcactatcaggcttttcaaaaatcgtaaggatatcgacaagatatgtataatggacggtgagcttccttctgctgatgacgagatcgctattgacagaatgtatgctgacaataataaacttaaagtcggcgacagcctgacggtcggtggcaagaagcttaagataacaggtcttgttgcactttcagattacagcgcactgtattctaatccgtctgatatgatgtttgacgctttgaagttcggtgtagctatcgttaccgatacgctttttgacgattatggcgaggctgatcttcattacagctactcatggaaatatgataaaaccccggcagacgacgaggaagctcaggatatggcttagaaggtcatgaagcatataaatggaatctcaatgctcactcagtttattccggaatactcaaatcaggcgatacattttacaggcgacgatatcgagggcgataacaccatgataacagtttttctttatcttgttatggtcataatcgcatttgtttttgctataacaacgggaaacactattgcaaaagaagcaaacgttataggtacgctcagagcctcaggctacacaaagggcgagcttgttagacattatcttgcaacgcctatgatagtcgtgcttgtatctgccattgtaggcaacatacttggttacacctgctttaaggaatttgcagtcaaagcgtactatggaagctacagtctgccaacatacaaaacgatctggaacgcagatgcgtttataaagacgacagtagttcctcttataatacttttcgtaataaaccttgtaatgcttgtaaataaattaagtctttcaccgcttaaattcttaaggcgtgatcttaaaaagcgtcagaagaaaaaggcttttaagctcaacacaaggataggcatattaaagcgtttcagacttagagtcatcttccagaacattcctaactatattacagtgtttgttggcattctttttgccaatgttatcatcttctttggccttggcatgaagcctatgcttcttcattatcaggatataatagaagataatatgataagcaaatatcagtatgtgctgaaaatgcctgctgaaactaaaacagagggtgtagagaaatattgttcaggctctcttaaaactgtcgatgacaagctcaaagaggaaacggcaactatttacggagttaaagaaaacagcaagttcgttcatgcagatataaaagacggcggagcgtttatctctgatggttattctcagaagtataacatagaggtcggcgatgaagtgacgctgaaagagtcttacggagataaaaaatacaattttaaggtagagggtatctatgacgatcctgcaactatagcagtttatctgacagacagcgacttcataaagacctttgaacttgaggacgggtattttaatggttatttctccaatacaaagataaaggatatagacgatctgtatattgcgacaactataacgaaagacgacctgacaaaaacatcgcgacagctcatactgtctatgggttctatgataagtatgtttgcgacagcgggtgttataatgttcatgctaattgtttatcttctttcaaaggtcataatagaaaagaacagccagtctatttctatgacaaagatactgggttacaacaacagggaaataaacagcctttatataacgactacgaccatagtcgttatagcctcaatgctgctgactgttcctatagtaaatgtcactttgaagtatatattcaaagttgctttcgctcagtattcaggctggatgccatattatgtgccagcaaaaatatttgttgaagtgccgttgctcggtatcgtttcatatgcggtgatagcatttatccttacaagacgtgtaaagaaagtacctcttgatgaggcactcaaaaatgtagagtaattcttacaaatcattctttcttaattgagctgtgctgtcggtatgtatcggcggcacagtttttttgtgctttttttataactttttttataatcgctaatttggaaaaatgagttaggcaatcgtcgtaaattttattaatatctttactatactttaacatattattaacagcatagtgatacattatatgatatggaattatacgcttttgatgatcaggctctgcttaatgaagagaagaagtgcagagaactgctgtgaatggcagtatgtcattcggtgggaggaaaaatatgagtaaacaaaagaagcctgcaggcggtttgaatattatcattgtgggctgcggaaaagtaggcacgacccttgttgaacagcttgtgaaagagggccacgatatcacgatagtcgacaagaatgcaaagaagatacaggaactcagtagtctttatgacattatgggcatcgtggggaacggtgcaagctttagcgttcagcaggatgccggcatagagaacgccgaccttataattgctgtcacagagtctgatgagcttaacctgctttgttgtacacttgccaagagagtagcgaagtgttcagctatagcaagagtaagaacacctgattacagcaaggagatagtctatctaagagagaagcttggtcttgcaatggtcataaatcctgagcttgaggcctcaagagaagcgtcaagaatactttgtctgccaacagctcttgaggtaaacacctttgcgaatggtcaggcggagcttataaagtataagataccggagggcaatcctcttgtcggtactacgatcgctgagcttagccgcaaaacggcaacaagcctgcttatatgcgttgttgagagagaaggggaaatatatattccatctggcgatttcacaatgaaaaagaatgatgttatctcattttgcacccaaagaaatttttcaagaacgttctttgaggatatcagtgtgaagacaaatcaggtgaagaacacaatgataataggcggtggcaaggcggcttattatcttgcaaaacgtcttattggcatggggatcaacgtcaagataatcgagaatgacagacagcgctgtgaggatctcagcgtgcttttgccaaaggcgataataataaacggtgatggcactgacgaggaacttctgaaggaagagggcatagagtatgcagagtcatttgtggctctcacgggaatagacgaagaaaatatcttgctcactcttcatgccagacaggtgtcaaatgctaagactatcacaaagataaacaggataaacttcaaggacgttataagcagactggaccttggaagcgtagtatatccaagatatatcacctctgaggcgataatagcctacgtccgtgcgaagaacgaatcgggagatagcaatatcgaaacgctgtatcatttgttcgatcatagagtagaagctatcgagttcaaggtggatcaggagtcagaggtcacaggtacaccgcttcaggatcttgatttaaaaagacatttgcttgtggcgttcataaaccgaaacggcaagatcattatccctagcggtcaggatactatagagaggggcgatactgtaatggtcgtcactactcatacgggatttaacgacatcactgatattctgaaatagcggaggaaatatgaacagctcgatcattcgatatattttaggaaacgttatgcgaatggaagcctgctttttgctgctgccttgcatagtgtcgctggtttacggggaaggcgtgggactttattatcttggaacagccattgtgtgccttgcttttggcatggtaatggcttggaaaaagcctaaaaactatgtgttttatctcaaagaaggttgtatagcaacatctctgagctggatagttatgagccttgttgggtgtatgcctttttggataagcggagagataccaagcttcacggatgctatgtttgaaacagtttccggctttacaacaactggtgcttcgatccttaccaatgttgaggcgctttctcatactgcacttttttggcgaagcttcacgcactggataggcggtatgggagttttggttttcctgcttgctatcataccgctgagcggtggctcaaatataaatcttatgagggcggaaagccctggaccatcagtgggcaagcttgttccaaagatgaaatataccgcaaggatactttatataatctattttggcatgaccatattggaattcattttccttattatcggcaaaatgcctgtgtttgacagcatttgtacagccgttggaacggcaggcacgggtggttttggagtcaagaacgacagtttaggaagctattcgccatatttgcagtgggtggtcgccattttcatgatactgtttggcgtgaattttaacgcatactattatattatatacaggcactttaaaaaggcattcaaaatggaggaagtacgatgctattttgctataatcctcattgccgcagctataatattcgcaaatatcctcgatcgctgtgttagcatttttgacgcacttacaaaatcagtatttcaggtggcgtcgctaattacaagtacgggcttttcaagcactgactttaatctgtggcctcagatatgccggacggtgcttgtacttataatgttcataggagcttgcgcaggcagtacgggcggaggtataaaggtatcaagagtgatcgtgcttttcaagacaatgataaaggagcttcactcctatatacacccaaagagcatacgcaaggtaaatcttgacggcaaacctgttgagcatgagatagtgcgttctataaatgtttatatcgtaacattcgtgataatttttgcttcatcagtttttatggtggcatttgatggtaaagatcttgtaacaaactttactgctgtgctgacaaccatcaataacatgggacctggtcttgcagaggtaggtccaacaggcaacttttcaaacttctctgttttttcaaagttcgttttcatgttcgatatgcttgcaggcagattggagcttttccctctgctgatacttttccacccctctgcatggaaagatcttatctctaaaagggcggaagcaagaaaattctgataacataaaaaggacggctcaaaccgtcctttttttcattttacagcctttttgaactgctgttcatatttatgcttggttgctattccgcctcttatatgtctttcacgtttgttttcctcaaggacctcttttacgcttttgaaaagctgaggagagattttcggcagacgttctgtcagatccttatgtactgtggatttgcttatgccaaattcctttgccgcacagcgtaccgtggctctgtgtgccgcaacatattctccaagcagcacacatcgttccttttcggatccattcattgttcacaccccattaaatttttctgtagtaatctatatgctgttccttacctcattattacttgacgttctttcagactttacaaaataattgccgataatcaaataattttatgcaaaatgcttgaaatcacactgggaatgtgctataatgtaagtgtgatagagatactgtcacagaatatgaacgaaacgaggggataagggcaatgaaacttaattttatcggtgcaacacatgaggtaacgggaagctgtacatatatagaagcctgcggaaagagatttctggtggatttcggaatggagcagggcgttgactattttgaaaatgcgaagataccttgtcctcctggaaatatagattttgtattgctgactcatgctcatatagatcattcaggtctgcttccactgttggcggcaggcggctttgctggacagatacacgcaacggaggccacttgtaatttatgtgagataatgctgagagattcagcgcatattcaggagtttgaagcagagtggagaagcagaaagggcaaacgtaagggtacaggcgaagtgtcgccactctatactatggcagacgcagaggcggctattgcttgcctttgcccacacccatacagtgaggtgacggagatatccgaaggcataaaggtacgctttattgacgcaggtcacctgcttggctcatcaagcatcgagatatggctcacagagaacggtgaagaacgtaagatcgtattttcgggagatataggaaaccttgaccagcctcttatcagagatccgcagtatataacggaggcagattatgttgtaatggagtccacatacggtaaccgtcgccatgataagccgaaggactatgcaaagagtcttgcagaggtcattcaaaagacctttgataggggaggaaaccttgttataccgtcatttgcagtgggcagaactcaggaactgctgtattttataaggcatatcaaggcggagaatatggtgacgggtcatggggattttcctgtgtatgtggattctccacttgctatcgaggcaacgcagatattcaataaaaacaaaaattcatgctttgacgaggaagcaatgtcctatgtgaacaagggcataaatcctatcactttcagcggacttaatatcgctgtcacaagtgacgagtcaagagccataaactttatcgacacacctaagataataatttccgcaagcggtatgtgcgaggcgggcagaataaaacaccacctcaagcacaatttgtggaaacctgaaaacaccatactttttgtgggctatcaggctatgaatacccttggaagaagtcttgtggagggtgcaaaaactgcaaagcttttcggcgaggaaatcgttgtcagggctgagatactggtgctgccaggcgtgagcggtcatgctgacgttgacggtctggacaggtggataaaaagctatgaaaagccgcctaagaaagtctttgtcaaccacggcgaggattcagttgccgaggcgtataaggagcatttgcgcaacgatttcgggcttaacgcctttgcaccttacagcggtgcggaacttgaccttataagcggcgagttcaagaatacgacccctataaagatagtcaagaaaacaggtgcgtcgcctaactatcagcgtctgctcagcgctcttgacaggctgacggctttggtaaacaaaagctcaggtcttacgaataaagaccttgcaaagctcactgataccataaataatatctgtgcgaagtggaacgattagcttttgctgcacatataatatgagatacagggcaacactgcacgctttatgtgtggtgttgcctgatgcatacgaaaggaacaaaccacacaatgaaaaagatacacgtcagtgctataaacagaaaggtcagagatgacgaaaagctttttgttgaagagtgcgacagaaaatataatgaaaagctcgttgccattgcagacagcatcgaggagcatcagaaggagaagcctatattgcttttggcaggtccgtcaggggcgggcaagaccacaacagcgttgaaaatagaggaaatacttgacagcagggggatacacacccacactatctctatggacgattattttctgccttctgacagcttcaccgctgttataggagaggacggcaagcctgactatgaatctcctgacagaatagaccgaaagcttctttatgagcatatggaaaagataaacagcggcgaggaagtcgttctgccgaagtttgagttttcagaacaatgcaggcgtgatggagaaagactcagacgaaacaaaaacgacatagttgtttttgagggtatccatgcgctcaatccggaggtcacaggtgcggctgggaattatgcaagatgtatgtacgtcagcgtaagaagcagacttgaattgaaagacggtgagcttctgcatccttgctatatcaggcttatgcgcagacttataagggacggatttttccgtggcagaagtgcagcggaaacactagatatgttcgacagcgttgaggctggcgagaacaagtatataatgccatacaagcacagggctgagttttcagtggatacttttcacgcttatgagcctgccttgtataagaactatcttttggatacactgcgacgtgagagcaggagctataaggattttgaacgctttttgcctatgctaaaagcccttgaggagatagagccggtgatgctcgaaagtgtgcctgtaaattcccttgcaagggagtttgtaggtgagagcagctatagctactaagacgataaaacgccgtcggaaaaggacggcgttttgctatgcttgcttgactttttttataaaaagtagtaaaatgagataaggtaagtacaggtatttttgaaaacgttttccttaacgtgatcattgaataaaaaattagtggggataaaaatgaattttgataatgatttgatgcttttcttccgaacgatatatgaagattcggcggatatggacgaatgcagtgctaaggtgaaaagtgctgtggctgctgtggcagacaagcttgacatcgtcagagcggagcttgcagtgaaaatgcctgcaacaaagctttgtgaagatggtgcagatatgctcatggtgctttatgacagagagaaggacgtgaaaaacgagccttttgaggcaagttttcctttgtttgaaggcggctttataacagtgaccttttattgtggtaattccaatggctttgataacgagcaaaggaatatcgtagagataatcgcaaacactgtttttatccaatttaacagggtaattatgcaggagcttgttactcatgttataaaaacggatatcgaaacaggtgcagcaactttagacgctttgataaatcacgccggtatgcttatagcgcaaaacaggatagaggatttcagtataatctttttcaatatacataacttcaaatatgtaaataaggtattaaattacgaacagggcgacgttgttttgcgtaattatacaaagacaatataccgaaatctttcagatggtgagatgatcacaagacttggcggcgataatttcgttatgcttgtaaagaaagaatcgctcagagaatatattgatatgctcagctttatgaacataaggtatgacgatggcaaagtatcaaaggattttatttttagtgcaaccatcggatattcgtcaactgtgggtataagatatccaagagaagtaatggctcgtgcaagtattgcatattctgctgcaagacgagttggtgcaggtcatgtaatggagtattccgaaaatataaaacaagaactgatgaaaattcagggagtgctgtcaaacttcatggctgggcttatggcaggtgagttcgaggtgtattatcagccaaaggtacgcatcgaaaccaaggagatatttggtgcagaagcccttgtacgttggcatagaaagggaaggttatcaacaccggtggagtttgttccgcttcttacgaatgacggaagcataataaagcttgactactatgtgcttgaagaagtttgcaaatggctgagaaaacgcatagatatgggttttgaacctttgaggatatcagtgaatttttcgaggaagcacctggaagaaaaaaatatgataggtaatatagttgctttgatcgacaaatacgagcttgatcaccagcttatagaaatagagcttacagaaagcgaggattatcagaattttgagcttatcacagagatcgtgaatggtctgagagctaatggtatcgtcacatctatggacgattttggcactggcttttcatcgctcaatatgataaagaacgttgatcttcaggtaataaagatagacaagtcctttattcctcttgaaaaggattatgagggcaaggataaagatcttataatgttctattacattataaaaatggttaaaaagcttggcaaggaaactatcgccgagggagttgaaactgagcagcagcttgactatctcagagaagttggctgtgatgctgttcagggctttgtgtttgacaagcctctgcctgcggctgactttgagaaacgtcttgcctgcggttataactgataaataaaggcgctgtaaaaaaacgcgcaataaaaaaagactgcaaccacccttaaaagggtaggaaagcagtcttttttgtggtataataaatttgatgaaaaaatactccaaatgaaaagctgcaattagttacttaacattattttttgagaagatgtgtcacctatcattgacaactgaacactaaaatttcacactttttcttgatgctacttgaaaaaaggcagtttatgtggtataatggataatgaatgtaaatttgcgtaaaggactatttctatatgaaaaaatggagaataaacagacctgaccctgtgaaaactgcagagtttatgaacaagtgtgacttgaaaagccttaccctagacgtcatgacttcaaggggtttcactgactttgacagccttgctgatttttttaaaggcgaagaacttagtgatccttttcttataaaggatatggctgtagccgccgatgtaataaacaaggcggttgatcagtatgaccttatttgtatttacggtgactatgactgcgatggagttacgtccaccactatactttacaactatcttgaaagcatgggcgcaaacgttatgtactatattcctgagcgtgaggctggatatggcatgaacatggaagctattgaaatgcttgcagaaaagggtgttaagcttatcgtcactgtggataacggtatttctgcggttgaggaagctgagcgtattgctgaacttgatatggaacttgttatcacagatcaccaccaaccgcctgagaagcttccgagggcaagggctatcgttaatccgcatcgtgcagattgtccttcgtcatacaaagaccttgcaggagttggtgtagctttcaagctttgtgctgcacttgacggtggcagttacgacactgttatggaacagtatgccgacatttgtgctatcggtacagttgcggacgttgtgccactcacaggggaaaacagaactattgttaagcgtggtcttgaatatcttgcaaacaccgaaatattgggactaaactatcttatagataaagcaaagcttgatagaaatgctcttgactcaacaggcattgcttttaggattgcccctgttataaacgcttcgggcagatttggctcaccacttacagcggtaaaaacacttctaagcgaagacccagaggacgctgaaaattatgttgacactcttttaaatcttaacgcccagcgcaagcagacggaaacagagataatgacagaaatagtaaaccatataaacgctcaccctgaaactcttgaccatagagtgcttgtgctttcaggcaagggctggcaccacggagttattggcattgtttcttcacgcattttggaattttacggaaagccaaatgttataatctccattgatgatgatggaaacgcacgaggctctgcgagaagcgtaaagggcttcaatatattcaagtgttttcagcattgcggagagctgcttgataaatttggtggacatgagtgtgcaggaggtctgtcgctgaaggctgagaatatcgaaaagttcactcaaatggtgtatgaatacagcgatcctatggagaaatttcctagcgttgagcttatagcggataagcttcttatgccgcaggatatcaaccttgataatgtaaagggtcttgctgcaatggagccttttggtgcagagaactctgctcccgtttttgcaatgcttggagtaagagtagataagataataccgctgtcacagggcaagcatacaaagatcgagttttcatacggaagctatagaggacaggctcttattttctcccttgcacctgaaaaagcttgtttcgcagttggcgataagcttgatatgctcgtggagcttggaataaatgtgttcaataaccgtgagtccatatccataagagttatcgaccatagattgagtggagtaaaacaggaaagatattttgcggcaaaggattgttatgaaaagctcatgcgcggggaacagcttcctgcaagttttataagaaaaataatcccgacaaggcaggagcttattggcgtatataaatacataagtgcagttaagaatattacgttggataatcttttcatgaaaatatcaggcgacagcatgaattattgcaaactgcatatttgcgttgatattttccgtgataagggtcttatcgagttcagacccgcaactatgaaaataagctacgttgtgccgaaacaaaaggtaaatcttgaggactctgaaactcttgttaagctgaatgaaatgcttggaaaggcaggtaactaaaatgtcagataaagagaatattttgcttgatcctgctgaaatggataagatagaaaatatgcctgagataaaaactgttagtgaagaagatcttcctgccgaagctgaggttaaagagcagtttgaagaaaagcctgctcctacggcttctcctgactatatcgatgctgtgcctgaagcttcaaagcctgagcatataggtgagaggtcggtgtgttccattgatgcgcttattcagaaaatacttgatggcgagaggcagtacgatctgtcaaaaatcgtttccgcctatgaacttgctgaaaagtatcatcacaatcagaaaagagagtctggcgagccgtatataacccacccgctgtctgttgcatatattcttttggagcttggcatggatactgatactatttgtgcagcgcttcttcatgacgttgtggaggacactccatgcactcttgaagaattacagaagaattttggctcagacgttgcaatgcttgtaaatggcgttacaaagcttaaaaaggtagaaactttcaccaaagacgagcagaaagccgagaatatcagaaaaatactccttgcaatgagcgaggatattcgtgttattatcataaagcttgcagatagacttcacaatatgcgtactcttaattattgcaaagattcaaaacgcagaactatcgcccatgaaacaatgaacatctatgcaccgatagctcaccgccttggaatacgctcaattaaagatgagtttgaagatcttgctttttactatcttgatccttatgcttatgccgagatagacgagcaaatgcagctcagaaagggcagccgtgaacagcttgttgaaaacatcaagcacaagatacatgacaggcttgaaaaggattttgaccctgttccccttatcgagggtcgagttaaaagcaattatggtatttataaaaaagtgtatcgtgacggcaaggagatagaccagatatatgatcgctatgccgtaagaattatcgtcaatacagttactgagtgctataacgtacttggcataatccacgatatgttcagacctatcccaaacagatttaaggattatatttccacgcctaaggctaatatgtatcaatcgcttcacacaactgttatcggcagagagggaatacctttcgaggttcagataagaacatgggaaatgcacagaacggctgaatatggtatcgccgctcactggaaatataaagagggcgtaaggggtagctcaaaggacgatcagcgccttgcatggataagacagataatcgagtcacagcaggagtcaaacgacgttgaggagatagtaagggctatcaaaaatgaccttgcccctgaggacgtttttgctttcactccaaagggcgatatgataacactgcctgttggctcaactgttatcgactttgcttacgctatccacacacaggtgggtcataagatgtgcggcgcaaaggtagacaagaaaatggtgtcttatgattatcagataaaaacaggcgagataatcgagatacttactaccaacgttgaaggtcatggtccaagccgttcatggcttaatatctgcaagaccaatgaagccaaatccaagatacgttcatggttcaaaaaggaaagacgagaggaaaatatctttgagggcagaaatgctctcgaaagagagttccgcagaaataatataagagtgcccgaggaagaacttgaggactttctcaaaatggatatgcacagacacagttgtgatactcttgatgatttctttgcagccataggttacggtggtgttcagctttcaaaggtgatgcaaaggctgaaatctgagtataataagaaatatggtgaaaaggctcagcctgatacttctgaccttgaaaataagataaagacttccaaaaattccaccggtgttatcgttgacggcatcgacaactgcgctatcaagtttgctcagtgctgtaatccgctcccaggtgacgaaatagtcggctttatcacaaggggtcacggcatatccgtgcataaaaaggattgcgtgaactatctttcgcagaaagatgatcctgaaaatgccgctcgttggataaatgttaagtgggaaagttctgaaaagcatacgggctattttaagtgtactttggatattgtagcagttgacagaataggtctgctggcagacgtttcgtcagcgcttgcaatgatcaatatttttatctatgagtcaacctcaagggaactgaaaaacggcaatgcaatgctttccgtaactgtcagcattgcaggaatggaacagcttaacaatgttataaacaagcttcagaaaataaagaacgttatttctgttgaaagaagcggtaaataagaaaggacagataatgaaaatatttaggctcaaaccattgagtgtttgtgaaacgaacagctatattgttgcaagcgaagaaaataactgcgttcttatcgatgcacctgccgaccctgattatattctcggtgagatagagagtcacggtcttacgcttaaaaagatctttcttacccacggtcattttgaccatatcggtgctgtggctgaccttgtagacaggacaggctgcgaggtgtatatccacattatggataagcctaagcttacagatgacgcaggaatgcttgctaatcttttcagaataagaggacacagaaattacacaggcaaggtcaatgtgtttacagaggacgatatactaaagcttgacgagcttgaatttgacgcgttggaaacgccgggacatacaagcggttctgtttgtttcatatgcggcatgaatatgttttcgggagataccctattttcaagaagtgttggcagaactgatatgcctgatggaagcagcacagcccttatgaagtcgcttatgaaaatagctgaccttggtggaaatctaactgtttatcctggtcacatgaatgtcacgacacttgacgctgagagaaagtataacccatatctcaggcaggctgcggaggctttgaaatgactctgatattcagcggcaacaattataaatatgagcttgagggagtaatgaagctttttatccctgcaacgctctttacccacgttttttctgacagcatagatacagaggacgattatgtgttcgctcagaaaaaggataacgctgacaatgtttgtttgagcgttaaggtgagatatgacggcaagacttgcgaaaaagaggagtttgtgcattttgaaagcgacatggaactttcgctttcaagacttctttttaaggcaatgagcgagataacaggcattgtgccgaaatggggcgttataacgggaataagacctgtgaagcgtgtgaatgatatgctcagtgagggcatgaacaaggcggagatatttaaagccatggagagcagatatctttgcagcgaagaaaagtgcgatattgcatacaaaactgctataacccagaagcctgtccttgatgagcttgaaaaggacagctttagtctttatgtgtcagtgccgttttgtcccacaagatgctcctactgttcttttgtttcgcaatctatcgagggctgtatgaagcttatccctgagtatgtgaacaagctgtgtgaggagatagtttatactgcgaagataacggaaaagcttggtttgaagcttgacaccgtatattttggcggcggcactcctaccacgctcactgctgctcagcttgacagagttatgaaagtcattgcaaacaactttgatatgtcaactgtccgtgaatacactgttgaagcgggaagacctgacaccataactgaagaaaagctgaaggtgcttaaagcaaacggctgtggcagagtatctataaatccacagactttgaatgacagcgttcttgaggctattggcagaaagcacacaactgcacagttttttgacagctttgaccttgcacgaaaagttggttttgactctataaatactgatataatcgcaggtctgccaacagacacagtggagagctttgagaataccattgataagcttatcgagcttgctcctgagaatatcactgtacacacactttccataaagcgtgcggctaggctaaatcacagcggtgacagggaagtgctgaaaaatccagccgataaaatggtagagtatgccacaaaaagacttcttgaaagcggctatctgccttattatctctacagacagaagaatatgcttgaaaatcttgaaaatataggctggacaaagcagggtcacgagagtttgtataatatctatataatggaagaggttcagaccatacttgcaatgggtgcaggtggctcgacaaagcttgttgacaaagagggcggacgtttggagcgtgtgttcaattacaaatttccgctggaatacaataagcattttgagcttatgcttaagcgaaaaaatgagatagaggaattttatgctaaagaaaaatgagattatcaggcttgaaataagcggtatgacaaatgagggcaacggagtaggaaagcacgagggcattgctgttttcgtgccttttactgttattggcgacgttatcgaatgcaggatagtcaaggtctgcaaaacgtattgctatggcattatcgaaaatattgtaagtggttcggttgaaagaacgaagaacgattgccctgtttattcaaggtgtggcggttgttgttttcgtcacatgagctatgaggaagaatgccgtgtaaaagagcagttcataaaggattcatttgagcgtattggtaagctttatcctgaatatgacagctttgagggttgtaaacagcttgttggctatcgcaataaggcacagtaccctgtagcagagcaggacggcagggcagtttgtggattctattcaaggcgttctcataatgtatgcgatcacactgattgtgcattacagcctgctatatttaaagctgtcgctgatgacataatggcttatgtgaacgagcgtaagataaaggcatacaacgaggaaacgggaagcggtctgctcaggcatatttatctcaggcgtggcgaacactcaggtgagataatggtctgtcttgttataactgaccttaaaaagcgtggcgtatttgatgtacttgtgggtgagctttgcaaaaaatatgctgatataaagagtatagttttcaatgagaatagccgaaagaccaactgtatactcggacagaagcttgttactgcgtacggaagcgacacgatacacgataccatgtgtggaaatgatatagagatatcaccgctgtcattttatcaggtaaatacaattcaggcggagcggctttatgaaattgccgcagattatgctcagctgacaggaaatgaaactcttcttgatctttactgcggtgcaggaacgattggtttgtcaatgagcaaaaaggtgaaaaagctcataggtgttgagataatacaatctgcattagacaatgcaaaacgaaatgccgcagcgaacaatgtcacaaatgcggaatttatatgtggtgacgcaggaaagatagcagagatactttacagccgtggcgaacgaccagatgtgataatagctgaccctgcaagaaagggctgcacgagggacgcactggagtacatggccaaaatgtcccctgacaggatagttatgatatcttgcaatcacgctactgctgctagggactgtgctgtgctggaagagttggggtataagacggtcaaggtcaagggcgtggatctgtttgggaggacgggacatgttgagacggtctgtttgctgtcaaaaaaataaaatcaagtgctgaaaagtggcgtatttccgggctttttgtaaggttggtatcatcagagaagccttgcggaaagctcggttttattatatggaaacatatctactgcaaaatgtgtgtcaggttgtaacctcggattagatgtcgcaatttgagacagtggattagatgtcaggcattttgggatgatttttggaaaatgaaaaagggtgacaaccaatccggcaggactgactcctatagaaatcggtcagggagtaacctataaagaggcaaaattaacatttctttgcaagaagttgtatcagctcaattttccaaaaaggatattacaactgaagttcaggagtattatgcttccatgccaaaagtatatcccgatttcaatggaggctggcaaccacatattgtttttgtagatgaaattatagtggttagggatgagcgataaattgggatttagaggatgtgaatgagcagcatgaagaaaataaaagaaggaattaatttaaaaaaactccttaggctgaagaatacaggcagtatctttgtgattgcggggcttttgacgatttttgtaatagcgttgtacacatttattctgcaaagttcttacactaagaccgcacttgaaacagaaatcacacgtgacacagcgagtgcagatgcagtgcacaaactcgtggatggaaaaatcggcaaagaagattttgatcaaatcaaagatcaatctgatgaaacgaagcaattatataaggatatttcttcatatttcaatgaaatcagaacactgaattctactcgatatatttacaccgctacaaaaaatgaagaaggaaaactcgtttatgtggtagacggtttggattcggatgcggatgatgtaagacaccctggagattatattgaggaagaaatggttccgtatattgatagggctatttctggggagaatgtgtactctcaggatatcattgatacaacatggggtccgatttttacggcttgctatcctgtaagagcaaatcatgatgggactggagaaatcattggcgcattttgcattgaaatggatatgcaatcagcttatggaatggttgaagagacgaatcatatttccatcatatgcggtttagtcgcaggagctgtattgcttttaatttgtctatatacctattatgtttatcagaaaagcaaggcagaagagcaaaaacaaaaacaattattaatgaccgccgctgaggaagcagatgctgccaacaaagcaaaatctgcgtttttgcttagtattagccatgacatcagaacgccgatgaatgccattattggatttacaaacattgcgcttcaccagaacacggtttcagatattcatgatagcttggagaaagttcaaaaaagttcgaatcatcttctctctttgttgaatgacgttctggattttactcgcattgaaagtggaaaagttactatttcgcccgagccggtggacattactcaattgacagataacgtccaggcgattatgaatggacttctttataatcgagatcttaagtttgaagtgcatcgagaaatcccaaagaacccatatgtccttgcggatgttgcgcgtatccgggaagttttggtgaatcttcttggcaatgctgtgaaattcacaaaggacggcggaaagattactttggatatcagcagttacccaggagctgatgagaaacatatcataactcgttatgttgttcgagataacggtattggcatgagcgaagagttccagaaaaaattatttgatccgttttcacaagaagatgatgctaatgccagaactcaatataagggaaccggtcttggtatggccatcacaaaaaaatatgtggatatgatgggcggttcgattgctgttgagagcaaaaaaggtgtaggttctacattcacagtggagatcccactggagttgtcagaacaggttattcaatcagaacaaaaacaacatctacatagagatttgacgggtattcatgttcttatggctgaggataatgatctaaatgctgaacttgctacgatgatactggaagatgctggtacgaccgtaacacgcgcatcagacggaaaagaagttgtggatttgtttaaaaatcatccacgaggcacatacgatcttattttgatggatattatgatgccaaacatggatggacaccaagcagcaaaagccattcgagccttaggtataaagcggtcagatgcagttacgattccaattatagctttgtctgcaaatgcttttatagatgatattcaggaatccctggattcaggcatgaatgaccatatttccaagccgattaacatggaggaattaatcgatactatcactaaatacattaaacacgattaggaaaacaaagaagttaattcagcttttcctgtaccttttcaaaatcttctctgctgattatggaagatctggaacaaaatgcgtgctactgatcctgaatatgcacttgcgatgaaaaatgctgataccgctaaggtttggcagcttgaaaatctcttcgagctgcaggctgaggagattgcaattcagacgtgtttggtaatgtagccattccttatttcttatcaaaaatcaacaaaactcgtttggtttagttttagccaaacgagttttgttttttactccctgagattttctttgagttttacttttcgatattcttttggtgacataccaatgtatttatgaaacagtctgctgaaataaagcgaattggtgtatccaaccatatttgcaatttcagtaatggtgtagtctgtattttctaacaaattttgtgcgttggagattcgcagctttaagatatattgcagcggactggaacctgtgatttctttaaagcactgaataaaccaacagttgctaagccctctggattcggagtactcctcaatgctgatttctgtgttgtaattcttacgaaaatagtgcatcgcaaaagcaacttctttttcactggtgctgctgaatttctttgcactcatgattgcacggcttatcaaaacaaaaatatttcgcagctgcaaagaaatcaattcatcataccatggtctgcaaagctgcaattcctggatcatctgaccaaataaccactgataatcgggagatgttccaatatagagaatattatttttcaggttgatattgtaataatttaaaatttcttctacttcatttccggtaaaatgcacccaataaacatcggtttgatctgcacgataataaacatattcctgtggttgatccggcaaatatataataatatttccggctgaaaccgttttttcttctccgtgaatgaaaaaatgtccttttccggaggcaatatataaaagctgataatcttttcttcccttcggacgatgtgttactacttcagaacgatttttcacacgataatttccacagcttgttacaatcaaaggtttcgtattatccactacagtagatgtagagttgttcaaataggcaacattcataaacataaaaagcacctccttgcttctataactatagtatatcacacctgagcactgattacaagaaaaatcctaaactttgtgcatatattttataactttgtgtattttttaagccgctttgtgtggtataatggagttaagaaatgagaggaaagaattaaaaaagacgtctttcattgtaattccatgttgaattcagtaaaaattctttatgctcaaaaaaataatcatctattctgacgatggcattatttcgtttttgcaagatgaaaagcagttcgtatcattcgttatgggaaaattctgtccatgtgggcatacaaacaatgaaaggagctctattatgagcaaagaaaaaacatacttaaagtggtataacaaagtcggttatggttccggcgatgttgcaggaaacgttgtctatgcattgctgacatcattcgtaatgatctatcttaccgacacgattggattaaacgcaggtgttattggcgttctcattgctgtatcgaagatttttgatggaataacagacatcatttttggtacgttgattgataagacacatacgaaaatgggcaaggcaaaaccgtggatgctttatggttttatcggctgtgcaattaccttgattggtgtatttgcaatcccgatgaacatggataattttgctcagtacgcatggttctttatctgctacacacttcttaacagtgtattttatacggcaaacaacatcgcatattctgctctgaccgctcttgttacaaagaacagcaaggaaagagttcagatgggttcgtatcgctttatcttcgcatttggaacaagcctcctgattcaggctgttacattccaatttgttgaagcaatgggcggcggtgcaaatggctggagaacagtcgcaattatttatgcggttatcggtcttattgtaaatacaatttcagctctttctgtaaaggaactttctgatgaggaacttgcagacagtgaaacaaaaatagaagaaaccaaatacagttttggcgaagcattcaaaattctcgtacacaacaaatattatgtgatgatcacagtaacctacattttgcagcagttctatggtgcaatgatcggtgttggaacatactatgcaaaatatattctcgcagatgagaatatgttcggcacatttgcgtggtttatcaatattcctttgattatcgccttgatcttcactcctaccatcgtacaaaaatggaacggaatgtataagctgaacaaatacagctacatggtagcaacagttggcagacttctggtagcagttgccggatacatgggaaacattccgctgatgcttgcatttacagcacttgcagcactcggtcaaggtccatggcaaggtgatatgaatgcagtcatcgcatcatgctctgaatatagctggcttaccaaacacaagcacgttgatggaatcatgtactcctgcacatcacttggtgtaaaaattggtggtggacttggaacagcaattgtcggtcttttgctcgactttagcggattcaagggcactttgacattacagcctgattctgctatcaatatgcttcacattatgtatctgatcgttccgtttgcactggatctgatcatcacatttattctttctaagatgaatgttgaaaaggcaaatgcggaaatcaaagaaaaacttggaatatccgaaaatgaagttgtgatggaatcacagaactaaaatggaggaaacaatatgaaatatacactcgactggctgaccgatccggaagtgtttgcagtcaacaaaatcgcagcacattccgaccacagaatctatgcaaaccatttggaagccgatgcagacaattcctctctgattcagaatctgaacggcacctggaaatttgcgtgggcaaagaatccgtctgaatggcagcaaaagttctatgaagaaagcgacagcactgacaattttgacaacattcaggttccgggacacatggaattgcagggatacggcaaaccgcagtacgtcaataccatttatccttgggagggacaggagcatctccgtccgccgtttatctctgaaaaggacaaccctgtcggcagctacgtcagatattttgacttgaacgatgctctgaaaaacaagcgtgtatttatttcttttcagggtgtggaaactgctatgtatgtctggctgaacggcgaatttatcggctacagcgaagattcttttacaccgtctgaatttgaactgacaccatatatccgtgaaaaggacaacaaacttgctgttgcagtgttcaaaagaagttctgcaagctggctggaagatcaggatttctggagattctccggcattttccgtgacgtattcctttatgcggcaccgtctgcccatgttcgtgatatgagagtgattgcagattatgacggtacaaatggtatcttctctgcaacgctggatattgcgggcaagtgttctgtgaaatcgatcctgacagatgaaaatggaacggtcatcgcacaatccaatgaaaaggaatctgtaaactggacaattgaaaatagcaagccttggagtgccgaaataccgaatctctatacgtttacagtgattctgacagacgaagacggaaatgaaatcgaggtcagcagaaccaaagtcggattccgtcgatttgaactgaaaaacgggatcatgtgtttaaacggaaaacgtatcattttcaagggcatcaatcgacacgaatttgatgcgaaaacaggcagagcaatcacaaaggaagatatgctgtttgatatccagttcatgaagaaaaacaatatcaatgcagttcgtacatgtcattatccgaacaattctctttggtatcagctttgtgatgcatacggcatttatctgattgatgaaaccaatctggaaacacacggtacatggcagaagcttggtgcaacagatccgtcttggaatgtaccgggttcacttccggaatggaaagaagctgtactggacagagcaaaatcaatgtatgaacgtgacaagaatcacgcaagtgtcctcatctggtcttgcggaaatgaatcatactgcggagaagatattgctgcaatgtcggaatatttcagaagtgtagacccgacaagactggtgcactatgagggtgttacaagagttccgaatcatcagtatgattctatcacggatatggaaagccgtatgtacgcaaaaccgcaggaagtggaagaatacctgaaacagaataacggcagaccgtatatcagctgtgagtatatgcacgctatgggcaattctcttggcggtttgagcctttacactgaccttgaggacaaatatgaggcttatcagggtggtttcatctgggactacatcgatcaggcaatcgaaacccaaaatgacgacggggaaacagttctggcttatggcggagattttgaggacagaccaagcgattacgaattctgcaccaacggtgtgatctatgctgacagaacctactctccaaaggttcaggaaatgaaggctctttactccaacatcagaatgtctattcaaaacggaatgcttaccgtagaaaaccgaaatctctttgcagatacaaacaacttgtcctttgttgtacgattggaaaagaacggcgttgttctgaaatccgatactttttctctgaatgttcctgccggagaaagcaagacaatgaaactgacgcttcacaaaatagacagtgcaggagaatatgtttatcatgtttccgccgttaccgcaaatcagacactatgggcagatgcagggcacgaaattgcctttgctcaggaagtgtttgaagtgaaagatgatcagatcccggaaaccacattgcaaaagccagcaattgtatacggcgatgttatcattggcgttcacggagaaaacttctccatgatgttcgacaaaaaagagggcggcatcagttctctgaaatacaatggttttgaatatatcacacgcacaccaaaggtcagcttctggagagcaatgacggataatgacaccggtgcttccgagccgtacaatcttgcacagtggcatgtcgcaggcaaatttgcaaagtataaaaccgtttcatggctggaacaggaagatgctctgaaaatcactttcacatatcaggctgcctgcattccgacttttgagtttactgtaacctataccgcacactttgacggaaagctgggcgtaagtgtaaattatgcaggagtaagcggtatgtccgatatgccggttcttgcattggacttcaagatgaaaaaacagctttgcaattttcagtattacggactcggtcctgatgaaaattacagtgaccgatgcaaaggagcaagactgggatcgtggaaatctacggcaaaagaaaatctttccgggtatctcaatccgcaggaatgcggcaaccgtaccggtgtaagaacgctctctgtccatgatgatatgcagcatggtctgacgttccaaaaggcatctgctccgtttgaaatgagcgtactgccatacagtgcctatgaactcgaaaacgcaatgcatctggatgaacttccaagtgttcgctacacatgggtcagaatcgctgcaaagcaaatgggtgtcggcggcgatgattcctggggtgcaccggtgcatgaggagtacaggatccatgcagatcagccgatgaaattggaatttgtaattatgcccttaagatcgtaagaagaaaggaaagcaatgaaaatacaggattttcaatacaatgttacttgtggtggatttgataatatcttcgcaaatatttataagccacaggatatagaaagtcagaaatcacgatatatgagtgctgtggagaaattcacagcactgtatccgaatagaaatgatatacacgtttattctgctccgggtagaacagaaatcggcggtaatcataccgatcatcaacatggctgtgtcattgcaggagcagttgacttagatgttatcggtgttgcagcatttcatgatgaaaacatcatcagaattaaatcagagggatacgatgaatttgcagtttcacttgacgatttggatgttcatatgggtgaaaaaggttcttctgaaattgtcagagggattgcagctcgctttaaggatttaggtgtagaaatttccggatttgatttgtatacaacttcaaacgtacttggtggaagcggtatttcttcttctgctgcatttgaaacattgattgcgacggcaattgacagctattacaataacaatcagatcggtgcagtagaaatcgcaaaaatcggacaatatgcagaaaacttttattttggcaagaaaagcggattgatggatcagatggtttgctccgttggtggatttgtttttcttgattttcaaaacattcaaaatccaagtatccaaaaaattgattttgacctttcaaaaactggctatgcattgatcataacagacaccaaaggagatcattctgatttgacagatgattatgtagccgttcgtacagaaatggacgaagttgcagaatatttcggcaaaaaggttcttcgtgaagttgatgaaaatcaattttgggataatctccctgatattaaaaagaagatttctgacagagctgtcttgcgtgcaattcacttttttggcgacaattatcgtgcaaaggcagaaacggaagctctcaaaaacaacagatttgaggattttctcacgcttgtaaacgaatcgggagattcctccatgaactatctgcaaaatttatactcatgcagaaagccaacggaacaaggtattccaattgcaattatggtggggaaacgaatattaaaaggaaatggtgctgtaagagttcacggaggtggtttcgcagggactgttcaggcatttgtaccaaatgatcttgtcaatgcatatagatcggaaatggacagaatatttggacaaaattcgtgctatattatgacaatcagaccgtttggcggtattgaaatcaaataataggagggaaaaataatgagtatacttgttttaggcggtgcaggatatatcggttctcacacagctctagagttgattcgcaccggagaaagcgttattattgcagacaatcttgcaaccggacacatcgaagctgtataatgtcccccttgtcaagacacaaatgaaaaaaattatcgtgacagcgaaaactttgtatagccatccaaaaaagtattttttcatcaaatttattataccacaaaaaagactgctttcctacccttttaagggtggttgcagtctttttttattgcgcgtttttttacagcccctttgtttgtgtcttacgaaacgagaggggggcgaattgcgggcgaacgctgttcgcccctactttttgctattctatcacaagttcctcttttgtggaatccgttccctcgatatggaaagaattgagcacaggctcatctctgttcataagtgagagtatcatatagcttgctgtcttgtcataagcaagccttttatcctcatcagaaggacgagaaggtgactcagggtgtgagtgccagttgcccagaggaacaagtccctctgccctcatgtccttgatagcagcaagctgctccttagggtcaagagaaaaatgctcgtttgagtgttctatgttcgtgagaagatagaccttttttattatcttgtcactgccctcttttactccgccgataagaccgcaggcttcgttcggaagctcgctttcagcgtggtgcagtatcttttcataatcgcttttgctgagttttatcatagatgtacaccgtcacattctgcctgttcatagtcgataagctctgtgatagtagggtgctcgccgcatactgcacagccctttgtatcctgtgggagctttacctttctgaactccattttaagtgcgtcataagtaagcagatagcctgtgagaagctctcctacgccaaggatatacttgatagcttccattgcctgcaaacttccgataacgccgcccattgcaccgataacgcctgcctgcttgcaagtaggaacagcgtccttcggaggtgggttcttgaacacacatctatagcatggtccctgaccgggaacataggtcatgagctgacccttaaatctgatgatgccggcgtgtgaaaatggttttttagccattacgcaggcgtcattaataaggaactttgcagggaaattatcagtgccgtcgataacgaaatcatagtccttgattatatccatgatgttctcgctgtcgataaaggtgcggtatgtattcaccttgacgtcagggttgatagcttccattgtttcctttgcggaaagaacctttgccttgccaacgtcctgagttgtgtggattatctgtctttgcagatttgagagatctacctcgtctgcgtctgcaatgccgatagtgccaacacctgctgcggcaagatacatagcggcaggtgcgccaagtccgcctgcgcctatgataagaacctttgcgttaagaagctttttctgtccctttgcgccaacctctttaagaatgatgtggcgtgagtaacgctcgagctgttcgtctgtaaatgccattactgtccgcctcccatgaagtaaagaaattctacaacgtcgccgtctttaagaactgtgctttcaaaagcaccgctctctacaaattcgtcattgatagttactgtaacgtactgtggtgtttcaacgttctcgtcgataacgagctgtgccactgtaagtccctctgcaacgtcctttttattgcctgctactgttatagtcatatctatttctccttaatctatagaatttattgtttcggcaagctgtgctttctttacagctcccgtaagtcttgctttttctgctccgtccttgaagaacacaagtgtcggaacgcttgtgacattatatttctgagcagtttccccgtcaaagttgatgttgagtttcacaagctttatgccctcagggttctcctcctcagtttccgcaagaagcggtgacattcgcttacacggaacgcaggaatctgaatagaaatctgcgataacaagctttcctgcctcgtttatctcgctctcgaaagtatccttatttgctcttactgacattaatctcccaccttttgtacgataaggtcataagtgccgtcctcattatcaatgagcttcaatatcttgtgaccctcttccttaatgcttcttggaacgttctgaacaggctcgccgtcattcattttaatggaaaggatctgcccgtcgtcaagctcctcaagagctacttttgccttgacaaatgttgtcgggcaaaccactgtggtgatgtccactgtatcgtctattttaaaatcagccattgttataaacctccagtatagtatttgtaaatttctctctgcccactctgtcgatagtgaacttaaatctttcgccagcttttgcgttatcgtcaaagaactgtatagcggtatcgcaaatcttcataagagtttccttatcctctataaatgggataacagtttcgcccttgttgatatggttgccgaaaagtccgccgaatgaaactatatagccgtggatagtatcccacgcctctgttggacaggctttaaagcagcgtccgcagaagttgcacttctctttgtcaaggactatctttccgtcctccattgtaagcgcgccctgacggcaagcctttacacacacgccacagccgatacaatcagcttcacgccattcgacttttatgccgcccttgataccaacgtcattttcttccgctttaaggcagttattctgacagcctgtgatgccgaacttgaacttgtgaggaagctcccttgcgaaatatctttcgtcaagcttctttgcaagagcgtatgtatctatacagccgcttggacagaccgcagcaccctgacaggctgtgatagttcttactctcggtccgcaaacgcccggttctgtgtcgccctttgcaagagccgcctttacctcgtcgatatcgtcaagctttataaaaggtatctcgacgctctgacgtgatgtaagatgaacatagccctcgccgtatttatctgacacctcagctatcgttgcaagctgttttgccgtaaggtttccgcccacaactctaagtctaagtgaaaaattattcttctgcttctggcgcatgaaaccgccttttttaagtgttgcgtagtcaactgccatagtaaattcctcctaaagtttttctatggactgtttaaagtcctcgatcagatccgatgcgtcctctattccgacgcttatcctgattgtgtcgccgaacacgcctgcgtttatcttctgctcctcgcttccgtgagcgtagatcgtacttgcagggtgtataacgagcgttcttgtatctccgatattagttgcattagttgcaagcttcaagccgtttataagcttgaacgctctttcctttgagcctgctcttatggtgagtatagcaccgcccttgccgccaagctctttttgacaaaggtcatagaacggactggctttcagtgcaggatagttcacttcaatgccctcacaactttcaaagaactctgcgagttccaaagcattgtggcaacatcgctccattctaagacccagtgtttcaagtcccacgctgttcataaatgcgttcattggagcaagacagccgcccacgtttctccatatgccgtttctcagctttgcgatataagcaaacttcccgaatttcttatattctgccagccccttgaacttatcataatcccatttgaaattgccgctgtcgattataacgccgcttatggaatttcctccgccgtttatatactttgacgtggaatgtaccacgatatcagcaccgtagtcaaatggatttataagataaggtgtagccgttgtactgtcaaggataaacactgcaccgttttcatgggcaaggtcagccaccgactttatatcaactatttcaagattagggtttccgataagctcggcaaagaccgctttggtcttactatttataataggggctatttcctcttttgtaacgtgctttacgaacttggtcttgataccgaatgccgcaaggtcgccgaaaaggtcaatagtgccgccgaaaagacctgcgccgcatattatctcgtcccctgcctcaagaatattcagaagcgacattgtaacagccgccatgcctgatgaacacgccactgcgccaacacctttttcaagtgtattcattcggttctcaaaagccgccactgtcggattgcttattcttgtgtaagcatatcccggtgctttattattgaatactttttcaagctgctcagccgactcctgcgcaaaggcactcacctgatatatcggagtgagcgttgagcctgttgttttctcaggttcaaatccgccgtggagcaattttgtattgaatttcaaaggaaacgccccctgtttttcattttattatataaccgcaagcctgccaaggtgcgatgttctttgttactgtagatattatacaacataaatcatataaagtcaataggattactatagatttaacatttcttttaaattatgcccttatttttatgaaaactcttgacagtttgctcaaaaaggtataaaatatattatgttgataggattactatgaataataggacaagtataaaaagcatgagaaatgataagattgtcatttctagggaggtgcagaaatgaaaatttcaacaaaagtagaatgtggcataattgccattgcagacattgcaatgaactcagaaaacggcgaaacagtgacagtatacagcgtggcagaaagacgtggactttcaggaaaatatcttgagcaggtgcttacttctctgaggcaggcaaggctcataaaaggcataaaaggctctaggggcggatatatactcaacaaaaagccagagaagataacactcaaagaaataatcgacgctctcgacccatcggtgcttggaagcgatgttgcggtagtaaatgacgaaaacacagaatttgcacaggtgcttgacgattatatatggctgagattagagaacaagctgaaaagctacactgagtctatcaccctcagacagctcgttgacttctataataaagagtcagcagagaacgtttcagagcctatgtattatatctgattgacaaaagtcggttttcattttataattagggacagagagtgtatactatatataaaggatgtgtttttatgtatgacgttataataataggcagtggtcctgcggggcttactgcggcgatatatgcaggcagagcaatgctttccgcactggtgtgcgaaaaggactacatgggtacaggtcagatatctgttacagacagagttgagaactatccgggtctttacggcataaacggctatgaccttggagaaaagttcagagagcaggctgaaactcttggtgctgaattttacgagggcgaagctgaaagctttgagaaaacagccgagggctggaaggtcatattcaaggacggctctgtaaaagaaggaaaaactgttatctacaccgcaggcacttcatatcgtcatcttgacgtggcaggcggtgagaaacagcgcatttcttactgcgcagtgtgcgacggcttcttctataaggataaagttgtggctgttgtgggcggaggagatactgcacttggtgacgcactttatctttccaagcttgcaaaaactgtttaccttatccacagacgtgacgagttcagagcaaataaagctttgcagaaaaaggtcgctgaaacagataatatcgtgcctgttatgagtgcagttataaaagaggtaacaggtggcgagaacgctgagggcatcgtatatattcaaaacgacgaggaaaagaacattgccgtggacggagtgttctgcgcgatcggaagcgtgccgaatacacaagctttagagggcgtttgcgagcttgacgaaagcggatatgtgaaagctggcgaggacggaatcaccactgcaaagggtctttttgtggcaggagatgtccgtactacacctctcagacaggtaataacagcagcggcggacggtgcaaacgcactttcttctgcggaaaaatatataatggagctgtaaaaagcaaaacaaagcggtgtcggagcgtaaaactctgcaccgctttttctattctatagcacaaaaaaggacgctgtcaccaacgccccaaattgcttttatatattcacgctttccttttcaagcaggctgtctataaacctctgcacaggctcaggagtttcatactgggaagccgtcaccgcacatatgctccttggaggtatctgctcttttgtgtttaccctgaagatgttccctgcctctatctccgccttggtggtcgcatactgcatgaagcctatgccaagattgttctttaccatcggcattacaaagtttatggacgtaagctcaatatcaggtcgcaaaagcaggttgtgctgtctgaatatatggtcaagatagtttcgggtggtggtggtgtttttaagacagataagaggatatttcacgagctcatgcagggatatctccttgtctttaagataggaaaaaccgtttcctgcggcaacgatatcctgaagcttctttatcacatttatgttaagccccgttttgtctgcaaacggcgaggtaactaccgccacgtctattagatttgccctcaacgcttctatagcgtcaggggtggacatactgtctatctttatctgtatcttcgggtgttctctgtgaaactctactattcggtcgataagaaagctttgcagtgccacctcgcttcctccaagccttactatcgccctgtcacgctcgcttatcagcgcaagctcctcctctgccgagaatatatgcttgcaggctatggatatatgcttaaagagcatctctccgcccgttgttagctctacacccttttttgaccgcacaaaaagcttgcacccaagctcgtcctcaagattttttacgcatcggcttatgctcggctgggacaaaaacagatagttcgccgccattgttatgttctggaactttgccacataatagaatatcttataatgctcgaaatttatctctctcataaaccgttcctctcctctctatccatacactatgagtatgtttacaatagaaaatatctatttgacatatgcttatgattgtattataatatattcgtagacaaaaagcaagtcttacatcactgcgcccatagggggacgcatacaaaaaatagttttatcatgataaaatcaatgacgattgcattcgaccgctgggggggtaaacggtaaagaccttattatacccttatgaggctggcattcttattggttttatttttttggaggtgataaaatgctggagagaatttccgaaaatctttccgaggctatgcaaaacaaagtagctttcaggataccgattttcggaggcatacccgttcctgtgtcctgcgtggtaacatggataataatggcgatacttgtgatagcttcaatacttctcacaagaaaccttaaacttatccctgacaggaaacagatgatgcttgaatcattcgtaggctttctcagagatttcttcagagaacagcttggagaaaagggtatggcgtattttccgttccttgcaactgtcattatctacataggctttgcgaacatcatcggtttgctgggctttacaccgcctacaaaagacttgaatgttaccgcaggacttgcgatcatgagcattgtgcttgtggaggttgcaggaataagagcaaaaggaacaaagggctggctgaaaagctttgccaaacctgtggcgataatcgctccgctgaatgtaatggagcttgttatcagaccgctgtcgctttgtatgcgacttttcggaaacgtgcttgcgtcttatatcatcatggagcttatcgacgccgtttgcccgatagtgataccgctggcattctcggcatactttgatattttcgacggcttcattcaggcatatgttttcgtgttcctcacgtccctgttcataaatgaagcaatagaggacgacgactaagataacagaaattcggaggtatgatctatgttagtagcaataggtgcggctgtagccgttattacaggaataggagcaggtatcggaatcggtcttgcaacaggaaaagcaacagagtctatcgcaagacagcctgaggctaaaaaggatataagaagctcactgcttctcggctgcgcacttgcagaggcaacagctatctacggtcttatcgtagctatccttatcatcttcttcctgaagtaagagaataagcgtagaaaagtaaaagaataaaaacggaggtatatatcatgttagtagcaataggtgcggctgtagccgttattacaggtataggcgcaggtatcggaatcggtcttgcaacaggaaaggcaacagagtctatcgcaagacagcctgaagctaaaaaggatataagaagctcgctgcttctcggctgcgcacttgcagaggcgaccgctatttacggtcttatcgtagctatccttatcatcttcttcctgaagtaataaaacaaaacatctttatgaaaggagcatagctatgataagtcttgatataagtttggtatgggtaataataaatctgctggtactgtatctgctccttaaaaagtttcttttcaagcccgtgtgcaaaatgatggacgagaggtctgcaaagatacaaagcgaccttgacggtgcggcacaggctaaggcggacgctgaaaaaataaaagctgactatgaagctgagatagccgacgcacacagtcaggctgttgagataacaaacaaggctaaagcacaggcaggcagagaatgcgaccttatgcttgaaaatgcaagagccgagtctgctaagataatgaaagaagctgaaaagtccattgcaaacgaaaaggaaaaggctatggacgacgcaaaataccagatcgcagaccttgctatactggcggctgctaaggtcattaagaaaaatgtgggaggcgactccgacagagaaactgttgatgaatttctctccgaggtaggtgctgccaaatgatcttttatcccgaggaagtctgcggcagagtgctttttgagctttcgccaaaggctgagagcgtaaaggcttcaagagagctttttgaaagctgtgacgagcttaaggacgctcttgcaagccctgctgtggaaataaaggaaaaggagaaagttatagacaggctttttcctgaggacatgagaaactttctgaaagttatgtgtcagtggggtcacatggataacatcatggacatttttgacgcatatgacgatgaagtcctcaaaagcaaaaatatacttaaagctgagctttactgcgtctgcccgcctgaaaaggcacagacggataaaataaaagaaacgctgaaaaagaaatacggcgtgagcgatgttctgctggaagtgaataccgacgaagccctcatgggcggctatcgtcttgaagtgaacggggtcgagtatgacaagagcgttcagggtatgataaaagctttgcagaacaggatatcagggaggtgaacggcttggcaggttcaagcagaagcgatattatctcggtgcttaaaagtgagatagctgactttgaggcgaaaactcaggtcaacgaaacaggcaggataatatccataaatgacggtatcgtaaatatttacggtcttaatcatgcaatgtatggtgagcttgttgaatttgaaacaggcgttaaaggaatagttcagaatgtggagagaaaaactctcggctgcgttcttcttggctctgaccatggtcttacggaaggttcaaaggtagtcagaacaaagaaaagggcaggtgtcggagttggcgaaaagcttctgggcagagttgttgacgctctgggcgctcctatcgacggcatgggcgagatagagtatgacgattattaccctatcgaacgtgaagccgcaggcgtttgcgacagaaagtctgttacagtgcctctggaaacaggtatactttctatcgactcaatgttccctatcggcagaggtcagcgtgaacttatcataggcgaccgtcagacaggtaaaacttccattgctcttgataccattcttaaccaaaagggcaaggatatgatatgcgtatatgtggctatcggacaaaaagcttccacagtcgcaaagttcgttgaggatctgaaaaagcatggtgctatggattacaccatagttgtaacagctatggccagcgaccttgcgcctttgcagtacatatgcccatacgcaggcacagcaatggctgaatatttcatggataagggcaaggacgttcttatagtatacgatgacctttcaaagcacgcagttgcatacagagcaatgagcctgcttctgaaacgttctccgggacgtgaggcttatcctggagatgtattctatcttcattcaagactgctggagcgttcatgcagacttgacgacgctcacggcggcggttctatcactgccctgcctataatcgaaacacaggcgggcgacgtttccgcatatatccctacaaacgttatttctatcacagacggacagatcttccttgaaacagagctgttcttctcaggcgtaagacctgctgtaaacgttggtctttcagtatcccgtgtaggcggtgcggcacagaccaagatagtaaagaaagtatcaggcaatctgcgtatcgaccttgcacagttcagagaaatggaagtgttcacacagttcagctctgagcttgataagacaacccaggagcttctcgaccatggtcacaggctcgttgagatacttaaacagccgctctatcacccttattcaatgcacgaggaggtcattatcctctgctgtgcacagcacaagcttttgcttgacgtgcctgttaaggagataagaaaattcactctcgatatgctttcctactttgaggcaaatcacagcgatatcattgccgagataaatgacaagaaggtcatgacagacgagcttgacgcaaagatagttgctgccgcaaaggaatttaagcagggcagataaaggctctgcaccgaaaggaggcataaggcatggcaggaatgagagagataagagaaaggatcgcaagcgtaagcgagatcatgaagatcacaaacgctatgtaccttatctcttcctcaaatctgaaaaaagccaagaaaaggcttgaaaacaccgagccttactttgaaaagctccaatctaccattcaccacatactgctccacacacctgagttcgagcacaagtatttcgaccagcgtgaggagaaaaagcctgaggacaaaatgataggctacatagtggtaacagccgacaagggtctggcaggagcttataaccacaacgttttaaagcttgcagagcaggaaatggctaagcacaagaacacctgccttttcgttgtgggacagatcggaagacattatttttcaagaaagaacgtgaccatcgacgctgagttcctttacacggctcagaaccctaccctttacagggcgagggatatcgccgaaactatcacagatctttttgaaagaaaatatcttgacgaggtttatgttatttacaccaagatgataaattccatggatatggagcctgagatgctcaagctttttccgctggagcgtgaggactttgaacaccctctgcaaaagcaggatcacgatatcgtaacgttcagaccaagtcctgaaaaggtaatggatcatcttgtgccgaactacatgaaaggtcttatattcggcgttttggtagaggcgttctctagtgagcagaatgccagaatgaccgccatgagcggtgctaccacaagtgcttcggagatgataaaggagctgtcattgcagtataaccgagcaagacaggcggctatcacacaggagataaccgagatcgtcagcggagcaaatgctcaaaaggacgagagttaaggctttcgggaaaggtgttgagattaaaatggaaaaaggaaagatcgttgaaataatgggacctgtcgttgacgttgaatttgaaaacggcaagctacctatgataaaggacgctcttactgtacagcttgacggcaagacaaaggtcatggaagtggctcagcaacttggcaacaacactgtcagagctatcatgcttgcttcaagcgacggacttgaaaaggatatggaggtcactgccacaggcgcttgcataaaagttcctgtaggcgacgctacccttggaagaatgttcaatgtccttggtgagagcattgacggcggcgagcctgtcaaggctgatgattattgggagatacacagagagccgccaaaatttgaagatcagaagcctgcaacagagatccttgaaacaggcataaaggtaatagaccttcttgcaccatatgcaaagggcggtaaaataggtctgttcggcggtgcgggcgttggtaaaactgtgcttattcaggagcttatcacaaacgttgccacagagcatggcggatattccatattcacaggcgttggagagcgttcaagagagggcaatgacctctggcacgaaatgacagactcaggcgttatcaaaaagacagccctagtgttcggtcagatgaacgagccaccaggatcaagaatgagagttgctcagacaggacttacaatggctgagtatttcagagataaggaacatcaggacgtactgcttttcatagacaacatattcagattcgttcaggcaggctctgaggtatcggcactccttggcagaatgccgtcagccgttggttatcagcctacccttgcgaacgaaatgggcgctttgcaggagcgtatcgcttccacaaagcagggctctatcacatctgttcaggctgtatacgtccctgcggacgacctgacagaccctgcacctgctatcacgttctcacatctcgacgcaacaacggtgctttcaagaaagatagttgaacagggtatctatcctgccgttgacccactggagtcaacttcaagaatacttgagcctgacgtagtaggtcaggagcattacgaagttgcaagaaagactcaggagcttttgcagaagtataaagaacttcaggatatcatttctatcctgggcatggaggagcttgacgacgccgacaagacggctgtttacagagcgagaaagatacagaaattcctttcacagcctttccatgttgcagagaacttcacaggcatagagggcaaatatgttcctctgaaagaaacgatcagaggattcaagaagataatagacggcgaaatggacgaatatccagaggctgcattccttaacgcaggcactatcgacgatgttatcgaaaaggctaaacagcttgaaaacgagtgatgaccctcaccgaaaggagaagctgaaatggtaaagacattcaagcttgaaatacttgccagcgaccacgttttctattcgggagaatgtgacgagcttatattcccgggtcaggacggctctttcggaatactgcctaatcatcagcccatgataacctgtcttaacgcaggtgagctgcgttacagaacgggcgaccagtggcactatgcggtggtaagcgatggttttgtggagataatgccgtcatatgtgacgcttcttgcggacactgtggaacgtcctgaggagatagacgaaaagcgtgcggaagccgccaaggagagagctgaggagaagctcaggcagaagcagagcatttcagaatattatcacacgcaggcagctcttaacaaggctgtggcaaggcttaagatatcaagcaagtatacaaaacataagataaatatttgatacaaaggctctccgctcacacggggagctttttttatgtttgcgtgttacctttttaaaaaatgcgtgtatatattagtgaaagccaaaagacaggaggtggaaagcttgaacgaaaaacatctgataacaaagctgaaaaagagatcccagaaagctctggatcagcttataagctcctattcggcttatgtgtataccatagcgagaaacattctgggaggtgcgttcactgcagaggacgcagaggagataacatcagatgtgtttttccgtatctggcagaccgccgacagccttgacgaggagcggagcatttcaccttatcttgcagcctgcacacgaaactgtgccttgaacaagctcaggtcaaagggcaaggatatgcagtgcggcgagcttatggaggatatcttatcctgcggagacattgaaaatgatatggaaaatgcagaacagcttgccataatatccgacggtcttgaacggctttcaaagcaggacaaagagatctttataagattttactattacggagaaagacttgccgccataagcggaaaaatgggcattacagaaaacgcctgcaaaacaagactttcacgcacgagaaaaaagcttagagaatatctggcagaaaggggctataaaaatgaaaaaaaatgataactggtcgcagagctttgcaccgctcaacacggcagaatgtgaccccgtccgcattgcaggctctgtcagagaaaagataaacgcagagaaaggcaggaacataacgatgaaaacaaacaaaagaagaataaaaccgcttgttatcgcagcagcagttgcagccaccgccgcagtttctatggtatcagtaaacgccgccacagacggacagcttgttgagaagataagtctattcataaatggcaaagagcaggatatcgacaactcaaatatcaagaaaggcgttgacgagaacggcgatcagtattatgaatttcacgtcaatgaggacacggacagcgaggtatctgtggagcttaggggagatgtttccgatgctgatgataacggcgttcagtacgatatgaatgttgacaaggctgaataacgccagttcacaaaaagtttacattaaaagcatagcaggctcttgacaaaaggtcaagggtctgttataatattagagcattcgtatctaaagacagttggcagcaggaaactgcggaagtccagccgaggaaaggaatagcaaagtaattatgactttgtatctcttttgtcttgcgacgaaagggatttttcttttgttagtttacggtttgcgtaaattagttcaaagaggtgaaattgaaatgccaagcgaaaagacattgtccgctaagaaggaaagagttgcacagctcgttgaaatgctcaagaactctgctgcaggcgtactcgttgattacaagggtatcactgttgaagaggatacaaagctcagaaaagagctgagagaggctggcgtaagttatttcgttgagaagaacactatcctgagatttgctcttaaggaagctggtcttgacggtatcacaaacgtactcgagggtacaacagctatcgctatctctaacgacgaccagacagctcctgcaagaatactcggtaagtttgctgaggactgcaaggacgaaaagttcttcctcaaggctggttacattggtgaggacgtttacgacgaggcaggcgttaaggctctctcgaagatcccttcaagagaaactctgctcgcacagctggttggttcccttcagggtcctatccagaagcttgccgcaacacttcaggctgttgtggacaaggacaacgaagctgcataatttatatgccgcttaacgaatgggctttgacccgaaaaattatttaataaaaaggagatttttatcatggcttcagagaagattatgaattttgtagaagagatcaagaaactttccgttctcgagctttcagagcttgttgacgctatccaggaagaattcggtgtaacagcagctgttgctgctgctccagctgctggtgctgctggcgctgctgctgaggagaagacagagttcgacgtagttctgacttcattcggcgatgctaagatggctgttatcaaggctgttaaggagatcacaggtcttggtcttaaggagtctaaggaactcgttgagagtgctcctaaggctatcaaggaaggtgcttcaaaggctgacgctgaggagatcaagacaaagcttgaggctgctggcgcttctgttgagctcaagtaattctgagtttacacaaataattaaaggacttcgtaatgaagtcctttttttgttgaaaaaattcataatgagtgaaactgttccaccttgggcagcggagtggtttgaattttttacaaggttgtgtagatataccgtgtggtatgctttggtttagaatatctagcccaacagaactgttatatcgcctgactgatttgtcaatagcgaagctcgaatatatacaaacaagtatgtggtatgtatatttataaatagtcgaatttttttgaaaaaaagccttgacaatagaaaaaataaatgctataataattaagctgaatgacacggaacacaaacaaaacgaaagagttcagcgaaaagaatagcaaatgcggcagtgctggaattggcagacaggcacgtttgaggggcgtgtgtccttgacgtacgggttcaagtcccgtttgccgcaccatacttgtgcaataaaatagatgcacacctcgaaaagctcgtatttacgagctttttttgcgttttgagagcgaaattttcaggtgtaaaaccgtagatgctttttcgttaaaaaaggatctgaaccctcaacaattaaatattgtcaagcattccggcaagttatgagcagattttgctccctacttgccgtatttttatgaaaaaaagtttcacgaagttttaaaggctgttttgtctaatatcacgaattaatgtgatgttaaacgaaacagtcttttttgttagcacaagagagagggtgattccaatgtggcaggtataccattaaaagagagcaaaaattaattcaacaggaggcaatatgatatacaaccaaaacaaggtagaaatactgagacagagatatccggaaggaacaaggatctgcgttgactcgatggacgactactgtcccattgaaagcggaacctgtggtacggttgagtttgtggatgatgcaggtactctccattgcaaattcgataacggaagaacgctcggagttattcccgatgtggataagttccataaaattgatcaggaacagactcagaccgatgagcaaacagaagaaattacggaaactgaggatattgaagaatctgaagaaatgaatatatcaatgtgacggtcaagttttgaaaaaagcttggccgttttttttattgcagaaaggaacgtggtaaatgataaaatattttgatattttcgcaggtatcggcggatttcgctcaggacttgaaaaagcaggcggctttcagtgcgtcggatactgcgaaatagataagtatgctaaaaaagcatacgaaacaatgtacgatacggaaggcgaggtgtattacgatgacgcaagaaaaattgacccaaacgaactgcccgatctcgaccttatttgcggaggattcccttgtcaaagcttttcaatcgctggaaaaaggggcggctttgacgatgcaagaggaactctcttctttgagatcgccaggattgccgccattaaaaaacctaaatatctgctccttgaaaatgttcccggactgctatcacataacgaaggcaggacgtttgcgaccatccttagtacgttggatgaattggggtacgatgtcgtatgggaagtgcttaacagcgcagattttggtgtaccccaatccagataaagagtgtatattatcggatttcatagagaaaagtgttccggaaaagtattgtctttcacagacgcaaatccaaaataccacaaaaaaagactgctgtcttgctttttggcaagatcgcagccttttttcttggggactttttttacagcccctttctgcgttatttaagaaatcgtaaaacacattactgtggtggcgtcgagaagaatgtctgccatgcgtagccctttgtgccattatattcaacataataccagccgttttcgttgcggtagtatttgcaggtcgcacccgacgggatagtgagaagattttcactgctcgatgtaggctgtgggtggagataaactgcacttatgcactggatatcaccaacagcgtcaccgttgtcatctttatcactgtcatatggatcttcgtcaggctcagtggtctttttggactttttagatgttttctgtggctcttccgaagttgtggtggtctttggcggaatgtattccgtagaagttatcgtaccggtctttttcggagtggtgttggtgttcacaaaaagagtttttgcaaatatcattattactatggctaccacaagtacagtcagcagtatcgctattattccctttacagtaggagtgagccaagtggagctttcctgctgctgaggtatgttctgaccctgcggtctgcgatcctgttcaggacgatagtagcctttattgtttctgttgtcaggcattatttatattcttcctttcggttcattgactaaagttcgacacatttcgtgtctatatctttaattatacaaaatataaactgttctgtcaattaaaattcggttacgatttacatttactttataacaatatggtgtaaatcgggaggcatttttatgtaatagatgtgaaaattatcaaagtggatagatataacgttttcttgaaggcttgttttgttacaaagggaaaaaatatgttaataaattttcataacccttttatttgtatatataatatgctataataataacaaatatgagaattttaatattctcagtaagctgtaaggagattgatgataatgaatattgccgttgcacaatcaggaggacctacctgcgctatcaacgcttcattggtgggagttttcaaacaggctgtgaaaacaccacagatagacgccgttttcggctcgctcaatggtatcgagggtatcataaacgaccagctcatagatcttaagcttgttataaaaacaaacgaggatatggagcttctaagacagaccccgtcaacagttctcggctcatgccgttataaacttcctgatgttgaggagggcggtgaaacatatgagcgtatcttgaactgccttgaaaagcataggatagaagctttcttttatatcggaggaaacgattctatggataccgtggcaaagctttccgattatcttgcggcaagaaattcaaagataagagttataggcataccaaagactatagataacgacctgcctgtaacagaccatacaccaggcttcggctctgccgcaaagtatgttgccgcaacggttcaggagataattcgtgacagctcggtttattctatcgagtccgtcactatcgttgagataatgggcagacacgctggctggctcacagcttccacctgcgtactcagagcaaatgacgagatagcccctcaccttatctatcttcctgaaaataactttaccgccgaaaagttcctggaggacataagaaatcaaatggcaaagcacaaagccgttatcatcgcagtttccgagggcgtaaagcttaagggcgaggaaaataagccgagagttgtggataatttcggccacgagtatctctctggcataggaaagacccttgaacagctcgttaaagagaatatcggctgtaaagtccgttctattgagcttaacgttatgcagagatgttcttctcatatctgctcaaagacggatatagacgaagccgaggaaataggctcagcaggcgtaaaagcggctcttgcagggaaaacaggtaaaatgatgatattcaagcgtatcagcgacgtgccttatgttgtgaccgttgacagcgttgacgctcatgatgctgcaaataaggaaaaattcttccctgcccagtggttaagcgaggacggcaatgacgtaaatccggaagccgtaagatacttcctgccccttatccaaggcgaggtaaaaatagcaatgaaaaatggtatgcccgttcatttcaagctgtaaagcgtaaattcgtttttatgcaagttgtaggggacggcgccctcgacgtcccgcttgtttaagtctttttcaacactctcagcagagcagtttcaagctgttctgcttttttcgttccataccgtcatcagcccttgacaattcggtgcaaaagtgagataatattataataggtgcagtaatgccatatcatgcggaaaggaaagaatataatgtgtgatctcaaattcagctttcaaatgaaattcacagttccgtttcgcagacagcctaagacacgagtctgacggcaaaaaggcaatgcctcttggtcttgccacgatactgtgatagaaaaaatatttgcgaaaggaattgttttataatgaaaaaagagctttcaaagctttatgagcctaataaggtagaagataagatctacaaatactggcttgacggcggatttttccatgccgagcctgattccaagaaagagccatactgtatagttatcccaccaccgaacatcacaggacagctccatatgggtcatgcccttgatgaaactttgcaggatatacttatccgctggaagagaatgagcggatatgccgcagagtggatacctggtacagaccacgcttctatcgcaacagaagcaaagatagttgaagctatgcgtaaagagggccttacaaaggacgatatcggcagggacggtttccttgaaagagcatgggattggaaaaagaaatacggcggcagaatagttgagcagcttaaaaagctcggctcttcctgcgattgggacagagagcgtttcacaatggacgagggctgttcaaaggctgtaaaggaagttttcataaactactataataagggacttatctacagaggcgaaagaataataaactggtgcccgcattgccgtacatctatctcaaacgccgaggttgagtatgaagatcaggctggtcacttctggcatcttaaatatcctctaacagacggaagcggatatgtagagcttgctacaacacgtcctgaaacgctcctgggcgatactgccgttgcagtaaatccaaaggacgaaagatataaggatatcgtaggtaagacactcacactgccgcttgttggcagagagatacctgtcgttgccgacagctatgttgatatggagtttggtacaggcgttgtaaagatcaccccagcccatgaccctaacgactttgaagtcggtaaaagacataacctgcctgttatcaacgttcttactgaggacgcaaagatagttgacgattatcctgaatatgcaggcatggatagatacgaggcaagaaagaagatagtcgaggaccttgaaaagggcggcttccttgcttatgttgaagaccatgagcataacgtaggtacttgctaccgctgcggaacaactgtcgagccaagagtatccctccagtggttcgttaaaatggacgagcttgcaaagcctgcaataaaggctgttgaggacggctctatcaagtttgttcctgaaagatttgagaagaactaccttaactggatgaacgatatcagagattggtgtatctcacgtcagctttggtggggtcatcagataccggcattttattgcgacgactgcggtgaaactgtggtaacaaaggaagaccacgcttgctgtcctaagtgcggcaaggaaatgcgtcaggatcctgataccctcgatacatggttctcatcagcactgtggccgttctcaactctcggctggcctgacaagacagaggagcttgagtatttctatccaacaaacactctcgtaacaggctatgatatcattcctttctgggtatccagaatgatagttgcaggcatggagaacatgaagcggaagccttttgatactgttcttatccatggtcttgttagagattcacagggcagaaagatgtcaaaatctctcggaaacggtatcgacccgcttgttatcatcgaccagtacggcgcagatgccctgagatttatgctcgcaacaggcaacgcacctggaaacgatatgagatttatcgaggataaggtaaaatcctcaagaaactttgcaaataagatttggaacgccgcaagatttatcatgatgaatcttcctgacgatttcaaggctgataagctccctgaaaacctcaatgttgaggataagtgggtaatatcaaagttcaatactcttgcaaaggaagtaaacgataatcttgataagttcgagcttggcgtagcagtttcaaagctttatgactttatctgggatatctattgcgattggtatatcgaacttacaaagccaagaatagccgcaggcggtgaaacagaggctaccgcacaggctgttctcgtgtgggtaatgaagggtatgcttaaaatgctccacccattcatgccttatatcaccgaggagatctggcaggctcttgtaaatgacggcacatctatcatggttcaggattaccctgtatatgacgaaaagcttgaatttgccgatgaagaagcaacatttgagaagataatcgcaggcataaagagcataagaaactgccgtggtgaaatgaacgttccgccgtctgtaaaggcaaagctttatattgaaactgcacagccagaagtattctcacagggcgtaatgttctttgaaagacttgcttctgcatctgaggtcatcattacagataagtgcgaggaaaaggattgcgccgccgctgttacagacagtgcaagatttttcattccgcttgcggatatcatagacgttgacaaggagcttgcacgtcttgataaggacagaaagaatgcacagaaggatatagacttccttagcaagaagctcagcaatcagggcttccttgcaaaagcccctgaacagcttatcgaagccgaaaaagcaaagcttgcaaaggcagaggagaagatgtcaaagataatggaatctatctccgctctggaagcaagaaagtaatataaaaaatcaatggcgaggtctttcacctcgccatttttttgtgttttatgtaggaggagctgtgcatggcttataacccaaaacaaaaaaggcaggacagcccgaaagctgtcctgcttgattttttatatctcagaattagtttttctttacgccgatagaaactttttcgccgttgatgtcccaatccttttcgttgccgacattttcgccaagaacgatatcgtctgcaagaacgtcatgagaaatagcctctctgttcttgtcaacaacagccataaccttttcgctgccgcttacagaaacagtgatgtgatccattacctcaaagcccgaatcctttctcattgtctgaaccttgctgataacttctcttacaaagccctcttcaataagctcaggagtgagaacagtgctgatagctacagtaacaccgttttcagaaagggtgtagaagccctctttctgctcagactcgatgagaacatcatccttgtcaagtgctatctcaccgcttgaaagcgtgagtttcagactgccagtttcgttcagttcgcccatagccttgtgtccgtcaagctgtgaaagctgtgttcttatctcgccaagctgcttgccgtactttggaccaagggtcttgagctgtggcttgaacttataatcaatatatgcagatacatcatttgagaactgaacgtccttaaggttaagctcgtccctgatgatgtcgatatagtagctgtcaagtgggtggtctgctgcaacgtacatcacgctcaaaggctgacggtttttaaggcttgcgccgtttcttgcagaacgtcccagaacaactatctccagaacctcttccatgtcagcttcaagcttttcgtctatcatgttttcgtcgcaaacaggataatcgcaaaggtggatactctcaggagcgtccttgtcaacgcttctaacgagattctgatagatctcctcagtgatgaaaggaaccataggtgctgcacacttgcagagcgtaacgatagcagtgtaaagagtcatgtaggcgtttatcttgtcctgtgacataccctgagcccagtatctctctctgcctcttcttacataccagttggaaagatcatcaacaaactcctgcatagcctttgcagcctcaggtatcctgtagttgttaaggttatcgtcagcagcctttatcatagagttcatctttgaaagcagccacttgtccattacagaaagcttgtcatattctatctcatgctttgtagggtcgaactggtctatctcagcataaagcacatagaacgcatatgtgttccaaagcgtgcccatgaactttctctgaccctctgttacgcccttgtcatggaacttattaggaagccatggagcagagttggtgtagaaataccacctgatagcgtctgcaccgtatttagcaagtgcctcgaatgggtcaacagcgttgccctttgactttgacatcttctgaccgttctcgtcctgaacaagaccaagcacgataacgttcttgtatggagccttgtcaaatataagcgttgagatagcaaggagtgaatagaaccaacctcttgtctggtcaacagcttctgaaatgaagtcagcagggaactgtgactcgaaaagctccttgttctcaaatggatagtggtgctgtgcaaaaggcattgagcctgagtcgaaccagcagtctattacctctgatacacggtgcatctgttttccgcactcagggcatttgatagttacagcgtcgatgtatggtctgtgaagctcgatatcatcagggcagttgtctgacattgacttaagctcctcgatagagccgatagaatgtctgtgaccgcactcgcactcccaaatgttcagcggagtaccccaatatctgtttcttgaaatgccccaatcctgaacgtttttcagccagtcaccgaaacgtcccttaccaatgctctcaggaatccagttgatagtgtcattgtttgcgataagtctgtccttgacatctgtcattttgatgaaccatgtatctcttgcatagtagataagaggtgaaccgcatctccagcagtgcggataatcatgctcgaacttaggagcggcaaaaagcttgcctgacttgtcaaggtctttgagtacctcagggtcagcgtcctttacgaacattccggcatatggagtttcagcagtcatgtcgcccttgccgtcaacaaactgaacgaaaggcagatcatacttctttccgactttagagtcgtcctcaccgaaagcaggcgcaatatgaacgatacctgtaccgtctgacatagttacatagctgtcacaggtaacaaagtgaccctttttgccctgcttctttgcgctttcgcctgcgcactcataaagcggctcgtattcaatatattcaagatccttgcccttgtaagtttcaagtaccttgtatgcaggcttgtcctcagttgcaagcttgccgagaacagtgtcaagaagtgcttcggcaagaatataagtgtagccgtcagcggcttctaccttgcagtaagtttcatcagggtttacgcaaagggcaacgtttgaagggagcgtccaaggagttgtcgtccatgcaaggaagtattcatccttgtcaacaagcttgaaacgaacgatagcagaacgctctttaactgtcttgtagccctgagcaacttcgtgagaagaaagcggtgtgccgcagcgtggacagtaaggaactatcttgaagcccttgtaaagcaagcccttttcatatatctgcttcaaagcccaccattcagactctataaagttgttgtcataggtaacataagggtgttccatgtcagcccagaagccaacagtgcctgagaagtcctcccacatgcccttgtatttccatacagactctttacacttcttgatgaacggctcaagaccatattcctcgatctgctccttgccgtcaagaccaagcattttctctacctcaagctcaacaggcagaccatgtgtgtcccagccagccttacgaggtacctgatagcctttcatagcacggtatcttggtatcatatccttgatagcacgagtgagaacgtgaccgatatgcggcttgccgttagccgttggaggtccgtcatagaaaacataggactcgccctttttacggctgtcaatacttttttcaaagatattgttatcgtcccagaacttttccacttctttttctctctgaacgaagttcagattggtgtcaacctttttgtacacgaagatcaatcctttctgattttgtaataaacgatcagttacgcataaagataaaatgcaataaaaaaggcttccgccctgaaacaggacgaaagctgtaaagccattcgcaaaccaccttttcagcatactgacatatgcgttccctttaacgcaggaaaagcggcgaagcttacttatcatactgattttcagcctgcaactcggaagtgatattcagcctgaagctaatcataccgccctctcactgtcggcggctcgctgagatttttgcataaagcctactgtcttcgtcaacgttttttacatataaaatcagtatatcaccatgctgatgttttgtcaatggttattttgttaattttcatgtatccgacttttttatttttgatataaagtcattgagcctgtatccacgttgctcctcacgctgtttgtcacgatactttttcaaatgctcgccaagccttgcacctgagcccatggaaagcataaatctgtatttctcttttctctcctctgaactttccctgatgtgccgtttgaactcttcgtatctgatgaccatatcgttctcttccgcaaaagtctttatcttctctgccagcttcagggaatagaataggtcgatagcaaaaacaccatagaaaaatccaataaagaacgagaacgccaaattattcgcaagccagttgagtgcgtcaagaatgtatgggtgtataaagaaataatagaccgcgcccagtgctgcccatatgagtgaatacaacggacatattatgcctttatagttgaatttgtttccagtgtagtcccacagcttgacgtgcattttcacaatgaatatctcgcctgcaataagctctatcactgtcattgcaatagccataagcaaaaaaagtataaacttctgcaaagccgtgttgtcagtgtgtataaatttttcaagtcccgccagcagataaagggtgcaaagcccgaagccgtataaaggcagataaggaccaataagaaagccgggatttatccattttcttgctttgttgttaggctcaaatcgtctgaaaataacttctatcccccagcctatcagacacccagcaaagaacaggaatgccagaataagtatattgctcatataaataatcctttcaaggtttataaaagcattgtaccatatttgccgttatttttcaatactttcaggtaaaaaagtttgactttaatcaaaaaacatcagcctgccatcacctgtaggggagcggcgcaatttctgcttggcagaaatgcgacgtcctgcttctttcgtttatcatctgtgctattttcctcttcattcctcgcaaataaaaaaggcaggaaaccgaagcctccctgccttatatgatttgaataagatgctattacatatagctcttgaattcgttgttttcttttctaatgccttcgatctcagcgtttacctgactgatctgaatatcaacctgctccttctcggcgttgagcgccttagccttttcctgaagcttaacgatctcctcgtagatatcgcttgcctgcttaccgagatccaaagactttgcctcaggttcagcaatgcttgccttaagctcgtcgatcttcttgttgttcatctcgatctgctcctgcgcaaacatacgcattttttccattggactcatacccatattctcgccctcctcattattatttgtattttcagcttccgcagctttcttttcagctatctcgtcttctatagacggcatagtagactcaggggcaggtgaaaccaccattgtgtcatcaaggcttataggctcgattgacggcatctcgacctcgtccattgtaggaacttcctcagccacagtagcttcagcctttgcattttcctctgccttagctttttcctcagcctctttgagagcctcaggagtaacaaggtgaacgctattgtcctcaggaggaacaggagcggaagcaggttcagcctttgcaggtgtttcgatacctgttgcatacatattgctctttctctttgcaatgccgcttgcaaggcttgccgccagcggatcagttatgttctgagcaggctcttccttaggctcagacgcaggctctgcctttggacccttgtatgtattcattcttttgaaatgctcgtccatgcagccctgaacagccttgatatcctcaggatctttattaaagaatcctgcgatatcgtttacgcttctgcctttctgaagcattgaggcgatagccgcaacactgtgatcaacaaatccgtcatcatccatagccagatttacagttacccttgcaggctcaacactctcctgctttttgttcttctttccgaaaagctcgcttacagacatattgaaaacgctcttctttccgttgccgttttcatcagcaccctctcttacaggctgttcaaagcttgcatagtcagggaagtgcttttcaagtattctcggaacattatccttaggcatctccatttcttttgctatctcaggaatggagtaaccctccttatacaaacgaacgatcttgtcgcttatgctttcattcttctttgccaaagcaatcaatcctttcaatcaatttcccaataccgtgactatttgtaaataaatacatttccgcaataaacgtttaagtaattatgaactgccacggcggcactatatatattatacaacacaaagcaggttgtgtcaatataaaatatgcaatttttctttaaaaagagcggaaaaaatgaatatggttaaatgacttattatttacatataaattaacaaatcacgttccgcgagagcagttttcaggcagtataaactcccgaccatttagatctatcagcccctcacggtgcatttttccaagctctgttgacagcgcactgcggtcaacgcagagaaaatctgcaagctgttgacggtcgaaattcgtcgtgacaatgtgcgatccgcttttctttgcaagcgaagaaagataaaccataacacgctctcttatagtccttggtgttatcacttgtatcttttcgttgagcctgagatttttcatagccgttatctttagaagcctagccgtcagcgtcgaactttcctttataatagactcaggggataaaaacagcactgtgcattgctcctttgcacatacgctcaccccaagcggttcacctgtgcaggcatagacctccccaaaaagctgtcctgcctccaaaggagcgattatgctcctgccgccccaaagctcgtcacgttcgataagcgccttgccctccagaagtatgccaaaataagcggacttgtctcctgcgtgaaaaatatagctttccttgcgaaagctttttatgccactgccgtcaggtctgagaaactgagctatctcctcgtcgctcatgccctggaaaaggggagtgccttttattatcttgatgtatttattatccattttatcttcctcatttttacgaaataattttatgcttttgttgtaattacaacagactttgcgataagattatattataatcatagcataaagtcaagagctttatgccgaaacgaaagatatcaataaaaatacggaggtaaccatatgataagacgagtaatacaaatagacgaagaaaagtgcaatggctgtggtgcttgtgcaaaagcctgccacgagggtgcaataggcatggtgaacggcaaagcaaagcttatgcgtgacgattattgcgacggccttggagattgtcttccagcctgcccaacgaacgccatatcctttgttgagcgagaagctgccgcctatgacgaaaaggcagtggaagaaaacaaaaagcgtcttggcaagcctgttttccatggctgtccaggctcaatgatgaaaacatttgctaaaaagccagccccggtagataccccgtcagcaaaaactccgtcacagcttatgcagtggcctgtgcaaataaagcttgtacctgtgaacgcaccatactttgacggtgcagacctgcttgttgctgcggattgcacagcctatgcctgcggaagcttccattccgatttcatgacaggcaaaataaccgtcataggctgtccgaagcttgacgccacagactactccgaaaagcttggcgagatagtgaaaagaaacaatatccgcagcataacagtagcccgaatggaagttccatgctgtggcggaatagaacacgcagtaagaaaagcagtcaccgacagcggcaaaaatatccccgtggcagtaagaataatcaccacagacggcaatgtgatataacacaaaaggcaggacaaaacgtcctgcctttttcatatctgtgtgggcgacctctggccgcccgcatttttttgtgtctgatttatctgactgagcgaaatttattcacccttagccatgacctcagccaactcgcccaaagccttttccgaagcctcattaagcgtagagcggatagtcacaacaggctcagcaatggtaacattcttgaagttttccacatagcccttcataactcttgccgcagtcggagcccatgaaccgttctctacaagacctatctttctgttctgatagttctttgacttcaggtgcataaggaagtcctccataacagggaacacaccaccgtcataactgcttgccataagtacgattctgtcatatctgaaagcgtcctcaatattttctgccatgtcgcttcttgaaagatcgctgataactaccttcttagcacccttttctttcagcatctcaccaagcttttcagctgcctttgcagtgtttccgtgtatcgacgcatacgctacgaatacgcccttgctctcaggctgatagcttgaccatgtgttgtaaagtccaagatagtaaccaagatcttctttgagtataggaccatgtaaaggcagtatcatctttatgtcaagggcagccgcctttttaagaagcgcctgtacctgtgcaccgtatttgcccacaatgttgaaatagtatcttctcgcctcgcaagcccagtcctcatcaacatcaagtgcgccgaactttccaaagccgtcagcagagaacaacagcttttcgctctgctcgtatgtcaccattacctcaggccagtgtaccataggcgccattacgaactgaagtgtgtggcttccaagagaaagcgtgtccccctcttttaccacaacagacctatcgtcaagtccgtcaatggtgaaaaactgcttcatcatagggaaagtctttgcatttcccactatcttcatctcaggatatttctccgcaagctttttgatgtttcctgcatggtcaggctccatgtgctgaacaacaagataatcaggctttctgccgcccaaagccttttcaagattgtcaaaccaaacgtccgttaccctagggtcagcagtgtccattaccgctatcttctcgtcaatgataacataagagttgtacgaaacgccgtttggcacaacatattggctctcaaaaaggtcaatgtcatgatcgtctgcaccaatataaataactgagtctgaaatttttgtgtctgccatttttattacctccgttgtactttttctaaatatactattttaatatactttgattttatcacaagctcagcattttgtcaataactgaaacaatgtttatgagaattttacctcctcaaagaaaaggtctttccccatgacctctttcacaggcatttcctcctgattgtaagcaagcagaagcttcatataagccgccaccgctgaggtggtgtatattggtatgctgcctgcctttattatctccgccacagtggagtatataggcacttttcttttcagaccgcaaatatacaccatgatgttctttgttatgcaccgcttgataaattccgtcagtgcatagcttttcccttctgaaacgtcagtgcaagccgtcgcactgtgataaggtgagtaaagcaccgccgccgtgtcctcgtttggcacaaagcacccgaagtccattgcaggataaccctctataaaaagaacacgcttcccaaatttgacatcattatggaaaatccgttccctagggcgtgacagcatattctcgctcactccgctgaaaacagaaaagtcgttgaaaccgtcataaccatataccccaaacctgtcccgacaggtgtctgcaggtatcaccctagtaggaagcatgaccctctcgtacagcgtgaaaacgcccttgtatttcccctcttttataagccccaccgccgaggtgaagttgaaaagcccgtttgaacctttctcgccaatgggcttgttgcttgcgataataaaaaggggtatatcaaaatgcctgaaatacattccaagcagagcagaagtgtaagcaagggtgtcgcttccgtgggtgaggataactcccgagtataaagccgtgtcaatgctgtttatctcgtgtatcattttctcccaccccgaaaaccccatgttttcgctgagtatattaagtacctgtcgacattcaaattccacatcatcgccgtatgcactcttgtaagcctccacaacagcgtattttccctcacgctcaacatctattatgccgtcagtagtaatgctcccgatagttccgcctgtgaaaagcacaagtatcttcttcatgtttttatccctgcctttaccaaaaatcaacccttgacatttgttataaatataatatcatctcacgattgatttgtcaatagttgtacaaaatgcacaaaagtgtggattatattaatgaaaaatgagtattgagaaatatgttgggatttgatataataatagtgttgtattttgtacagtttaactatagtttcgcagataaccaataaaatatgaatgagttgaagaaattggtgtacaaataacgtaacgctacccagtaggggcgaacagctttcgcccacttttttctcagcaaatcatatttcatctgcgaacaacattttctattagtatcagaaaggaagataatattatgtgggcatacgaaagtgtattttatcagatctatcctcttggattctgcggtgcgccatttgagaatgacggcaaagaggaaagcaggatattaaaggtaatagattggatacctcatatcaaaaagcttggtgccaacgctatctatttttcaccagtgttcgattccgacactcacggctataataccagagattaccgcaagatagattgtcgccttggcacaaatgaggactttgcaaaggtctgcaaagagcttcacgaaaacggcataaaggtagttttggacggcgttttcaatcacgtcggcagaggcttctgggcttttcaggacgttctgaaaaaccgtgagaactcaccatataaagattggttccatatcaatttcggcggcaacagcaactataacgatggactttggtatgagggctgggagggtcactttgaccttgttaaattgaacctcaataatccccaggtagtggatcatatcttggaatgcataacaaattgggtcaaggagtttgatatagacggactccgccttgacgttgcatattgccttgataagaacttcttgaagcgcctcagacagcattgtgattggctcaagcaggatttcgttcttatcggtgagcttctgcatggtgattacgctcagtgggtaaatcctgaaatgctccattcctgcacgaactacgagtgctataaggggctttattcaagcttcaactgcatgaatatgttcgagatatgccactctctgaaaaatcagttcggacctgagaactggtgcagatacagaggaatgcacctgctgtgttttgttgataaccatgacgtatcaagaatagcaagccagctcacaaatgagcgtcatttgccacttatctatggaatgctctttggtatgcctggtatcccatgtgtatattacggctcagagtggggaacaaaggcaaacaagagcgagggcgaccctgctctccgtgtaagctttgaaaagcctgagtggaacgaccttacagagtttatctcaaaaatggcagaggcacacaaaaacagcaaggctctctgctatggctctatcaaaatacctgttcttaccaataagcagtgtataatcgagcgtgagttcgagggtgagcgtgtccttgttgcaataaacgctgacgatcagcctttcacagctcactttgacgcaggctgcggtcaggcagaggagcttctcacaggcactatccatgattttggtggcggcagcgagcttaagccatactctgtagagttctggaaaatggaaagatagacctatatgaatatagaaaggggctgtaaaaaaacgcgcaataaaaaaagactgcaaccacccttaaaagggtaggaaagcagtcttttttgtggtataataaatttgatgaaaaaatacttgagcttatggacgttgcagataactgagcttcgcaggaagatatactttactaagatattgtgatttaatacagcaaaaagaggcagagaaacccattgatcgggtttctctgtttttttatttttgctaaagcagacaaccaaacaccgccacctcctgtcccccaagagagcggcggtatctacaccacgctacttttcagtaagatattcatttctgtcaaacaactgctcaattgaaagatttttaaacctcggaatgttgtatccaaacggcgagttgagagcctttacaaagtctttcgtatagccgtgattttttaaaagatcatcctcatactttattttctcttcttgctttgtatcatcttcccttttcgtgatgcagcgctgcataacataatgataaatggagaagtaagaatccactgtacgaatatctcctatgtattctttcagttcacgaactacagtaagatgagcaatacagttgcggtattttcttgtcatgctgctgtctgcattattgatatcaacttcaacgcacttgcgcagccgcttgttctttttcaggaacaaattcggcgactcgtcaccattatcacaaagttcacaaagcgtctgtgaaagtatcctgtagtcatttttcaagttctttgaagccagctcaggaattatctccttatacagcccaaagtcacgttcaagacagtgtatcgcaataacatatcttgcattgacattcacaagatttttcaccagcagatacatgaccgtaagataaagcccgataacagcctttgccctctcctttgccacgttttctctgccctttgcctgctgtttcacatttttgaaatcatcaaatctgatgttctttatcattctcgcaagctcactgcgctttgcttccaaagaactgttcatgtcaggaaattccacacaactcttgtaataacgctctatctgcgtgtcagggatacccccaagaacaaacatgacaactttctcattcttagccacttctcttatcttctgagcgttcgcatacttgataaggtatacaaaccgagaggactcgataacattgtttgttatgaaattcctcagaccatgtatgcccttgcctttttctttaagttttaaaatctcgcttatcctatcgtccgtgatcttgtcgtctataccgagtatagtcagtgcgtcacggaacatcgtaagcttcgccgaagccgcaggctttctcatggaagcaatgttctttacgataaaaagctcgttggttatcctctggctgtcattgaacagcttgtagccagccgtaagctcacactcaacatcaatagcagagcttttcattatcttcaaaaactccttgatgttatcaaacttgctgataagcgttgtaagaagatcgtttatctccttgccgtcaagaaaatatgtgagcatatatatcattttggagaaatacaaaaggtcagacgcattcttcttttcgctgtcaagaattttctcatcaaaatccatgtcagccttgccaagctccttgataacgtcaccgttcatgtggtcggcgatattttcaaaatcattcctgaatttgccccaaagctttgccgcttcatcagcatatatcccctctttttcatcatcggtcattgaaaaacgcagtttgcgcacaagagattcgcctgcggcaatgtcatttctgtagtagttgcagaaaagcagaaaatccataagcttgtacatctttgagcgcacagagtcatattgcttgtccttaaatctgaatccgtattcgtccagtattttctcacgaagctttttgatagaaaaaccgagatttttctgagatttaagcacaatgaaatcgtaataaaggcgtatgatatcatcagcctcatagcctttcatcatatcaataagcaagctgatattgaccttgttgccctggataaagcccttatttatagaatcaaatctctcatctacaagatagtcaagagtttctctgcactctctgtacacttttttgctattgtcaataaagctgtaaaggtcatactctgagtgttctgacaagtcatgaaaaacgcactgccttatctgccccacaattgcaagcatatgataaacacgctttttgtatgcttctaaaactcttgtatcctttgtctttggctcttcaaggccgaaatagccaagacgcttagttttcagcagggcattgaatttgctaagactttttctgatattctctttcttatcgtcggataaagtgctgccattaggattagtaaaaactttataagtgttaaatgtggaaagataccccatgaaatcgtaattgctctcatcgccttccccaagcatattgttcagggcataaacgatattcgtcacatacaccgcaagtatcttttcgatatccagaatgttgtaaataagctggatatgtatattatcatcaaaagttttgccgaaaaagcgcttttcaagctccgatttaagccccagcatatcccatcttacaggcgagctttcaccgcttctgtgagtagggtttgaagtgtttatctccactccgctctcaaagccatgcttgctagaaaaagtgatgtttacttcgtttacaccacaaagctcgatattgctgttgtcctttgaagaaagctgagttttgttgtagtcattattgtccacctcatattcaagcacagcagaattgcccttgccgaaagaggttatgtacattttattttcgctgacaagaatagacttcattcctgccgcctttacggaggattttttcttctctgccacaggtgcaatgacctctgcagcaggcatggcagcgatcgcaggagcagcattattatttatctcagccgctttgaactgtctggcttttttctgagcctcacgcagctctctaggcttcattttattcttttttgccataaatattactccttatattagttatcccttagcgcattgagcgttaagggatttttttatttgttggttttaatgttaaactttgccagttagtgcaaatttgcaccagtgtagtagactcgaaagaaaagcagccaaagtattgtggttttagactagtgcaaattcgcaccagtgtagtaggcctacggctgatatactgcggtcagcgcagttttagactagtgcaaaatcgcaccagtgtagtagaaaaataaaattaaggaggagaaagctatggttttagactagtgcaaattcgcaccagtgtagtaggttaaagttgacaaaataatcaatgatattttgtaataaaacaccaaacttattttatcgacactttaatatatatatattataccattttcagacacaaatgtcaatagaaagtggctgttttacataaagcattttcatcaccttccgtctgttgttatttcatctcattccccaatctccttgacagctgcgatagcgcagtcaagtacggctatgaggatagtcgtaaggatcgtctttcccatttttatcacctccctagtctattgtgatctcgtcacagctctcaatttccttaacaactgctatcgcacagttaagtgccgataaaaggatagttgtaagtatcttttttctcatttttatcacctcctgtctgttgttatttcatctcattccccaatctccttgacagccgcgatagcacagtcaagtacagctacaatgatagccttaaggatcgtctttcccatttttatcacctcctgtcctttgttctgtatacattataccaccttatcatcgtcaacaaaagtgtaattttcaaaaacttttttgtctatgtttttgcacatttatcacgtttttacggcatttatatcacaatttcagcaaaataattttctatgatattgacaaaaagtacatttgtgatataatggatacaagaggtgataaaaatgctcatacccccaagcacatttctgcccaagcgtgaggacggcgtaccatatatcgcagaggtgcaatccatacccctctcaccctctgcatattccgtcattatcaaggacaagtccatatttgaaacaagcctttcccctaacggcagcgtatcaatgtcctcatttctcacaagtatatttgattcagcatatatcgcatcattaaaatacaaaagtgacgataactataaatataatggtataccacttctgaacgcattcgtagaatggcagatcgaggagattgatgacggccttgatgataaaagcaaggagataataaaaagctatcttatctcaaagctctctgcaaaatacgaaaagaccaagaccgaaaacgcagtgcgagtaaggctcagcatatgccgtgacctttacgatacactgagcagtgatgacctttattatgaaaacaaggtgtacagctcgaccctaagaagatttctgaaagccgtgtatgaggactatgccctgctgtcagattgcgaacgtgaaaggctcattttcgccgacaatatcataaaaataaatgaagtcatcaaacaaaacggcagcagatattacagcttcatttacgcatattctaatatgtacagccgtgaaaagcgccgcataaggcttatcccctaccgtatcgtcagcgacgaatataagatgtataattatcttgtctgcctgtccgacgaaaaaagcgcaggcaaagagttcaaagccgacagctatcgcataagcagattgagcggactaagcatcgcagaaaagctcagccaaaaggaatactcctccgtcaccgaatacgaacggctgaaagagggtcacgtcaagtccgtgaagcacctactcagcgacccacgttttggcagtgatgagagcgatatctccaaagtgtacctcaccgaaaaaggcgttgaaatgttcggcaaaatactctatcagcgccccatactgaaaggcaatgaaaagcccaagcccaacgctgtcaacgagttcatctccccgcctatccaagtcaaatactatttcaataagttcggcaaagacggtgttatcctatctccaagcgactcgtttgaagaaatgagaacgctgtatgtcgagggagctgaggcgtataaccgagaagttgagatatgagaataaaaatgaaaattatagcaaaaaaacacccctatgcagaaatatactcacgatatcataaattgtcaagctctgagaagagtgaatatatgagtttatctttgtaaaataaaccgaccccattcgctagattttttgacctagcaaatgggggcggttcaaatatcaatatcattaactaaaaaaatcaagacataaacgcaagcgtaatatgcggatcactttacttttctgccgtaaaccttgcccactcatattccgctgtaagcggaactgtgccgtcaaaggctttcagccagctgtcaacgccaatgccgttccacgcattcatcattattttaccaggcgtaacaggcagattttctgttgccttgtatgcttcctttccgtcaacataccaagttatgctgtcctctttccactcaaatgcgtaagtgtgaaaatcctcagaagcgtcaaaaccaagatcatacatgtattcgtgcttgccaacaccattggtgtagtaattgaactgcacctttgttgtgtccttgccaaggacttcaacgtcaatttcgtcccaaggattatcctccgacggacctgtgtatgtaaagaacgatgatacaacgccgtcattctttatggctttcatcgatacctcataaagtccatagccatagttttcctttgaacgatactcgccgcctctgtacgcttcggaatcgcccatactgtcaatggtaagctgcatttttccgtcattgaaagtcacgttatcttcgctccacgaacagttgaatggatcaccatttgaccagcctgctgaaatggaaaaatcatttgacgcacccttgctgaaatctgcctcaaccgtgtatggagaattgctttccgtttccgccttgctgctgacatcttgcgatgaactgctgtcagatgaagcaccgcagccacccatagacataactatcattgtgagaatcgacatagccaaaacttttttcatttttcattacctccgaataaatatcagaattttatcttctataagtattataattcaacaaatgtgatatttatatcagaaaagtaatgcaaatatcagattattaacatcaacttatattttcgatctgcttgtgctatgcttgttccagtttgcacggaaaaactgatctctatactgtttcggcgtaagtcctgtctgtttcttaaagcaggcaataaaatggctgtgcgagctaaaagcaagataattggctatatcaagcggactatattcagaatatctcagcatattttcagccgcctgtatcctttttgacataatgaaatcagagatctttacgccaacttcctctctgaaaagctttgaaagatactgaggcgttatgttcagttcatcagctatctgattgacggtcacgcccttgtaaatattatcgaaaatgcagtcaaaacacataaggatatgctttgagtaaacgttctgtgacgcagcctttttcatttgctttgtataataaacgatgacttctttgtgtacagccataacgctttcttcattgcggcactcatcacatttattaatgtatatatcgcttatggtatacgcagtttccgggtcaagtccaccctcgatgcaaaacctgcacagcatagctatggttatgacaagatgatacttgacgtttctaaggtcgtctttgctgagcctgccctttccgtttgtatccagcggcgtatacaaacgtttaaccgtttcaaggtcgccctcccgcaccgcagaataaaattccagttccgtttcatatggtgaatgatgatagtcattttccttttgcataaactgccgcttagacaattctctgtttatttccatagctttcaccccctgctttttagcttattatatcatatttacagacacaagtaaagcctcatatttatagaaaaaggacggcaaatcaccctgccgcccttttttctgataattagatattatttagcctctttcattgaagtcatagcctcgtcgataagataatctatagccttttcattttcctgaacgacctgtgaccagctctttgactcctgcggattcattgttcctcttattgcagtatcgcaaatagagttaaggtcggcagatacgccctgttcaaagtcaaatacaggattctgtgcagacagatcatagatagtctctctcatttcaagcatctcatctgtccagccgtaatcgtccttgtactgatcgagggttatctgatgtgcagcctcgtcaagctctgcgtaacggcagcattcaaggaaagctgccacgccctcaggattttgagcgttctttacaatgctaaagccgtgtactcttgaagggatatactgtttatcgctatcagctgagcaaggaacaggaacgaacattacctctccctttgatacatcgccatagtttacagttgttgacggagcattctcaagtgcccaaagtccgataggatagaaaagcgtcaggcctgttgccattccgcttccctctgcgtcgcctctgagtttccagttattctcgtgctttggataaacaacattgttcttctgcagctcatacatcatattctgagcctttgctatcatagggtcagaaatattgtttacaagcttgccgtctgtgataccgatgagcggcacacctgaagactgctgcaaagccttttcataataccagccgtcgagagcgtatttatcgctttcagcgtcagtaaaatcaagacacatttctgtgaatgtatcccagttccacttgccttctttgaaaagctcagcaggatcgtcatagccgttatcttccattgtctgcttgttgtatacaaaaacatatgcagggtctgttctgataacgctcacataatgcttatcgccaagcataaactgatctgtcgcaccctttatgtctgtccaaagaggctttgaaagatcgatataatcgtcaataggctctatcattgactttatagcacccttagggaaaacgtccatatcatcagcaccgatgaaatcaggtgaatcatttgacattacaagtgccgcaagatcgtcaaacttattttcccaagtggtctgcacccagtttatcttaccattatactttgtcttgaacaaagcaaggtcagcacctatctccttgtcctctgcctcagtagggttgatatcccaatgtgaaaaccactttatttcgttgctcttgagatctctcacatctttcatatcatcagcaagtctttgaactatctgctgctgatcttccttaagctttttgtcaacgaccttgcttgatgaatcacttgaacttccgcaagatgcaaatgctgaaagcgagcaaaccgcaagggcaaatgtcaaaactctttttgcattattcatagtcatacctccgaatattactttcttctctttgcaacgatcactgctgtgcctgcaagagcgataactgcaagtgctccgccaacagccgcacctgtttctgctgccttagatgtatcgtcagatgcttttgaagatgtagccgctgctgcggaagtcttgcctgcatctgccttagatgaagaaacgtctttctttgacgtatcagcctttgagcttgaagcatcagactttgaatctgcctttgaagcatctgtttttgagtctccgccctcggcagatgcaacaccgaaatcaagtgtcattgaaagtgtgccgccgttgaaagcgccttccttctcccagcctgcgacctcaggacaagctttctttgttacctcgcctgtttcctcattgacctcgtcagttggtctgatatgtattcttattccaccctctgggtcctcgtccattgaagtgatagaattaatcgaatcaaaaaccgttgttgtgccgtcctcggcaacgaactttgcgtcagatatcttaacgtccacaggataaacaccatcaggaagattagccaccataacgcccatatctccaagagttcccttgcctgacattgtcttgtcggtgataactttgcttatcttatattcaacagttatcttgccagcatcatcgatgcctacccaatcgccctgattccaagtccagtcctgacccatataaaagcccattgctccgatagagtaatatgagtcattcatttttgagtcctcctctgacgggtgaacaacatcgccaagctttgctgccgaaacagaaactgacatcattgttgctgcgagaaccgctgctgaaagacctgctacaaattttttgatcatcataaccttttcctcctatttttcaataaatttttttgctaaaagcaatttattttgttgtttctgtatatattataactatgtaaacgttttgtttatatcaaaaacgtaacataaatatcataaaagtgtttaatatcaaatttgtgaaagaatataaatatatgaaaacagacccacttgatattcaagcaggtctgtttattcggaagttattataagaaagtgactatgaattaatatgtttatattatacgctttgtttcaaaactattatatcaatattcaattatttatatcaaataattatcgtaaatagaattttatgagcaaacatcaatttatgaaactaagcataaaaaaacaagctcggcaaacgtgaccgagcttgtccaaaaatggagttatattaagaaatgatctattaaagatactttaccagttcatcaagaacgctgtcaagatgtccgtcaataaagccatagtcaacgtccttgtatgaccaagccgctcttccgatagaacatttctcaaaggcactgcttatatccttgtaccagttaagagtattttcagcagatgcaagatttataacaccgtattcgccacaatacataggaacatttctttcctctgcgacccttacagcctcagcaaatcttcccataaaataatcaggcgtaaatttctctgtcttgacctcctcatatgtctgcatatattcaagaccaagacgctttatctcagttctgtattttgggacgctgccaggataatcgatcctgaaatctctcggcatctcatctacccaataggcagcctgatgagtgaaaagaaatgggtcatagcaatggaaagtataaactatatgctcgtcataaggcttatcaaggtctttcattgaatcaatagagttgttccagtagctgcccacaataatatttatatcagagctgtattttctaataagctttatggcattttcaacgatagcattccactttttgctgaacttaggatcagttacctcattgagaagttcaaaagagaccctgtcagaatatttgctgaaacgctttgcaaactcttcccaaaggtcgtagaatttctgctgaagctcagcgttatcaaagaatccgctttcagcctgagccttgtcaaagaaaaagcccattgtcttatggaggtcaagaatcatattgataccgttatttccgcaccaatcgatacacttctgaacatagtcgaagccgctctctataaagccgttttcgtcctgaaagatattataatccacaggcactctaacgtggtcgcagccccagccctttatacgcttgatgtcctcctcagtaataaaattatcaagatgttccttactgtaatcgcattgtgacagccagcctccgatatcgatgccgtgcatatagccattaaatcttctcatatttttaaccgtcctttctgattctagttttgtttgcaactatatcgtatcactatatggctgaaaattatatcataattttaatattcgtgtaaaaatcgtaatgttattgtggcgtgctaaatgtatttcgcagtaaataaagcaaagaaaatggcgtaaaatttttcaccataacaagacctaataaaaaaatcgaattaaaccagatactttaatatgatactattttcgccgtcaatagtcgccaaaaaccgggcgtatcaaaaacatcggcaagcagatgttttgatgaaatagaatacctgaatgtgactatccttgacacaaaaggcaagtcgagagcaattacaattccgcctgatgtaaagcagctttggaaacagatacagcatattttgagagaccctgttatcagaagatatgcgtttcctgatgatattcacttagagaaaaaagccggcattacagctttgtgtgagtattcattgctgtcagataatgattaacctacctatggggtgacaaaaaaagaattgattttctgcccctccccttgactaatattatcagctaatgtataatcaagtaaagtataaaaatatcgaggtaagatcacaatgagtagattccctagagtatacgctgaaagcacaatagcaagaatgaataaaaagcttgccctgccacaggaaacaatgtcgctgctttatgattactttgaagcttttgctaatttgtatcagctattgccgctaaaggacgcttacaaaataatcagcaagcaaaacaaaggcttgataaccttagacgagttcattgcattttctgagatagcacgccacgaaaatcatttttactacattcttgccaaagacgaattgtatcttgacgcacctaaggaagagcctatcgaccgagagatagttcattccagcttggtagatgttgactatgagtattattataatatggccgatcatcaggcaggtaaacctcttaaaattcttccgaaacaggaacttcttaaatacaaagaggaaatgtacattgccgataccccttatgtaagagcaatgatggactttttacgcacaagactaaaaatgtccgaagaggagatcaactatacaatttccgattttatactgataataacctgtgatgacaagccttttgacgcagtatctaaaatgctcgacagaaagaatattctaatgacaaaaagtcagcttgaagattttatcaaactgttcaccgatttgagcaacaatactcgaatgccgcaaaacagaggctttactcccctcgagttatcggcaaatcgtggcgatcaaaaagttatcaacagcatttcctttgggccaaatataactgctgcattgaaaagcggagaagtggatatcgaagaatacaggaaaacaatatgatgaagagtttaaaaagcaggcaataaagctcgcaagcttcaggcagcaaacaaacggatcaaagagcttgaaaagaaaaaccgtgagcttgaagagcttaatgaatttctggaggaagcatctgcttttttcgctgcgaaccgtcggaagtcaggaaagaagaacggttaaagttcatttccaaaaagactgatgacggtaggatctgacccgccccctgtcaagtagacagcgcaaaaaacaaaaatattctatgttgtgactaaaagcagtctgtgcaattctcctgtttctttcttttattataccactgtcacgatgttttggcaattttgtgttcagtttctagggtacattatattttataaccttcatcgcaccattcaaacttgaatttttgattattgtttcctgtataattatacattatcaaagacgcccctggattagtggagttgtcttttacattcatatagtattccggataaataccgaccattttagtaagataatatgtctctccatcaaggaaatcgtatttatcacctaaaatgtcaggtttatccatgggatacggatcttcaatatccgaataaccgtcaccatctgaatcgtcattactttcaggattagaattcataataaaataataaccagcagttacttcctgctctttgtgatccattataatagtcttataaatcggtacaggttcaatttcaacaccatcttttaatccgtctttgtcagtgtcaggcaaatcatatctagtgttaactatctgtccgttctgcactcgtataccagctaattcaaaaacatcatacaaaccatcaccgtctgtatcttttgtatcaaagaaagtatccaatgcaatttgggaataaatatcggctaaatcattagttgtaatggctttgtagaattcaccatgagtcatctttgccatatgttcaagtgttttatcatcagaacctaagccaaacccaatagtgtagatcgaaatatctaaactatccgcttcttttaaatatgaatcagaaatattacatccaccatcagacataaatacaatcattttttttggagcacctgtctgtgtttttagtagttgaattgattgatttatcgacgcatcaaaattattacctccggtagagtagatattattcaacgagtttaacaatatgtttttctgacccacagaagtaaaattacaaagtatctgaggcctgctgtcttcagccaaaatagctacattatctttattccttagaacattaataaacgattcagctgccttttttctgcctgcttcatatggatcgttgtattgcatactacccgaacaatcaatgaccaaaactgtgcttaatccacttggagcataatcataataactcggatataattcagtagaccatgctttgtaccattcttccctattaactatcatatacttactgaagtgtgtagtctccacacttacagtagagttctcctcatcaagcatagtgtccaactcaacaaaattgtcattttcttcatcataccataaaaatagcagattgtcaaattcggtatcgccaagtttagacttgtcgatcacataagtaagcgtagccttatcaaactgcgaagtcgttttgatttcaaaaggctcgcccacaagacctacaacctctgagcagagtatatccttgttcataatgctctcaacggttgtggttttctggagattacccgtgccctccatagatacacgaacctctgtaacggcacaatcctcgttttcaaccttgtgaataaacgtctgtaaacgcttttcatcaccgtcaagaataccattttcgtttgtatcgggatttgtaggatcagtttcaagatagatttcatcgccgtcttctaaaccatcgtcatcggtgtctttctttagcggatcagtattataagtattgatttcttctccgtcattaagtccgtcgccgtccgtatcatcattataaggctctgtaccaagttcatactcctgaagatttgttaatccgtcttcatcaaaatcctcatcaccgtctgtaattccgttttcatctgtatcaatcaaagtcgggtcagttccggtaacaaacacctcataatagtcatcaagaagatcaccatcggtatctaccaacgtgctatcacttccaagatactgctcaacgcagtcaggaagcttatctccatcggtatctttgagaagctcccaattattcatatcttcaaagaaatcaggtaagccattgtcgttttcatccttcatatactgccattcatcgacaggtatatccaaaggctctgaaacagtgccaaccaattcgccagcattgccactatagttagcgtttacgcttggacagttgaaagttattgtatccgcaataatgacaacattattgagattcagattctgagccattatctcaacgttgccgaaaggagcatataccagaccattaagattaacgttctggctgtcaatcacaatatctccatactttgaaaagatgacagaattgtttgtgttttttacctcgccgttaagggtaacatcttcaaaggctttaagcgccgtgttgatatttatgttgcctgtaagagtagcattaccctcaacctccagcggatcattgatgtttatgtttatttcttcaagagtgtaatcctgtgaatattcatcaatattattgcctgaaaaataggctgaatcgatcttatcaaagatatatatcatttctttgcctgcattctcagttttcgtaccattaacgttcaaattcccatttgaaactattgtgccgtttgtcgctatatttccattcacacagaaattgttagcattaatggtgatagacccctctgtatcagaagcggcaaacattgtgtagggatacttttctgctgcctcctctgctactgccggcaaactcggtaaaagagttgccgccatagctacactcattacgccggaaagtattcgtttaaagtttcttttaaggttcatagcttctcctctgtttccgcaatacgccgaataaactccatatattcggaatactgcatattatcagtccgtattgtaatcgttcaatattggttctacgtcagacaaacccaaaattcatataccttagtccattggaatcaccaagcctctctgcctaaagcataaactgtaaattaatacaaaacctccgcactgtaaacagtgaccgtttcgtaagatgtgcccttgtagacctttgcaactgttttaacacggtaggttccgctgccaatcggcgagaatgagttaggataactgcaataccagctgttaaaagttttgctccagtcggttattttgcgccatgacattccgtcttttacctgcaaggtctgagttacaacgattttagttgttgttcccgatattccgtaaactgtgcttttacaagatgctacaccgccggaaatagtcaaattacaattgacactatccgtatacaaataacagggagaaacaacactaccattatcaggcggaacagcagccgacactgtagctcctccaactgagcagaaaacaaggcaagccataaaaatgggtacaatttttttcataatatctcctcctacaaaaaatgagtgcaagagaaatttttcctcttacactcttaatgacaacaaaatattcggctttatgagctgtttttcaaaatttatttcaattttgtagacttgcacaattccagcacatcgtctttgttcatattgctttttatttgtaagatatacctaccattatcccacataatacagaaatcatggttggtactttgaataagatattcctgtcctgattcatcagtgtagtattcaagttcagaatgttcgttatcaaaataacctgagtaactatcatgaacgaattgctcgaaaaagatatatttatcaccattaaaataagcggcgaatattgttccgctatctcggttataatcagataattcaaaaccgtcgggcagatttgagatcgcatattcttctttgatagttgccggataatctttttcagtagcgttgtttaccgaaacggcagtgtgatctccgaaaatactcataaagaaatcattaaccgcctcacgtaccgcttcaacgctcagtgaagatgccgacaaaattattatggcagccactatacacgccgctcgccttcctccggtacatatcagattaaaatacggtttattccttcttcgtataagtttgtccatcttacgttcgaacttttctgagaactcagcattaacatcaaaatttacagagtcaataaattcatcaagcttaggttcaaaagcctcgcctatagctcttgataatattgaatagttatccattataaatgccctccttttcaagcagctttgcaagactatcctttgcgtgctgaaaacgctgtcgtgacgccgcattggaaatatgcagtgctaacgaaatctcactgtacctcatgccaagagtgattctcaggtaaagaatttcctgatcggtatatgaaagccgcttgatacaatcaactatattatcgtaatttctgtcacaaagcgtctcgtctgttaattcgggaatatcttcgcttaaattcatagctttaatgtgttccttttcttttttcagtaaattcaaagacacgtttctaacagtaatgacaatataatagtccaatttgtgagattctaaatttttaattttttgaaaactttttgcgagactaaaaaagtctccgaacaagcttcttcggctaacgttttatttttcaaaatattaaacgcaatcgcataagccttagacctattttgattatataaatcctcaaatgatttcttatcgtcttcgttatcaattaaggttaagtatattgcaagcataatgccccccatttatttttgtttatcattttcatacagcaaaaccaaaaactccgccaacgcccgtaatttcgccttaaactcgtcagatatttcaacggattcctatgctgtcctaccctccaaggcatccttaaccgcccggttacacaaccgccaccatttcagcttactcccgttatgatattccttgcgaagaatctctgttgcagaattaacagccttgtttacagcgtttctggtgatcagcatatagtccgcaatgtcgttaacggaggtctcttcatacccgaatgcaccatattttctgccgagaatttctctgtccctggctgataagttttcaaacaattccttgaaaagctcaaggctaacttcaatgtaaaccttgttatcggggtgcagatcgttaacgacaagcccaggattttcaatgtactcaattccgttctctgtttccgcccgtatcatcagcgtttccgttttaaaagagaatgacagacagctttgaacggttttcctgtccatgccaagctccttggatatatccgaatttgacataccttcattatgcagcttgcggcatctttgtatttttgagaaatcggaatgtgaaagtcctgccggagaactgaaattttcaataaactcctgcattgcatatcgaagttggggagtaagatatgtcagtagactgccctttcttgcgtcatatttttttgctttcagcttttcaaagaacgtcaaactgccaacctgaacaaggtcttcaaaggtatcgctgaaacgcaaataatttttgtagtcttttgcgaccgcagcagcaacgctctgtatgaacccgacattctgctcgtacagatcatataaagcttgcatattaccgtcataatatttcgatatcagttcctcatttgtcattcttaaccgcctttggtctgcctctcttcggaacgtcaaaaccgcataatttgtaaagattttcagactgcatttgctgttcaaattcctcattgctgaattcgggagaggtcattgctctatggtacagttcttctgcttgtcgcagaagaacagatttttgtttttcatcaataacttttctctgatagcttcgcataaccctgttaagacagcgccgatatgactgatatttcggattatccgcattttcttccttaattctgaccgttctgtaagccatctgattacaggtaaacctcggattttcaggcgcagccttgtcgcagtatcttgttttgtagcctttggtcataagaaagaatcgtccgcaatgttcacatctgcgtatatgatgtcctgccataagaccttttagaaaatcgacctttaaaaagctctgcaatctatcaacatggtagtattccgcaattacatactctccgcagccatcggttatttctttggggatcatattcatttcaagaaaatcagcgcttgtatacgacatatattcattcatgataggatttgcaatcatcttgtacgccataggatttgtaaggaagtcgtagtaagcggcggcaaaattttcgggatcaagctttttaagatgtgacagaaaatcgttcacaaagtaatacatagtcttattgaaattaaaaatatcatcgatcacaggcttgtaaagacttgcggtcttgtaataaagctcccagttttcggaattcataattgtgccgtccatatcagtaaatcctttgaaaaattcgacagcattctgagtatcaagaacctgaaatattttatgttttttcaaagccgtatctatttcgaccatcatgctgttcagcctgccccactccttttttaagggcggtatatattcaacggaattatccttttcagcattgatttcatggttcattatgtattccgccgatctatacttatcatatatctcttcgaattcggaaggaggtatattcatacatgatgccgaaagctcgcccaataaaaagtcctgaccgttgaccttgatcatatttcctttgacataaaaacaaatatcgttaaacataattacacctcaaggctgtcgtttttacagtttccaaattaagtatatcatattttgtcgtaatatgcaacagaaaatgtcgtgttgagtgaaaattaaatgttacgtgattttattcattttccggatttccgcatataataatatcagagagttaaaaacgcgccgcagaaaactaaatctgcggcgttttttgtttgcagaaccgaggtcagcggctttgcatattaaaaggaggtcgataaaatgaaagaattaaaaatgtacagcagcgagtatattatgaacactccgatgaaaccgattgagtactgcgtggacggattgatctcgcaaggcttatttattctcgcgggtgcgccgaaggtcggcaagtcgtggcttgcgctggatatgtgcctgtccattgcaaaaggagaaaaggttcttggaaaagaaacgtcctgcggtcatgtggtataccttagtttagaggacagcttgatacgtctgcaaaacaggttgtacgaactgacagacgatccgtccgataatcttcattttgcaattatggcggagtctatttcaaacggtctgcctgaacaaatcgaatactgcaggaaacggtttgacgatttgaaaattgtgttcattgacactttacaaatggtgcgtaacgaatcggagtcgagctacagttcagattacaaagagttatctgtgatgaaagctcttgccgataaacttggcatagctatagttctggttcatcacacacgaaagtgttctgacagcgacccatttaatatgatttcgggcagtacaggtttaagcggttgcgttgatggcagtatggttctgattgaaagcaagcgtggaagtcgaaaagctaaactgtattgtgtaggtcgagatattgaaaatcaagagatcaatgttgtgtttgaaagcagcagatggaaagtgtctgatgagattaaaaatatcgaacccgactatttttcatttgctgttcacgattttatggtaactcagaaaaagtttaaaggctctgctactgaacttgctgaaaagttatcggctctgcttcacaaggaagtgttctcaaatcgtgtcaaaaaagatctgattcagcacgcttatgaattgctggattacggagtgacgtttgaatccaaacgcagtaacggacaacgaataattattctgaattacgatatgaaaagtgacagcagtgacggcagaaatcttatgccggaggtgtgtgaaaacgctgaccctgctgtcacttgcggtaacagtgaaatgcttgaaaagcctttaaatacgttgcttgcgattgatgagtacgaagttgaggcagaaaaatccgctgtcactgtttgcaatcctactgaccctgttgatattgttactgacactgatgacaatgcaaaggtttatgaagtcaagttaatgagtcttgatgaagtactgcatatgtctgctaataaaataagaagtcagcttgcgaataaggggattgaaattccgccgtttgaaacgcaaagaaaggcaacgtaagccgatttgcgtggcttgaatttttgtcgggtaagtctagcagaaacagcttaaaagccgacacaggctatttgtgagccgctgtgggcgatatgtgggagaggttttaattctgataataaaaggcgattgtcaatctgcacaaataccggatatgcagaggttaaagtaagcataactaataatttgcaagttaaagcgacggtgtcgcactcacagcggacagcaaagctgaccgcaatattttgccgaaattacggaggttttcggctctcgagtaaaaggagtcttaatttgcaaaagtatgaaacggaggtgtcgcagcaagtaaaaaatcaataaaaatgcggaaatatcgccctttggagtgtgcaccaaaaggtaataccgcaggaaacggaggtaattatggcaaagaaaataggaataagcttagacaatgaaactttggaactttgtgatgagtatgcggagaaaacttcgcactcacgttcagaatttatagccaaggcgataagggagtatgtttcctcaattgaagtcggcaggcagaagaatatcatcgcaaaaaatcttgcagatgaaatcgtgaaaggtagcgaggcagggataactaaaatctcaaaaggcttgttcagatacgcagttgagctagaaattgtgattatgatactgtcggagctggctgatattcctccgaaagttatagcggagtatcgcaaggaggcggtgcgtaacgttcgcaggacaaggggtaaagttaaccttgacgatttgattgcaaggaacaaccgtgaatttgccgaacaaaatatagctgaaaattcttgcgaatatggcgaaggtgatgttatcgttaacgcctatgaggttgatgataacgaattgtaaaatcggtgcgtatcaaattcgcacaaaaaatttaaaacgaaaggactgaactgatttgtttacacgaattttctcaacatttgttccgatatatatcggagagcaggaggtatatggacacaaatattatagaaagaaacgaaagctgttgctccggcagcataacgcaaactgaggataagtatatcaaaagtcgttccgagatcattgacggaactgtttacaacatcaactcggtgtttgatatgacctcaaaatccacagctgaggacaagctgaaatatttgctgagatccgccgctgaaaaattatcataaatttatagattatcgctggactttcagaatcgattgtgatatactatctgtaatctcaatcggtttgacagagtccgcataatggacggaaagagaggttaataatgtcagacacgaataagataacggctttgtattgcaggctcagtcacgaggatgagcttgcgggagaaagcaacagcatttcaaatcagaaagatatacttcaaaaatatgccgatgaacatggattttacaacaccgcgttctacattgacgacgggtacacgggagtagatttcgaacgtcctgcattcaaacgcatgatagacgatgtggacaacggcaggatcggcacaataattacaaaggatctctcaaggcttggtcgaaatcatctgcacgtaggattatacacagaggaatattttccgcgcagaaatgtccgctatattgcgatcaataacaatattgattccgataatccggattcctccgctgtcgatatggcggcattctacaacatttttaacgaattccacgtcaaggatacaagcagaaaaattaaggcaagctgtgtaataaaatccgaaagagggcagagagtcgcttcacgtccgccttacggttacatgaaatctcaggaggatcacaacaaaattctgcccaatcccgaaacagcgctggtcgtaaaatatatttttcaactatgcgctgatggcttgggtccggctcagatcgcgcacaggcttgaggaagaacagatatacactcctgcgatgtacgagtacagtcaaacgggaaatgttatttctaactttgatacaagctatccctaccgctggaatccgaccgcagttgcaaatattttggaggacgtcagctatctcggacacacttgtaatttcaggttcggcagagcgtcatacaaagaccatcggaaattaaagctgcccaaaagcgagcacaagctgattgaaaatactcatgagccgataatcgacattaatatatgggagatagttcagcgactcaggcagagcaagcgtaggttcacaaggagcggagagaaaagtatttttgccggaatagtcttctgtgcggactgcaaacagaagttatattttcacagacacgcaagagagaagtctgaaaactggaaatttatctgttcttcgtatcgaaaaaatagtcgggaacaatgtaccatgcacggtattaaggaaagtcatctcaaggaaatcgtactgcatgaaatacggaatgtgactgcgtttgcgagagaacgtacagatgattttgctgagtatatcagtcgggagtcaaatactgctgctaaaaaagagctgtccgaagctaacaaaaaactgaaaaagagcgagaaaaggcttgccgaggtcggaataattttcagaaagctgtacgaagatcacgttcttggtacgattgatgatgatcagttcagaatgctgtcgcagggatacactgatgagcagaatcagcttaaagcggaaatatcagacttgaagcatacgatgcaggagcttcaatcccagacggctaacaccgcaagatttgctgcgcttgctaaaaagtacacagatattacagaattaactcaggaaatcttacacaagtttgtatcgcgcatcgaggttcacgaaaagctgaaagacgataacggcagtatcacgcaggaaatcgatatttactttactcatatcggaattgtaaagtagacaaaaagaaaacggagagcattagtctgaataaatcagatgactctccgtgatacataagtttagggtcgttccctatttgtgccgcgataatacgagcttttcgaggtgtgcatctattttattgcacaagtatggcaggggcagaaggattcgaaccctcggcacgcggttttggagaccgctgctctaccaactgagctatacccctagataaaaaaatgtggtggaccatcagggactcgaaccccggacccaccggttatgagccggttgctctaaccaactgagctaatggtccacatagagcaaaaaaatagcaagctttttgagaagcttgcataacgacctcacgcaagcgagaggaaatattggtgacccgtgggagaatcgaactcccgatgccggcgtgagaggccggagtcttaaccgcttgaccaacgggccatataatgctgagctgcagcatataaagaaaaaccgcagcgagcaaaaatatatctgcccgttacgggaaatttggtgcaccatcggggactcgaacccaggacccactgattaagagtcagttgctctaccatctgagctaatggtgcataggtgtcggcagcaccctatcttaccgggacgttaccatccaagtattttcggcgaagaagagcttaactactgtgtcttgtttgacgatgtttaattgttgagggttcagatccttttttaacgaaaaagcatctacggttttacacctgaaaatttcgctctcaaaacgcaaaaaaagctcgtaaatacgagcttttcgaggtgtgcatctattttattgcacaagtatggtgggagaaggtggattcgaaccaccgaagctagaagcaacagatttacagtctgccccctttggccactcgggaattctcccatatgaatgaaaacaaaataatggagctggtggacggactcgaacccccgacctgctgattacaaatcagctgctctaccaactgagctacaccagcttgtattgcttgatctgtcgaactgacgatatctattatatcatatctccaagcacttgtcaagcactttttattttgttttcatttttttaataaagtggtcgaggcgacaggacttgaacctgcggcatcttggtcccaaaccaagcactctaccaaactgagttacgcctcgtagttgacgttgcacacggtggggaaaagtctccagccacggaaaagttccaagctttgtgtgccttgagcttcatagatgtttctgtgaagcatttgtctgcgtcatcagacagcttaattattatactccccaatgcctgttttgtcaataggttttttatcactttgtatacttgcacaattacgccccgcttaaaaacgatacaaatatcattattcaacaaattataccgcgatatcatacgaaaacatcaaaaataatgtccataaaagagccttttttaaaagaatggtataatttgatgatattttggtgaaacctgttgatttttaaaatggtttgtgttatcattatatttaacagataatattcgggaggaaagtaaaaatgaaaacaaaggaatgtcctttttgccataaggaaatatccgaagaagcaatactctgtaagtattgccataacctgcttatagacgaaagcacacctgttacggaagacagcaagcaggaggagcagaatttcacctctgctgacgatgctgacagaacaagagtgttcacaaagcaggaggcacaggagtatgaagagaaaacaagagcttttaccgtgcctaaacagccggaagagcctacagagtttttctccacaccaatagctgatagccatgataataatgacggctgtgagaattatcaggataattatgataatggcggctattctgacgatgaaaacgattattccgatgatgatacagaggataacgatgacgcttccagaaagaagctctttgcaattactgccactatcacagtgggtatacttgtggtggtcattcttgctatagttgcaggctataagatcttcggttttggcggaacaaataataagaccactactactacaaagccaaaaacagctgttgccgctgatgacgacagtaagggaggcgtgttcgtcgataccgagagcagtgcagtttctgctgacacaaataccactacctcacagccggctgacgaaagctcaacaccagccaccgaaacctctgcacctgatacagaaacaacgacaactaccacaacaactgcctcagatacagaaactacaacaactaccacaactacagcagactcaaagcctgacgaaactacaacaactgcatcagccgagagcggagattctgcaaaggctgtcgccgctatcacagctcagatagacggcaaggtgtcttcatatgaatacagaactgaggacgcaggcttcatgtactattacgtctttacagaagacggtcatggctacagcgccgcatataataaggcagacggctcagttgtacttgtacagagctactgattttaaatagaatatcaccgattttacaaagtgcgttttccttgtgagaacgcactttttttgtttatacaaacagattttacattgtgcatagcagtgtaaagcccgtttttgtgtgtaaattcctttgcaaacatcttacaatgactttactttacttcggttactgattttacaatgctgatgtatcataagtatatcacctgaatagaaataacatgaagacctgcacacagggtgcagagagaaaaggtgcaaatcaaaaagcccaaagggcaagtataagaaagaggttttatatcatgaaaacaagaacatcaaaactggcagcgatctttacatcagttgcacttgcagccacaatgctcgcaagctgcggaggaagctcagataagatcacagttatctcccgtgaggacggctcaggaacaagaggcgcattcatcgagctgacaggtatcgaggaaaaagactctaacggcaacaagaccgataacacaaagaaagacgcccttatctgtaagtcaacagacgttgtgcttactcaggtgtcaggagataagaacgctatcggctacatttcattcggctcactgaacgatacagtaaaggctcttaaagtagagggtgttgagccttctacggcaactatcgaaagcggtgattataaaatagtaagacctttcaatatcgctgttaaagacggactgtcagacgccgctcaggactttgagaactatatcctcagctcagatggtcaggatatcatcgaaaaggcaggctatataaagatcgacaagagcgcagcagcttacgcttcaaacaacgcttccggtaaggtagtagtcagcggttcatcatcagtaacaccggttatggaaaagcttgcagaagcatatcagaaggcaaatacaaacgtaacagtagacgttcagcagtcagactcctcaacaggtatcaaggatgctatcaacggcacatctgatatcggtatggcttcaagagatatctcagacgacgagctttcacagggtatcaagtctgtaactatcgctcaggacgctatcgcagttatcgtaaataaggataacgcagttgaagatatcacaatggacgagataaaggctatctatacaggctcaaagacaacatggtctgacgaaagcaaataagctatcaagttaattctccataaagatttgcacaagacaaaactttgggcggcacagcaaattgtcgccccatttgtctgagcaaaaaaacaagtgaaaaattttcagaggtgataattacgttgacggaaaacacagcggtggcagcgactacagccgctcagaagccaacagcaaaacaaagttcccacctgcttgagaaagcgatgaaagcattgtttttcctttgcgcctgcgtttcagttgcggcagtaatagtaatatgtatcttcatgttcgctaaaggctgtcctgcaatcgccaaaataggcgtggggaacttcctcttcggaacagactggagtcctagaaacgtccctgcttcatatggtatcttccctatgatagtcggctctctctactgtaccgcaggagcaataataatcggtgtgccgatcggacttttaacagcgatatttatggcaaagttctgtcctaaaaagcttttcaagtggctcatgcctccgataaatcttcttgcaggcataccgtccattgtatacggctttttcggcatggtagttgtagttcctattataagaaaccttttcggtggaacaggaaacagcgtgcttacagtttccattatcctcggtatcatgatacttcctactatcgtgggcatgagcgtgagcgcacttaaagccgttcctgacagttactatgagggcgcagtcgcccttggcgcaacacacgaaagagcagtggcaacagtcgttttccctgccgcaaagtcaggcatactggcaagcgttatccttgcagtgggcagagcaataggcgaaacaatggcagttatcatgatagcaggaaactccactatcattccacactccctcatggacagcgtccgtaccctcacaggcaatatcgtaatcgaaatgagctatgccgaaggacttcactatgacgctcttatcggaacaggcgttgtgctgttcgtgttcattcttcttctgaacctttgctttaaccttgtcacaaacagaaaggataaagggtgataaaaatgtcagacagaatgaaaacctataaaacacaccccatgtcattggtgtttaatatcctaaccaaaatagcagttgtgcttaccataagcgtgttcgttcttatcgtgggctatgtggtgataaagggcgttccttatctgaaaccgtcccttttcgcaaagacctataccaccgagaacgtgtcaatgctccccgctatcgtgaacacctttgaaatgcttctggtgtccctggcaatagccgcacctctgggcatattctgcgcaatatatctcgttgagtatgcaaagaaaggcaataaattcgtcagagtcataagacttactacagaaacactttcaggtatcccgtccatagtgtacggacttttcggaaatatgttctttgtgcttgcccttaactggaagctctcaatgctctcaggcgcttgcacattggcgataatggtgcttccgcttataatccgttctaccgaggaagcgctgaaatctgtagacgacagcttccgtgagggcagttacggacttggcgcaggaaagctcagaactatcttcgttatcgttctgcctcctgcaataagcggtatcctctcaggcgttatccttgcaatgggaagaattttcggtgaaacagccgcccttatctataccgcaggaactatcgccaagtatgcaggccttacagactcaggacgtaccctttctatccatatgtattcactttcaaacgagggactttatatgaacgaagcaagcgctacagcagttgtcctgctggcagtagtcctgcttcttaacggacttgcgtcccttgttgccagaaagctttccaaaggaggaaactaataaatgacacagccaaaactgcaggtgaaaaactgcgatctcttttatggagattttcaggctctcaaaaatataaacctttctataaaggaaaaagaaataaccgcattcataggcccttcaggctgcggaaaatctactcttcttaaatccctcaaccgtatgaacgacctcgtagagggctgtaagataacaggcgattttacccttgacggggagaatatctataaagatatggaaataaccgagcttagaaagcgtgtgggaatggttttccagaaaccaaacctcttcccgatgtccatatatgataatatcgcatacggcccaagaactcacggcataaagaaaaaagccgaccttgacgagatagtcgaaacaactctccgtcaggcttccgtgtgggacgaaacaaaggacagacttaaaaagtcagccctgggtatgtcaggcggacagcagcagcgtatctgtatcgcaagagcacttgccgtaaagccggaggtgcttcttatggacgagcctacatcagcccttgaccctatctccactatcaaaatagaggagcttgccacagagcttaaaaaaaattacactatcgttatcgtcacccataatatgcagcaggcgacccgtatatccgataaaacagcctttttcctccatggcgagatagtcgagttcgacgaaactcagcgtatcttctccaatcctaaggaacagaaaactcttgagtatatcacaggacgtttcggataaacgctttggaaatataggtgaaaggaagaaatatctatgcgtgcgaattttgacaataagctcagcgagcttaacaaaaagctgctttctatggcagcaatgacagagcagataatcgcaatgtcaataaaatctcttgaagagcaggatacaaagcttgcccgtgaaacggtggagtttgacgccaagataaacgaggcggagcgtgaggtagaaaggatctgtcttaacttgctcttgcagcagcagcctgtttttgccgaggatctcagacgtgtgtccgctgcacttaaaatgataactgatatcgagcgtgttggcgatcagtcagcagatattgcagatctgaatatccagcttataaagaaaaagcagaaatgggatcttagcgacatcagtgaaatggcaagagccgccacacaaatggtgaacgacgctatcgacgcctatgtgaacgacgacgagaacctcgcccgaaaggtcataagctctgacgataaaatagacgagctttttgtaaagaccaaggataagataatcgacgagatagcagccgataaggcaaacggtgaaaaagctatagataccctcatggtggcaaaatacttcgagcgtatcggcgaccatgcggtaaatatcgcagaatgggtggtattctccgtaacaggcgtccataaaacagaaagaatcatgtaaaatatcattataaaaggcggaaataccgcctttttgctcttcttgtacgattttactcagattttactcagcctgatttgttattttacaattatgttgtataatgttcattgtaaacattgtaacaatagtgtaaaattattatcagggagtgtcagtatgacgatttttaatgttctgacccttataggcggtcttgcaatgttcctttacggaatgaatgtaatgggtaacgggctggaaaaactcgcaggaggaaagcttgaaaagatatttgaaaggcttacctcaaaccctatcaaggcaatgttgcttggactttctgtaacagcggtcattcagtcctcctcagccactacagtaatgctggtgggctttgtaaacgcaggcatcatgaagctccattccgccataggcgttataatgggtgcaaatatcggtactaccgtaacagcgtggatattgtctttgtcaggacttaacggcgacagctttcttataaaaatgctcaagccgtcctcgttctcgcctgtccttgcgataataggcgttgcaatgctgacgttctcaaaaaacgataagaaaaaggatatcgcatctatactcgtaggctttgcagtgctcatgttcggaatggactcaatgagcggtgcagtcgcacctcttaaagacgttcctgagttcgcagaagtgcttctctggttcaaaaaccctattctgggcgttcttgcaggcgcactccttaccgctatcattcagtcctcatctgcttccgttggtatccttcaggctctctcagccacaggtgcaataaccttcggctcagcgcttcctataattttaggacagaatataggtacttgcgtaacagcactgctttcatcaataggcacaagcaaaaacgcaaagcgtgtggcagttgtccacctctattttaatataataggaacactgcttttccttacagtgttctatctgctcaatgcctttatcggcttctcgttcgttgacggagttgtgggcgcaaaggagatagctgttgtgcatactatattcaacctgtcaacatctatcatgcttctgccatttatcaaagtccttgaaaagcttgcctacctcactgtcaaagacaaagagggggagggaaataaggacaatatcgaagagcagttcaagcttcttgacgagagatttctccagtcaccgtcttttgcagttgaaaagtgcagagagcttacaaaccgcatgggcgagatagcaaaagaaagcatagacatggcaatgagcatctgcgtcgataagtacgataaggaaaaggcagagcagatagccgcaaatgaagccgccgtcgacctctatgaggatagactcggcacatatcttgtaaagctttcgagccgagatctttctgcaaaggattctcagtcagtttcaactatacttcatgttataggcgactttgagcgtatctccgaccacgccatgaatatggtgtccgttgccgaggaaaaacagcagaaggatctgaatttcacatcacaggcaacagccgaagtaaaagtcatgtgcagtgccgtaagagatgttttggatatcgccatggaagcctttgaaaagcacgatctggagcttgccacaagagttgagccgcttgaggaagtggtggataagataagaacaaagcttaaaaaccgccatgtaaaaaggcttcagacaggcgagtgtaccatagaaatgggctttgtgttctccgatctgctcacaaatttggaaagagtttcagaccattgctcaaatatagcggtctgtcttatacaggaaaacgacgaaagctttgacgtccacgagtatgttcagatgcttaaaaattcaggcgagggctttgacggacaggtcaagcgctacagcgagaaatacgctctgcctgctaaagagttttaacgaaaaggggtaagatctatggcacttatatattgtgtagaagacgatgacggaataagagagcttatatcctgcgcacttaaatcaggcggatatgaggtgaaagcatttccaaaagcaaaaccgttttatgaagagataagaaacaaagagccttcgctggtgcttcttgacataatgcttcctgacgaggacggatattccatactttcaaagctcaaaaaagacagccacactcaggacgtccctgttataatgctcaccgcaaaatcaagcgagcttgataaggtgtcaggtcttgaaatgggcgcagacgactatataacaaagccgttcggcgtaatggaactgctttcaagaataaaagccgttttaagacgtgcaggcaagcagaatgccgaagctgacgtaatagaagaacagggcgtatcccttgacgcttcaagacgtatctgtacatataacggtcaggaggtcgttttgacctataaggaatttgagcttttgatgtatcttatgcgccataagtccatagccgtaagccgtgataagcttatggaaatggtctggggctatgagtttgcaggggaaacaagaactgttgatatgcacatcaagaccctcagacaaaagcttgaatccgcaggctgtacggatcttatcaaaacagtccgtggcataggctacaaaatataaaaattttcagataaggaggaacagcatatgcagaaaaaactctataaagtcatgacgatacttgtttcatgtacagtgctgtttttccttttagtagcaggctctcttggatattctacctatcagcgcttcactaaaaatgagcttaaatccgctgcaaagctcgttgccgcaggaaacaataaaccctcagaaatggctgatattttggaaagatcagtagaatatgatgtccgtgtcaccttcatcgacgcacagggcaatgtaaaatatgactctgaagcagatcccgccaaaatggaaaaccactcagaccgtgaagagttcaaagaggctacggcaaaaggcgagggcgaatccacaagattttccaaaacccttggatatactacatattattatgccataaaatatgacagtggcattctgagattttctacagataaggaaaaccttgcaggggtgttccttgcagtgataccaatgctggtggtgttcgcaggaggaataatctttatcaccaccataatctccataaagctttcagaaagcatgataaagccgataaactctcttgtgaaacagcttgacctgagaaacgagaatatcggtcagtttgaaacgccttatgaagaacttgaacctatcataaaaaatgcggacgttcttatgggacgaatacataagaacatgaataaaataaaggcagagagagaaaaaatatcacttatcactgaaaatatggttgagggcatgatacttcttgacgaggacatgacagtgctttcggtaaataagagcgccttgaaaattctcggcaacagctttgaccctactgagcataccaagatagaccatatgacaaacgatcagcagataataggtctgcttgaagaagccaaggaaagcggtgcagcaaaaggtatcatcacagaaaaaagccgtttttaccgtacctttgcaaataaggtctacagcgagaatacccttgattttggtatcataatcttctttgttgacgtaacagaggagatacaaagtgagcagatacgccgtgacttctcggccaacgtatctcacgagcttaaaactccgcttaccaccataaaaggctttggcgagcttcttgaaaacggcattttcaccaaggaagaggacgtgaagaaatacggcggtatgatatatcgtgaaagcgaaagacttttgtatcttataaacgatattatcaggctttcccagatagaggagcaggaacacgttttaaacgataagatagacctgctgaaaaccgcccatgacgtagaggagatactccgtcacaaggcagataatagagaggtcacaatgaccattgagggcgaacctgttcagatatacggcaatcagagctacatcacagaactgtttttaaatctcatggacaacgccataaagtataatcatgagggcggaagcctgaaagtaacggttggcatagaggacggcaaagctttcgcagtgttcagcgacactggcataggcatatccgacgaacatcaaagccgaatctttgaacgtttttaccgagttgataaaagccgttccaagaagataggtggcacaggcttagggctttctatagtaaagcacatagtcgcatatcacagcggtgagatatcccttgaaagcgaaccggataaaggcacgaccataacagtaaaactgcctttcaatgagcctgaaacacagaagatagaaatgaacacaggcacagaaaaataaaccgcaacgccgtactgaaatttttaggacggcgtttttgtgcaggtacatagtatacaagttattaaggggaagggtgataaagaaaggacaaaaaaacaagcgggcgaccaaaggtcgcaccagtatgtcgcaaaagtgttaaatcaacgggcgaacgctgttcacccctacaaaaaaaatcatcgccgcaggcgataccataattcctcattcctcactcctcattcctcatttacctcccctgttatgttacaatagatagttgacaaaacaaattgaaaaacaacttccaaaatgatataatgttaagtaccaccaatttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgccataaatttagcatttttctttctttttgaactttgtcagattgattatcaaagcaaaaagtgccataaaaagaactgccactacgagagtaactgtcgataatttaataaggctgtcagttaagccatacatggatcttgtgagtgcattatacacagtgtcattatgtatcgcaagcccatcataatattttgtaccctttaggatagcacacggaacaagaatgagcattgaggaacagaaaagtgaagtacctacccaataaagcaaaccgcatatatgctttctgtttactgctgccgtaacgcctataaatataacagccgttgcaataagagctatccttatttttctcgcaagcaaaagcagatctttaagctttgtggaaatgccattaggtttatttatatggctcaaaagcataacgtcaaggtcggattcaattgcctgttccacattttttattgtcttctgctttatgtcttcaagttcctgagtatattcaacgccttcttttttagcccattttgtataatcgtctgagatattcttttcaagaagcgtaaagtctgccttaaactcaggaagtccactctttttgccaagaatataactgaaagtatcttcaacatagctataaatagcgtttgatacatcagttttgttaatcgacttcttcagggtatcagcttcaacaccagtgtaggcatattgttgttcacaatatgtctgtatctcttcgaaagccgtgtcctcgatttttatcttgtacatactgttcgtataggttgtcggttcaaagaaaatattgtctgccgcaaacagaagtgacagcgcaaggaatataaacgccaaaaacagcgagattatcagattaggcaggtagttgtatagctttttgtttttcacagatcttaccctcctaattcttatattctttgcttacgactttgcagataacatatagcctctgatctgaaagacccatatagccattgttccagcaagtgtagagtatcagatcatctacaggtggatctgcggtcacgtcataatacaaaagggaagtatctgtgtctggaagtaccttagtttctgtgacctcataagtaaatttaccataatctgtttttagtatcacttgatcacccactagaatattaggtaaatatctgaaataagtgtggttatgtgccgcaaggacaactctgcctgtagcacctatatatgcagaatagttagattgcacaaccccttttgctaggagatcatcagagtctccccagtaaacaggctctttgtcaatgcctgccttatcattctttacggtcagctcggcatatttgtcgccgtaatacggatagattatctcatgctgttccgtctttttatcagaatctggcactgtgacttttgttaatcccttcataggcagtgcgtctgcatttctgtatttattatcctctgatgggtttttcaaatgagcgttctcattgaacgctattgctgcatatccttgcagctctatgaattttttataacttaccagcgtcatgatagacaaacaaagagccaaaactaaaagaggcgtcaagaccattacagccactgacgtcctcttattttttttcagtttgtttgcgtcagacgaggaagctttaacctctttcctgaccatatcttagcactctttgttcttcttaacagctactgtaataccaaatgcactaagagcaagtgtaagaaccgcagcaacctgaacagctgtcatgctgtttgcaccagtattaagtgaaccgttacctgtgtttgttccaatgtttgtattgccatctgaatcaacaacctgaacgttccaatccttgcttgtaagctcatctaccttgatagtaacaccaaagtgtttacctgtagctacgcaagcatcagcaatagcctttctgctatcctcgcccatttccttaaacacctgtctaagctgatcgtttgttagtgaagcaagatctgttcctgcaccaaaaagcttgtcagcaacaggctgaacatatgtagcaccacaatcagagagagcctttaccatgtaatcatagtcagcagagctgaactttgaagcgtgggaatcaaggtagttcttaagctctgatacatggttagaaggaacacctgctgatttagctgcagaaacaacatcggcagaagaagctgctgatgcgcttacaaccattgttgaagcaatgatgaacgcagtaacagaagccgaaattgacttaaatatctttttcataacacctatcacctttcgtaataatttcgtataacaatattatacactattaaaattcgattgtcaatatttttattggtatttttttcagaaaaaagcaaatatttttacgataatttgaaatagttatgtgtaagtgcgtatatgcgctatttcatgtaattgtatatcgctggaaaatgtaaaagatcctcggcattctcaaataaaagacgtataacattactgcattggtgcttttatgatttttgtcagagctgatctcaaagcatttagatataatttctacattaattattataattatacgccttgacacgatatcatgccatggtgtataattcttgtgtataatataattgatgtaatgtgcaaggaggatatatgaaaaattatctcaatgaaagcctttcagctcaggaaagagctgaagcacttgtaaatgaaatgaccgtagaggaggcggcttcacagctaagatatgacgctcctgctgttgagcggctcggcattcctgcctataactggtggaatgagggtatccatgggcttgcacgaagcggtgttgccaccatgtttccacaggcaataggtcttgcggctatgtttgacaccgaccttgtgttcaaagtggcagatataacctctacagaagctcgtgccaagtataatgagtattcaaagcgtgatgacagggatatatacaaaggtcttaccctttgggcacctaatataaatattttcagagatccacgctggggcagaggtcatgagacttacggtgaagacccttatcttaccgcagagtgcggcaaggcatatgtaaaaggcttgcagggcagcggcaaggtactgaaaactgccgcttgtgcaaagcattttgcagtacatagcggacctgaggctgttcgccatgaatttaatgcagaggttaattggaaagaccttgaagagacctatctttatgcctttgaggagcttgtgaaaaaagcaaaggtcgagggtgtaatgggtgcttataaccgtgtgaatggcgagccgtcatgtgctagtgagtttctaatgggcaagctcgacaaatggggttttgatggctattttgtttctgattgctgggcaataagggatttccacgaacaccatatggtgacgtcttctcctgtagagtcggccgcaatggcacttaaagcaggttgtaatgtgaactgcggttgtacgtatgtacacctgctttctgctcttgacaaggggcttgtgacagaagatgaaatccgggcttcctgtgttgctcttatgagaactcgcataagacttggtatgtttgacaagtcaacggaatatgacaacataccatacagcgttgtttcttgccctgagcataaagctgtatcctaccagtgtgcagtgaagtccatggtgttgctcaaaaacaagggtattcttccgcttgacaaaaaatcaatatcaactatcgctgtaataggtccaaatgccgacagcagagcggctctcgagggcaattataacggcacagccgacaggtatgttactttccttgagggtatcgaggacgcatttgatggcagggtgctttatgctgaaggctgtcacttgtataaggacagagtatcgggtcttgcacaggcaggagatagatacgccgaagctgaggcggcagcggcaaattctgatgttgtgatactttgcgttggtcttgacgccactattgagggcgaggagggcgacacaggtaatgagttttcatcaggtgacaagaacgatctaagacttcctgaaagtcagcgcgagcttataaagcgtgtcgcaaagatcggcaagcctatgatagtggtatgtgcggcaggaagctcaataaacatcgagcatgattgtgacgctcttatccacgcatggtatccaggctcagagggcggcaaggctattgcggatattatttttggtaaagtgtcgccatcaggaaaactgcctgttacattctataatagcgccgataagctaccttgctttactgattatgctatgtctgatagaacatataggtacacgagagataacattctttatccattcggctatggccttacttatggagatgttgttgttacatcgcttagttatgacgatggcaaagtcaatgtagaggtagaaaataacggtgccgatacttgtgatgttatcgaactttacattaaatcacattgtgataatgctccggtttatcctgtgctgtgcggcttcaagaggatttttgtcaaaaaaggtgaaaagcttgatgttgaaatcgaagtacctgacaaagctttcacaacagtgtcagatatcggcgagagaaaacagtttgcaaaagaattcaccctctatgttggtacgcatcagcctgatgaacttagttgtcagcttagtggtacaaactgtatgagtatcgagatagaacgataatgaaaagagatcttacaaacggcagtatcataagcttgcttcttattgttttggtgaaagaaatgaacgccgcctgaaaggctgtctgaacatatcatttcagatgataggctctgttactttggtgacagagcctatcacattgtgcttttccaatgagattttgaaacttttgcatactccaattaaaataatgctgttgacatctgattatgttagaattatcctgtcatgaattccgacatacttatgatacaaagactggtaaatagttttggaacgactgtaatggcggcttttacagtagccgttcataattgttaaattaagctgtcagcttatatgattttccaacaaatacttggctgattttgtttatcttattgtatgttataacaaaaaaccatttttttgttgaaatacaaaaaaacgtatcgtttaaagttgactttttgaatagaatgtgataaaattattattgtacggtttattttttgggaaaataacgaaaatatcaacaatagggtgaataattcaaatgaaaaaaaattacactatcaaggatcttctggtacttcttctcggaaaggtttggcatatcgttgccgcttcaatagtgtgtgcgatactggcccttttcgtatcaaaatttgttatgagtaagcagtatcagtcacacgtttcaatgtatgttaaaagtgctgataatcagtcaacgggtcaggataagactaatgttgacttacaggacattaacgcttcaaagtcattggtacagacctacattgttatacttactgatgacccggtaatgaacgaggtaagcgataaacttcttgagatgtatactcctgaacagcttgctccttattttactgtaacaagcggcagggtttcaaatgacggcctgagaaatgcttatagcatgaccgctgtaaatcagacagaggtacttcagataactgccacaacaaccaatgcaaagctttcttctgacctttgtaacatcatggctgacgtcgctccgagctttcttataagagttatcggtgcaggctcagttgaaaagataggtgatgctgaggtttacaatacacctgtttctcctaacaccactaaaaatgttgcccttggctttgttggtggcttgatggtggctgttctagtgatacttgttatcgacttcttcgacaacactgtaaagaattctgatgagcttggtgaaatttatcagaagcctatcgttggtgagataatgaatattggcggaaagacttctaaaaaggatgaaggttcttctgctgacagaaagaaacagcttctgttcaataataaggatataccgtttaatattgtagagaactacaaaacaatgcgtacaaaccttatgtttacactttctacaacacgaaataagatagttgtcgtttctagccctaatccaagtgagggtaagtctgtaacagttgctaaccttgcagcttcaatggctgaaacagaaaataaggttcttcttattgacgctgatatgagaagacctgttcagcacagaaacttcaagttaaaaaacaatgttggactttcaacaatactgagtggtgaaagcacatttgataagtgtgtgcatgaaaccaagaatggcaattttgctgttcttacatcaggcgttttgcctccaaacccgtcagagcttcttgcttctgagaaaatgcgtgaattgcttgaatatgttcagcataagtatgattatgttattgtcgacggaaccccgctgcttcctgtaactgacgtaatgagccttgcagatgaggtcgcaggcgttcttctcattgcaagatatggcagaactacatatcaggaaatagaggagtctatgaagaagcttgagataggcgattgcaatctgcttggtttcgttcttaatgatatttccgcaaagaacggttctcattacggatacaagtatagctacaagtataaatatgactacagctataaatacggtggtaaggatgcttctgccgaaagttaaatgacatggagatgttagattgactaccgattatcacagccacatactgccgaatattgatgacggctctgacagcatcaaaacatcacttaaaatgataaaaatgatgaaacagcagggcataggtataattgtggcaacaccgcatttttatatgcacagggaagcttctttagacagttatcttgtcaaacggcaaaatgcttatgagaagctcatggcatctgaccctgccgtgaaggatatacatattggtgctgaggtggctatagaaaagggcatcagcgtattaggagaacttgaaaagctgtgtatcagcggaacaagacttattcttcttgaaccacccttcactcagtataacagttggatcgtcgaggagatagacgagatagcaaattctcgaaggcttattccgataatcgcccatgtacatagatatatgggcgtttattcaaagtcagatctgaaaagtctgatgtctgtggatgcagtttttcagataaatgcagaagcttttgagcatttttccacaagacgttttgttaataagcttatttcaagtggcagagattttgtctttggaagcgatgctcatgatcttgatgatagaaaacctaattttgatcttatagctaaaagatctggaagtgaaaatataagacgttctgataaagtactcatgtctgctatggctgacgaagaaagaatgtttgctttttaagtatagaaaaaatattgatgatattataaatagcctgcactgtgccattgaggggtggccatggtgtgatcttattcattgctttaattgagcggaggtatgttttatttatggagaaaacaagtgaaaacacagttcaggtgtggaaaaacaaaaagataaaacattggatgcttattgcattctttctgtgtttctatgatattgttgccgtaaatctatcctacattttcggacttttcatcagatttgaccttactttttctgcaataccaaaggagtatatgcttgcctatgtaaagtttgctccaatatatacagctttctgtgttgtggtgttttttgtgttcaagctttataatagtttgtggagatttgctagcattggcgaactgtcaaggatatttttggcctcgatagttactaccatattccaggctgtgggtataacattactcttcatgagaatgcctgtggcttactatatagtaggagcgggaactcagttcgtgcttataacagcagtgcgttttgcctatagatatatcacccttttaagagcaaaacaggtaacaaatcaggtggcagtgcataatgcaatggtcattggtgcaggtgcttcgggtcagatgatccttaaagagcttacgatgtcagaacgtgcaaatgcaagaccactctgcataatcgatgataacccaaataagtggggaagaaatattggaggagttcctatcgtcggtggccgtgattgcattatggaaagcgtcaaaaagtataatattgatcagatcctttttgtaattccaactgcatcacctgagaataaaagggatatccttaatatttgtaaggaaacaggctgtgagatgaaacagcttccgggcgtttatcagataacaaatggtgaggtgcttctcagcaagatgaagcctgttgcggtcgaggatctgcttggaagagagcctatcagagtaaacatggacgagatattccagcaccttaagggtaagaccattttggtaacaggtggcggtggctctatcggaagcgagctttgccgacagatagcaggtcatgagcctaaacagcttatcatatttgacatttatgaaaacaatgcttatgaaatagagcaggagcttaaacgtaaatatggcagtaaactcaatcttgtgacgcttatcggctctgttcgtgacagcagacgtatcaatgacgtttttgaaaaatacaagcctgatatcgtttatcacgctgcagcacataagcacgttccgcttatggaaacaagccctaatgaagctatcaaaaacaatgttgttggtacatacaagacagcctatgccgctttgaagcatggcacaaagaggtttgtgcttataagcactgataaggctgtaaaccctactaatattatgggtgcaagtaaaagactctgcgaaatggtcatccagagcatggacgctatcagcaaggcaggcagaacagatcttctacctttgctccatgcacacgttgatgaaatgacagacggtatgcttgagaacgatccgatggacgagatagctgttgataatatagagagcagtgaagcgattaagatcgaaagcgttggcaataaggacagaaatggcacacagtttgttgcagttcgttttggaaacgttcttggaagcaacggctctgtgatcccactgttcaaaaagcagatagaagcaggcggtcctgttactgttactcaccctgatatcataagatatttcatgactatacctgaggctgtgagccttgttcttcaggcaggcacatatgcatggggcggcgagatatttgtccttgatatgggtgcgcctgtgaagatagacacacttgcgagaaatcttatcagactttcaggatataagcctgatgtagatatcaagatagtttactcaggtctgcgtcctggcgagaagctttttgaggagaagcttatggcagaggagggcatgatgaaaacggataatgagcttatccatatcggaaagcctataccgtttgacacagaaatgttccttggtcagcttggagagcttgctcgtgcaagctataacaatgacgaaaatatcgttgaaatggtcgaaaagattgttccaacattcagtcctgtaggtgataaaccaacaggaaatgaaaaatatggcagaaacgatgttgcagtttctgcggcgaaataataaaagatccatatttcagcactgcggggatttctgcggtgctgtttttatgcctaaaatttcacactttttcttgatgtgttatgttacaatagatagttgacaaaacaaattgaaaaacaacttccaaaatgatataatgttaagtaccaccaatccaaatgaaaagctgcaattagttacttaacattattttttgagaagatgtgtcacctatcattgacaactgaacagttgacggtattttcccgtgaatgttcgtattttgtgatgatgtgaaggatatttcagttgatgtttagtgctattgtataaaaatgcgattaaaatttccgcgatttatatgtaaaagtaaaagagatatgttcatatctcaaacgtttagtataaatattattcatagatatataataaatatgtatttgcattaacatcaaaatagtggtataataaatgggtataaaaaataaaggatcttggtaaactctgagatctgatagtaaggagtaatattaaatgggtatgacaatgactcagaaaattctggcagcccacgcaggtcttgacgaagtcaaggcaggtcagcttataatggcaaaccttgacctggttctcggcaacgacgttacgtcccctgtggctatcaacgagttcaataaagcgggctttacagatgttttcgataagaataaggtcacaatggttatggaccactttgcacctaataaggatatcaagtccgctacacagtgcaagacctgccgtgattttgcttcaaagtatgacataaagaattatttcgacgttggcgatatgggcattgaacacgctctgcttcctgaaaaaggacttgtcgctccaggcgactgcgttatcggtgctgactcacatacttgtacatatggtgcacttggtgcattctcaactggtatcggttcaacagatatgtgcgcaggcatggcaaagggaaagacttggttcaaagtccctgccgctatcaagttcaatatcgtaggcaagcttccaaagtatagtgccgctaaggacgttatacttcatataatcggcatgataggcgttgacggcgcactttacaagtctatggaattttcaggcgagggtctgaaaaacctttccatggaggacaggctttgcatggctaacatggctatcgaagcaggtgcaaagaacggcatatttgcagttgacgatgttacacttgattacatcaaggataaggtagacagagagtataagatatacaaggctgacgatgacgctgagtatgaggctgaatacactattgacctcagccagataaagcctacagtcgctttcccgcatctgcctgagaacgcaagaacatttgacgatatcccggaggtcaagatagatcaggtggtcatcggttcatgtacgaacggaagaatagaggatctgagatgtgccgctgagatacttgacggcaaaaaggtggcaaagaacgttagatgtatcgttattcctgccacacagaaggtatatatgcaggccatgaaagagggtctgctggagatattcataaatgcaggctgtgcggtttctacacctacctgcggtccatgtcttggcggacatatgggtattcttgcaaagggcgaaagagccgttgcaacaacaaacagaaatttcgtgggacgtatgggtcacccagaatcagaggtttatctggcttcaccttacgttgccgccgcttcagctgtgacaggcaagatctcacagccgtcggaagttatgtgatattcggggagaaaatcagctgacagatcttgcgttgggggaataattgatatgcggcatgaccgcatatacgacttgggagcgagaacagatgaaaaattatcttagggaaatattctccgatatacttcttagtattgttacaaagaagtacggaacttcactaaatgactatcagcgtgaggagaaggctgacgagatcattcaggaactccatgacaaaaatacatttaccgtggaaatgacgcaggctcttattgacaagaagggcttcaataccttttatacctccaatatcgggggtacacctgtgtatgctctcgttaaagagggaatgttccacaaggtaaagatctgctattttattacaagaaacaaggatactatagacggcccgtatcttgaaaagatatatgaagagcttagaaaacaggcgataggagaaaatatattccattcgtcagagttcaagcagggctgataaagtttgacgaaaggggttttcataatgaaagcttgcggaaaagtacataaatacggggataacgtagacactgacgttattatccctgcaagatacctcaacacacctgatatgcaggagcttgcacaacattgcatggaggatattgacgttgactttgcaaagaacgttcagaagggcgatataatggtagcaaaaagcaatttcggctgcggttcatcaagagagcatgcgcctgctgctatcaaggcgagcggaatatcctgcgttatagcaaagacattcgcaagaatattctacagaaacgctataaatatcggacttcctatcatcgagtgcgaggaagctgctgagaagatagataacggtgacgaggtggagatagatttcgacagtggcgttatcacaaacaagaccaagaatgagacttatcagggtcagtcattccctgagtttcttatcaatatcatcaacagcaatggtcttcttaactcacttaaataagatattttgaagctttaagggggatctctcaaaaggggtcgcccttgaactgtttctatgaaggggtgaagctatgaaagctaaaaagctatttgcggcacttgcagcaggggtaatgctggtgtgcagcgcaggctgctcgaaaaaagaggagagcagtaataaatttgaatacagcagcaaggattttctgccttttatggtaatggtggacggcagcaagatagacctgaccctaagctctgcagagataaacagaaagcttggcggcagttttgcaaggggaactgcttcaaacagcagtatagtgcttgtggaaaagaacgaaaagaccgataaaaaaggcgttacaacaaagacctttgcctgcaataagcctgagataaatggtgctggattttccactttcaacggactttgggcgaatatagacgaagcaagcatagacagcactgtttcacccaacagcataaaggtcaaaggctctgacggtttgtcttactactggtcatattatatggacggcgaggagatagactatagtcaggtgaactttgacggcactgatacggcggacagttatatgcagtatcagctcaaaggcatggctgctgacgattattgcaaaaagaagcttattgacggcgagtgttcggtctacacaggcattttgttcatgacagccgaaaagcagagctattcctgcgagataagcgtttcgactttaaattctgaggaggaaaaataacatggaaaagaaaataacagttataaagggcgacgggataggccctgaaatagtaacagaagcacagaaggtcctcgacaagattgctgaaaagttcggtcataagtttgtttatactgatatccttatgggcggctgttctatagataaatatggcgttccgcttacagacgaggctgtcgaggtagcaaagagctcagacgcagttctgcttggctctatcggcggaaatacttccacttcaccatggtataagcttgctccgaacctcagacctgaagccggactcctgaaaataagaaaagagcttggtctgttcgctaatctgcgtcctgcaaatctttatcctgagcttagagaagcttgccctcttaaggacgatataatcggcgacggcttcgacatgatgataatgagagagcttacaggcggtctgtattttggtgcgagaaagacagagaacgttgacggcgttgaaactgccgttgatactcttacatataacgagaacgagataagaagaattgctattcgtggctttgacatcgccatgaagagaagaaagaaagttacaagcgttgataaggctaacgttcttgattcttcaagactttggagaaaggtagtaaacgaggtagctaaggattatccagaagttgagcttgagcatatgctcgttgacaactgcgcaatgcagcttgtaagagatcctaagcagtttgacgttatccttacagagaatatgttcggagatatcctttcagacgaagccgctatgatatcaggctcacttggtatgctggcttctgcgtcactgaacgacacaaagttcggtatgtatgagcctagccacggctctgcacctgatatcgcaggacaggataaggctaaccctatcgctactatactttcagcttcaatgcttctgagattttctttcgatatggataaggaagcagacgcaatcgacaatgctgtcaagaaggtgcttgaggcaggctacagaacaggggatatcatgtcagaggacatgaagctcgttggctgtaaggaaatgggcagtcttgttgcagatatgatataacagcacgataccagttttcagacggtgataataaatgtattattatattttcggaataacagacaagggaaattaccgtgaacagaatgaggactgcattttaatagaccacgaggtcatcaacagcggcagctatgaatcaactgtcgctgctccttttattgcagccgtttgcgacggcgttggtggagaaaatgcaggagaggtcgcctcggagctttgtttaaggcatctttccattcttgaatataattcaggggtggatatgaaaagaacgcttatcgatgttcacaacaaaataaaaaagcagggcgtaagggctgaaaacgctgcaaatatgcagaccaccctgtgttgccttgcggtggacgaggaaagcagagcaatgtgcataaacgttggcgacagcagaatgtaccgctatgtgaacggcactatcagacagatatctgttgaccaatcctatgcacgatatatgtatgagcatggcaggatagaagatgtgtcagagcttgagccacagtatcagaatgccataatatcttctatcggcagcactctcaatgaacccgatgtggcacaaacaccgttggtggctgattttggcaaagaacctgacgatatgataatcatagtgtcagacggcgtgtcggattacgtttctgaggaagaaatggtggtggggcttggtcttgacctttctgtttctgaaaagcttggcgctataatggagcttgctctcacaaacggtggaactgacaatgtttccgttgtgggcataaagccttatcttgacgatcatgagcttaaaacgctcacagcaaaaaaggctgtggaaaagacagtgagcgtgcaggatatgcttgaaagtaagaagcctgaaacggcggaagctgtagaggaaaagaagcctgacgagcaggcaaagcttttctctgatacggtggacgagcttatgagccaaatgaatgaaagtattgactttttaaagcagatatagtataatcatatattgatatatttttatgatcttagacgtattttgtaatttggaggaaataaaaaatgttgaaagagttacgtggctcagacgttataattgaatgtttgctggagcagggcgtcgatacagtgttcggctatccgggcggagcagttctaaacatatatgactcgctgtataaatattctgataagatacaccatgttatcaccgcccatgagcaggctgcctgccatgcggctgacggatattcaagaacaacaggcagaacgggcgttgttatcgcaacttcaggtccaggtgctacgaaccttgtaacaggtatcgccacagcttatatggattctatccctatggtggctatcacaggaaacgtaacaagagatctgcttggtcttgactcttttcaggaggtagatatctgcgggataacaatgcctatcacaaagcataactacattgtgaaagaccctgcggagcttgctgacattatcagagaagctttctatattgcaaacgagggcagaaagggtcctgttcttatagatataccaaaggatatcacaggcgcacttatggtctatgagaagaaagagcctaagaaggtagtaaatcacaatcctgagggcataaacgaggagatagctgctgcggcagagcttataaagaatgctgagaagccttttatctacgcaggcggcggagttgtttctgctgacgcaacagaagaaatggctgagttcgtaagaaaagtggacgcacctgtttcattgtcacttatgggtcagtgcgcacttgacaatactaaggactgctatatcggtatgcttggtatgcacggcacaaagacagccgctatgacgctcagcgaatgtgaccttatgatagttcttggctcgagattttccgacagagttctttgcaacgctaagacatttgcaaaggataagaagatcatacatattgatatagaccctgccgagataggcaagaatatcgacgtttacagccatgttactggagacgttaagtatatccttgcaaagctttgcgagctgcttcctgatatgaagcacgaggcttggatgaatactgttatggattggaaaaagcagtatgcactgagaatggtgcctatcgagagcgaggacgaggtgcttccgcaggacgttatcgaggagcttgacagacttacagacggcaaggctatcatctccacagaagtcggtcagcatcagatgtgggctgcacagtattataacttcaagtgtccaagaagctttgcttcaagcggcggacttggtacaatgggctacggctttggcgcaggaatgggcgcaaaggtgggcaaccctgacagaacagtagtaaacatcgcaggcgacggaagcttcttcatgaactgcaacgagctttcttcacttgcaaagcataatataccgcttgttgagcttgttttcgagaacgacgttctcggaatggtaagacagtggcaaagacttttctacggcaagagattttctcagactaacattgaaagaggaacagaccttatgaagcttgccgacgcatttggcgttgagggcataaggataacaaagagatctgagataaagccaatgcttgaaaaggcactcaaatgcggtaagccgtgccttgtggacgttatcatcaacaaggatataaacgttcttccaatggtacctgccggcgcagacgtttcacagccgataatgaatatcgaacttgattaagaaatcgaaatatagggggtaataaaatggtaaaatatccaaatgccgcaagcggtatcaaaaaggtgtttctggcaaagatcataggtgtgataggagttccgcttgcttttatacctgggataggcgcacttcttttgatgacttgtaccgtagccgcaactattttcaacgtatggggaatacttgaagcttcaaaagaccataatggttatcagacagctcttgttttcacagtggctgatcttatcttttcaatagttgacacatttattgacaataatgcgatatcaagtgttctgagttttgctggcaatgtaatgaacatagcggtgctttactatatctgcaaatcaacaggcgacctgctcagggacgtgaagaactacgggcttgcaaataagggcgaccatgtgtggaatgtaaacaagacctgccttattgtcatggcagtgtgccttgttgtggcgtttatcccgatactgaacattctcgccgcatttacaacattggtggtgcttgttgtaactatctatgcgtctgtggtatatctgatctatctctatcagagcggacagtatctcagccttaacacaaatttctaagcgatttgagagctgtacggcaaaggctgtacagctcgtttttgtaaggagaaactaatgaaatttacaaaaaaattcaaagaaaatgcagcccttgtggttcttggcgtagtgcttttttggggattgaccaactatgataagttttttagacttctgggcgtaatgatcggggtcttgaagcctgttatatttggctgtataatcgcatttatcctgaatgtgccaatgtcaggcattgaaaagaggctttttaagaagcctaaaaaagagaaatatgccaaaactgtggaaacgctgaaaagaccatgctcgatagtgctgacctttctgctttgcctaggcgttgtggcacttgtgtgctggcttattatccctgcactcataaagactttctctcagctttcagacgatatccctgtgcttatttcaaatatttccaacaagctcaacaattcccctgagatagcagggtggcttgacagaatgaatataagcactgctgatattatcgataaggttacaagctggctgaaagacggcgttgtgatcttgaacacactcagttcaacagtaagctttgtgacagatcttttctctggtcttgtgaacttcttcttgggaatttgctttgcggtctatatgcttgccgcaaaagagcggctcaaagacctgtgcaagcgcataagctgtgcttttctcagcaatcgtatcaccgaccgcataagccgtatatgccgtcgctctatcgacacttttgcgaactttcttgtgggtcagaccacggaagcccttatcctcggctccctttgcggtattggtatggctatcttccgtttcccgaatgcggtgcttattgccatactcgttgcctgcactgcacttatccctattgtgggagcttttcttggctatgtggtgggcttcctgcttatatgcgtgacggatttcaagcaggctgtgctgtttttgttgttcatgttcattattcaggctattgagggcaatcttatctatccaaaggtggtaggaaactcggttggtctgccgtcactatggacacttttcgctatcaccataggcggaaacctctttggcatattcggaatgttcattgctgttcctgtgttctctgttatatactgcacttttggagaggtagtcaactacagaaatgaaaagagagctgtcaaggtggaggatatatcataataaaatagtccgtacaaaaaagtttgcacaatttcgtgcaaacttgagcttattgacaacatcctaaataagcgggacgtcgagggcgccgtcccctacaattaatgtaaatacgttgttatatgtaggggcgacctcaggtcgcccatttattatagtttttcgacacaaaaaaaggcgctgtaaaaaaaagcgcaacaaagcccgtggattccctcgatatggaagctcacgggctttaatatatcacacagcaaaaaagaactatctaatcttgaaaaaagggtacagcaaacacagcggcagaaatacagcgctttttgccgattattaaaatgttgaaaaatatctttttcaggctgcttttctgattgcgatcttcttcaagtgaaatttatgcagattaaaaccacagcaaatcatcgcaatttctaaattcatggcatttaagccacgtcttctggctctttttttggatggctatacaaagttttcgctgtcacgataatttttttcatttgtgtcttgacaagggggacattataaaaatcgagcttttcgtggtgcggatgacgggacttgaacccacatgaccttgcgatcactagcacctgagggtggagtaacgttggtgaaaataaattatgtttcaaaatacgaatgatattcaatggccttgtcactttcaggaaacagcaaacgatacagccctataaaatagtcatcagtcatagaggcaatataatccacaactatctgattcggttcttcagaaatataatcccagtcctcataatactggcagcttttctgtattgcgttgatatgatgtttgtatatacacgaatttatgtttttacttttaacgtcatcaagcagtttatagtacaactcattgaacattggctttattatttcgttatattgaccttcaattttttcattcttgtatatgtattcatagttttcttttttcgccgttttcagatcattaaacgcttgctcacttaaaataatgcagtcttttccaaagctgttgtttacaatatcaacagtaagattatttatcatctcagcatttttgctgccaataaattcagatgaaaacattgaatcgtccgataatatttttgccgttatcgcatcttgcctgtctttaccgatataggctataatatcgcagatccttactacacagccctctaacgttgacggaacaagtttttttattgcctctccaccctcagtataacagagctcaacattattgtcatattgctcaaatgtcaaaccctttttggggcgatattcattaagctcaaattcaccattgtgacacaatatcccgtctagtgtctgtaaacttatattacgcctgtacaaaatatcaagaacacgtgtactgtgaacattatgattgaaatgccgtccggtttctttctgcaaaagctcactaagataacgttctcctgcgtggccgaaaggtgtgtgtccaacatcgtgcccaagtgcgatagcctctatcagatcaagattaaggccaagcattcttccaatatttcggcttaaccgtgacacaagctgaacgtgcaggcctcgtcttgtgatatcatcattgttgtagaatgaaaacacctgcgttttatcgttatatctgttgtacaaaggcaaatgaagaattttctctatatcacgtccaaaagacggacgaagaacgctatttttgtccttttccatatttcttcgcacagcattttcgtccataaatctgtatggactcaatattccctttgatatattttcctttatctgtttctcaacagaactatcaagctgatgatattttaacgacatattttacctccgcaatcactaaaattaatgaacttctacatttcgatctgagttatatatcccttatccatttcatgcacagtatcgcacagcactgagatgtcctccgcagagtgtgagcatataagaatagtcttgccctgttctttgtagctgagcagatattcacgcatttcttttacaccgtccttgtcaagaccattgaaaggctcgtcgagaatgagtatcttcggattttccataatggcttgtgcaagtcccaaacgctgccgcatacctagactgtatttgcggacgtgtcgctttagttcgggatcaagtcctacctgtttcatactgctttttatctcatctttgccgatcttgttgttcagccccgcaagaagtttgagatttttgtatccactgtaatacggtataaacccaggtgtttcaataatgatacccatatctttcgggaagtcaacgtccttgccaacctgtttgccgtcaactgttatctcacccgatgtgggcttgataaagccgcatatgcacttcatcagcatcgttttgccgctgccgtttcgcccgataagtccgtgtatcttgccctcctcaaaggacacatttatgtgctttagtatctccgttttgccaagagtaagacacacgttgctaactcctatgatatccattatcattcctccccagccgtcagaaaattagttttccgtagcaaaactaatgacagcaagatcaaagatactatgattgaaaagaaatatatgtaggaataagatatttcatatatctgctgcctgaagaactttgtaaaatgcgttttcactatggcattacaacacggaaaagcccagcgtatcggcgtttcaaggtatattgccgcaccgcctgccagaagtaaaaagacatttatgcctacacccagaagcttttgcctaagctctgcaaaaacgagcataataagaccgcacaccaacaacagcagaaatatcagcaccgcagaattgcctgccgaccgcagcggtacatattggtagtaaagattttcaggaataagatttgcagcaacgctatcggcgttctcgggaaagagcctgctgtaatctgtgactgttgccgaccattgttcgctccattgcaaataacctgccgccgcaagaaacgtgctgagtataactccaagcataaaagtaagtgaagacataacaagaaaaagcatttgcccaagcagccaattaacacgccatgtgcgctgcacgcaaaacagcatatttccatcgtttttaggaaaatctcctataagcgtaataaaaactatgggcattatcatcagcagtacgtctgaattggttattgcaataaacggctcaaacagaccaagtttaacgcctgtttgttttgatatctcaactaacggctttacggcaaattgatctatgaatatcaatgcacatagaaatatcaacattcttgaactgcatatccatttgatatattcactttgtgccgtcccccataccgcccttattcttgttttactcacaacagtcatacctcctttgcaagaagctgacgccaattatcgccgcaagtatcatcaatacggctgcggctaagatcacatacacagtcatgccgttttctatggctcggaatatcccgttgaatgaaaataagctgacgatctttccgacattggcggaaaacccttttgaaagtctgtttataagagtgttgtaaaaataaaagaacataaacggtatgcaagtcatcatatatttgtttctgctgaaaacagagatgatatatgcaggcaatgcacttaacgctcctattataaaagcacctgccattcggctcaaataaaagcagcctatactcattgaatgaagcactgccgcagctgaatgactgttcgtatccataacagacggaaacataattactgtaaatatcacaaaaagcccgtatcccagacaaagtaccgccgctgaagtaagcaccgccgacacaagtcttgatgcagcaaaagcaatttttccgctgcgttgcatttcaaaccgctttaacgagctgttctctgctgaaacacttttaacaaacggcagaacgcatacaacaggcgaaaacattatcagccagctgctcatagctgcacgaatgatattttcacgaacgacagaatttccttcaacagcctctgtggggtcacgcaaaagcagtatggtcaatactgaatagccttttccgccgtctgcatcggtgtaaacatttgttatacagcacaagccaaatatcataatggcacatattacaggcacagggctgatgagcattttataaagctgtgttttcagacacttattgaaattcatgttctatcctcagttttccgaaacatctgcattgttgaacagtaccaaagcttctccattcagagcattgacaaataccattcgttcattgtctgtggtggtgtcgagccatataaaccagccaagctctgttttatattttgtatcaccttgaaaatagaactgtccgtcgctatccttgttccatggttcaccgtttgctttaacaacattctgcatatatccgaggtctattttattgactgtatatttatgatttgccgcaagtgtattttcacatatatctaaagcactttctaaggtaacgcatttatcgacactttccgcagagccgtcaagctcgcaaaagccatgatctcccaagaactctcctacggtgtttggagcggtcatatacagctttgctccaaaatacggatattcatcaaaatccccgtcgctataaaagaaatcgttcagggcgattccatcgacggttctttgaatatgaaaaagcagagcattttcctgatcgtatttcaatacatcaacgtaagctattttcatatttccaaatccgctgtcggtcaaagcctgcaaaaagccgtctacatactcaacgccctgactgagtttatacgtctgtccgccaagaacatactcttcgtcttcatagggtctgtctacaaaaactgtttttatcgtttcacagtcataggcagattctttagaaagaaatccgatgcctccatttgatgcaacatttaaatagtacgttgtgtcatcataaacgttgccggcaggaaaagaactgtcaaagccctgataatactctttcttatagtccttgtcggaaataaacagcggccttattttaccgaaacactgctcacgatcgttcacctgctttaggtcagcgagttcagccttttccggcagatcatttgccaaggcttgaagtgtttcagtcggtacagaaatattttcatactctgtatcagttgacaaaatatctttttttacatcagaaaagctctcaagctttatgctgatatcttttgtatcactggttttaccgcctgctgcacaggctgtaaacgtacatatcatcacaagaagtacaaatatcttaaatatttctttcatcgttgctccttttataaaaatggctgccgacaagcagcagccatagcacattatttaggcgttcttgtgtatcctgaagcttttatatcatcctcatcataattattgagtgtgattttattcttcacttctgctgttggtttatatgacgatgtcatcgttataaaatactcataattgtctcttttatctatcgttactttattgctgccatttggtgaactaaacgtaacattagaatagagcacctcatcttgcccagtccaacttgttataataacattctttgttgtaccgttgttgatcttaactttattgccagctttaagagtcttggttatagatttagtgctttgtgtgtattttgcacttattgtccacgtcgcacttgaatatgtatctccggaattatatgcactagccccaatagccatagaactcatcatcataacagcagcacccatagctgcgatcctttttacgatctttttcatattaaacgtcctttcttattataacatccaaatatttgaatgtcaatgttttgttttttgattttggattatataaattttattactgcattgaatcacctgtcctttctgtgcacagcctattattttagcatgacgctgttttgctgtaaatagttatggtctcataatcagaaccgttatagacctttgcgattgttttaagacggtatgtaccgctgcttaacgatgatttagacgtggtatatatcgctgtatatgtgttgaacgtttttgtccagcttgtaacattgctccaccattttccactctttttctctagtgtatgtgtaacaaccactttagttgtcttatctgaaaatcccattaccgtacttttgcacgaagcagtcttatttgaaatagtcatactgttataaactttggaagtatacttatagtattctgtgaattcaccttcgataggagtacttaactgaggctcagcacaaacagatatgccaccgccacacaccataatggaagaaacaagtaacgctaataactttttcatcttttattatcctttcaaaaaaaatagagtagaaagatcaaatcgacctctctaccctatataacaataaaaaatcaaattagtaagactatttttgtaactttgtagacttgcataaatctataacagtttctttgtcaagattgccggaaattgacaatatatacctaccgttatcccaaatgcacgtcacatcagtatcagattcaaagagcaaatattcctgaccatcgatctcaatcttcgtaaaatccgttcgctcattatccatatatatattatgattacctttgacattctgatcaaataaaattccttttttgccatttgaataaaaaactgaaatactattatctgtttcaccatattgagtctgttcaaaaccggcaggcaactttgaaatataatatttttcttcaatagaagtcggataaccgtcgtccgttccactttcggttgttacaacgctgtgattcgaaaagatttttattataaaatcatatactgcattacgaaccgcttcgacacttaacgctgatgcagatatcacgaccactgctaatataatgcatgcagctctacggcctgctgtactaacaaatctaaaatattgcttcttttgccttgcaataagctttttcattttcctattgaatttgtcgctgaattcatgttcgcccgttaaagagatcgaattcatatcttcattaaaatcttcatcagatacatcttttaatgcctgtaaaaactgcaaattttcattcatcaagcatcccctcctttaaaattattcttttaagattatttttagcagtccaatatcgctgcttggctgctgcataactgataccaaacgaatctgcaatttctttatagtccattccctggacgcatacaagatagagtatatctctatcagttttatttaatttccttatgaaatcagaccatttatccttatcaaattccgaatatttatcgtcgttaaaataaatatcatcttcgtatggcaaattcgatgtattatttttttctttcgtaaggatgttgaaagctttgttcctaacactaataacaacatatttctgcttttcgtaagaagttaaattgttaacttttttgaaattctttgcaacagaaagaaagacttctgaaacacattcttccgcaagactttcgttttttaatatcttataagcaattatgtacgctttatttctacactctctatacagtacctcaaaatctgatacatcgtcatcatcaactaataccatataaatcggtaacattttgtcacttcctatcaataagtcaaaagatttattatttcaaaattaagtatatcacatttagattcaattttcaacgtagttatcatcatattaacgattgtacccttatcttaatatgcgcaaaaactcagacaagtggattttagacaaggaaatatattcttatcgcataaataaaaatcatgaggtggcgttttaccacctcataactttgtgtaaatgctaaagctaaaagtcataaaagttctgactattgtgtaatcatacagacttgagaaaattttttcaaataaggttgttaagtcatcagttacttcccctatacaagtataggaaaactcgacaaattatcaatttcaattttgtgcaaacatatgaaatttataaaaccaaaataaaaaaatcctgtactttttcaaatttgttgccggtaataataagagatcaattgaagtgatttgcgatagtctccgtgtcacacagacatacctttaatataacatactaagtaatattaatatagcaaaagaaaaaatgtatattaccaacaaagtggaaagacagataaaataatgaccgtgacagtagtgacagtaaaaatggtagcggagttactgtcaacaggctgacttcaaaatagtgaaaagccttgaaattccttgctttgcgaggtgtgacagtaaaaaataaatcaaagttttactgtcaacatttcaaggttactgtcaacgcaacgtaagccgatttgcgggcttgaatttttgtcgggtaagtttagccaaagcatttcaaaagccgacacaggcgatttgttagccgctgtgggcgatatgtgtgagaggttttaattctgataataaaaaggcagttgttaatctgcacaaataccagatatgcagcagttaaagcaaagtaaaatatttcattgcaagttaaagtttcggggtcgtagcccccgaaacagtcacagcggacgagcaaagctcgccgcaaaagtgccgaaaatacgcagtttcagcaaaatgatgtattttttcatcaaatttattataccacaaaaaagactgctttcctacccttttaagggtggttgcagtctttttttattgcgcgtttttttacagcgccttattctattcagaatagtcctaattttaacctatcaatatcggctcctgatatctgtttgtacgaatccatacttactcagtctatgtcaccttaccccctcaatgactcccttatccatttcatgcacagtgtcgcacagcacggagatatcctccgctgagtgagagcaaataaggatagtcttaccctgctctttgtatgaaagtaggtactcacgcatttcctttactccgtccttgtcaagaccgttaaacggctcgtcgagaataagtatctttgggttttccatgatagcctgtgcaagtcccaaacgctgccgcataccaaggctgtatttacgaacgtgacgctttaggtcaggatcaagtcccacctgtttcatactgctttttatctcctctttacctatcttgttgttaagccccgcaagaagctttaagttcttgtagcccgaatagtaaggtataaacccaggtgtttcaataatgatacccatatctttcgggaagtcaacgtccttgcccacttgcttgccgtcaactgttatctcacccgatgtgggcttgataaagccgcatatgcacttcatcagcatcgtttttccactgccgtttcgcccgataagtccgtgtatcttgccctcctcaaaggacacatttatgtgctttagtatctccgttttgccaagcgtaaggcatacgtcatttacattgatgatatccatttcgtccccctaacttgcaacctccgtcacattatcataattaaacttaccaatggctatccctccgaaaaccagcagaaccgcaataagtactagcagataaatcacagaaaagctcatcggcattattggctttttgaaatatttcgtgtaatgcagccaagttattgagtttgccattggcattgtccacataagatttgtccttatagcactgaacgccattccaagggatatcattccgccgcatatgataaagcccaatgtctttcgcttgaacagtgaaaacaccagcagtatcagccctattatcatcaaatacgccgccacgagcagatagctttttaccgccgcctcaaataccgaaagctgattgtagagattttctggaagcagctcaactccgaaatcgcctcgcctgtcggggaacattttcacaaaacccgtggcaacattgctccagccattgtaccaaaaaccctttgaaagcattggcaaaactgtaccgagaaatattaccgcaagatatgatactatcataaaaacaagtttcaaaacctgccctacaaaccagtttgccctgccgatacgcacgatataaaacacggtattggtgtcaactttcggataatcagcaatgagggtaagaaaaactatggggattataagtatcagtatctcagaattcgccacagctataaatggctctagtatgttaagcggctcacccataagctctgcattgttggtcagcggagaaactgcaaaattgtttatgaatatgagcagcaccgcaacgatcaccattcgtgcgtcacagacccactttacaaattccgttgccgcacaggaaaaggcttgtttaaaactaaaatttttcattgcttacacccctttgtccagccgcatattcattattactataaaacctatcacagataaaagtattatccctaaattgaaaaacagaatgtattttgtgtcggcaaaagctgtgtaatatgacaaattcattatgctgttgggataaaaattctccaatatgcttgccctgtcgaaatcctctttcatcattgaatttgcaataagtttctgcacagttatctgccacatatatgttaccataaatggcacgcaggttataagatacggatttttgcagaatgagcttatgaaaagtgcaggcattgtgcttatagctccatacaaaaatgccgaaagcatatatctcaacacgcccgtaagctcgtctttattgttcacaagcacgaatgataaatcatctgcggaaagttcgtattggctcaattgcggaaatattatccgcacgataacgccgaaaattatatatccgaatagaacggctgaaccgccgcacaaaaatgctgagcagaattttgacagataatatctcaaactgcctgttcgggttatgttgaaccgcattgagccgccgtttcgctctgcacaaaatgccgtcataaagggaaaagccgctattataggcagaaacattgccatatatcccgacataccttttgcgaatatcagataggaactgaaggaataatcatcagcaaaaagctgtttgtcaagctttgcaatgcactcaaacaccgtgtatatcttcgccgtgtttgggtcagtatacgcctttgcggtaaagcatagcagggtcgtgagcagcaccgcaccgacatatccgatattcagcatactcttgttaaggtcgcatttaagtgctttcattgccccaccccctatggaataagcacatatatctcgcccgtaacgcaatcgactgtcacataatttattgcgtgcagacctgtcggctgcttatcgtcgataataaaataccactttggcgtacagcatatattatccgcactttcgccgacttcggtactctcgccacgaggttcatacataagcttgacgtcatcaaactgtatatcgattttgtccgcaagattttcctcaagcagatcgcaagcgcccttgaaagacagcattttgtctattttctcagcctttgccaccttgaaagcgttacaacctatgtaatattcggggtcaaagtttgcgtcgagatcggtataagtttgcattgaataggtcataagggcatttcccttcacgaacagcgtatcatcagcattcgtggaaaaaacattttgtatgccgatacctttatatgccttttgtatctcgatctcatagccaacaccgctgtcggtggtgattatataccagtcactgaccacattgtcaagctcctctccaagcacattgctgaacgtgtccgccaaagtctttgccttgtccgcagcagacaaaagtccgctgtcagcattttcagaagttggtctgtcgagataaaaaagctccatattatcggcgtcagcgtctgcggtatttacgccgttttcgcttgcctcccaacagcaataaggctgtgcaaagcgtgttattttaagtttgttatgttcgtcctggagctgtgcctgatcttccacagtttcgatcttaccatcgatcttgatatccaaggcactttgcagctcttccacttttgacgacagccagtccatatcattttcggcattgatataagcaagctccaagtcataaacgccgtcaggtttgcaaatgctcaccgccgatttttcgggtagcttgaattttgtatactctttttcaaatgcagcatcaaagctgtcataaatattctctgacgaaacataagcctcgccgctgtccacctcagccgaatgcttgttgcttctgatattgtcgggagtattttcacaagctgacagcgccacagccgccaacatcatgggcaataatacttttgtttttctgatatttttcatatgtcattcctttcttttgggttattgctgcgaggtagtatagaaatcaagctgttaaattgatcgtataatttaaggcaatatcacataaaaagatagttagtgatattgccttagtttaaattttatttaccgctaacatatcctgaagcctgactacctacacctgacggagctggattgagtgacatggtgcacaaaatacgttcacctttatcaatatatgtcgcattaatgtgtttcgtagtatggtttcctttacttgatatttctccacttgcaatatatgtacctccaaccgttgttctatatgaaacggatgtagcattggaaattttgtcaatttggtagttgaccctaacataatcatcctgagctgcgattctcttaacgatattttttataatataggtgtgattttcttcaagttttgttgcaaataaattcaatttcatcatataacacaattattgcaacggataattgtgcataatgaatattcacatcttcattggactcaccacatttttttgcaatagacttttttatctatgcatacattattttaacacatataacaccaaaagtcactatattctgcatatttctctcatatgcacaagatttttgtatagctgaacaaatattgcgttctaaattatttcattttacataagttgattgttaaatgcttgttaacatcaacacggaagttgaaatagccagattataacgcttattgacatacaagtcaatgaatgatattattaagatataacgattttagcacaggcggtgaattaattttgaaattctacgattatccgataatcagcaaagaaagcagtcttcccgtctttttggtgagcgtcgggctatctgtacagcttttttcattgaattgagccgtcttgcggcgaaaggaaaaggcagtgtacaaattgcccctgcggtgacaaagacgatcgcatatattgacgaaaactatatgaaacagaccggtcttgaatccataagtaaagccgcaggcgtttcttcgcagcatttgtgcagattattcaggcagaccttgaactgccgaccgatggaatatatcacaaaacgcaagataaaggcggctaaaatgcttctggcagaaacgcagaaaactgtcgatcagatagttgaagaaacaggtttctgcgacagcagttatttttgcaagattttcaaaaggttcgagagtattactccgtcgcagttcagaagtatagaacaggctctatgaaattcgtaaattgaccgctgacaccgtacgataaacaaaaaggcatcatgtccggatacatgatgccttttttctattgtagctttgcataaacctgccggatacgatcagttattcctgcgtctggctctgttcagcagcaggagcgatatcataagtatcaagggaaatgcgcagcctgcgagcatacctttctgcatatcatcgcctgcacgctgggtgatatttcctacaatagcgggaccaagtgctccgccaaggtcaccagccatggcgagtagtgcaaacattgcagttccgccggtgggtatttttccagaacagatgcttatagaaccgggccacatgatacctaccgagaatccgcacattatgcagcctagaagtccgattacaggtattcccgacagggatgcagtgatgtaacagatcagacacagcagcgccgagcctatcatgaatttcataagatcgagcttttcgccgtacttcccgtaaagtgtacggcttatgcccatcgtcaccgcaaacatacacggtcctgcaatatctccgactgacttagtcagtccgagagcagattctgcaaatgccgacgcccactgcgccattgaaagctccgaggctcccgcacaaaccataagcagtatcgcaagccagaacagcggtactctgagcaggtcacggatacgcattccctctccgtcctcgacggggtgtgcaatgggacatactgaaaaattgtaaacattcaccagcggaattatcgcccagatacaagagagccacttccagttttctatgccgaaagcagtaaaaaacagtgttgaaatgagtatgactccgaccgaaccccagcagtagaatgaatgcagcaggctcattgcagcttctttgtgctcaaacgggcaggcttcaactatcggacttacaagtacctcggtcagaccgcttcccattgcatatatgaccgtgcttataattattcctgaaaacggattgggaagcagttctggcagaaaagcaagcccgataagtcccagcgcagaaaacacctgcgaaccgataacgcatttccgatagccgatcttgtcggcaaaacgtgcgcacagcacatctatgataagctgagtaacaaaaaataccgacgagataagggcaattttcccaaacgggataccatagccattgtgaaatgtgagaaatagaagcggagcgaaattagccgctattgcctgtgtgatgaatccaagatagcaggatataagtgtttttctgtaattcacagccatattgacaagctcctttacaaatgatataatcagattatatagtaaatgtcgtaacatttcaatacacaaaatcacatttttattacacaatatcgtaaatcgggtgagaacatggaaaatgcaatcaaaaaggacaggatcacaacggacgaaaccttacgtgaaactgcaagtcacggcagcgaagaatatccgttcagttattattatgaggacatctgggatttcgattttcactgtatcgactggcactggcacccagaggtcgaatttgtttatgtacagcatggcaaggctgattttctggtgggtggaaacaggtatgttctaagctcgggcgatgggatctttataaattctcaggtgatacacaggtttgaagcagaagacagcgccatcattccgaacattgttttttcacctgttctgcttgcgccgcagggcagtctgatatacagcagatacatcagaccgataattgaatcaacttccgaatgtgtgattttttccgccgaagaaacagcgcaccacagcattatcgaaacaatgaggtcggtatttgctgtgcagggttctggcacggcttctgaaatggaaacggtagaactgctgctgaaactatggcgcctgttatatgaaagcatacaaataacagactgcggccccgtgtccgggcattccgcacagacgcaggctaagcttcagataatgatgcagtatattcatgataattacagcggtcagataacactggacgatattgcaggaacagttcttataagcaaaagcagtgttctcaatattttcaggacatacctgcacacatcgccgataaattacgttgtagaatacagactgaaacgtgcgtcaaagctccttgttgataccgaaaacagcgtttgcaacatagcgcaggaaacgggatttgataacatcggctatttctgccgcagattcaaaaagctgtacggcgttacgccgataaattacagaaaatactattgcagtgcagagcgtaattcaatgagaaatatacattctgacacaaatgtcctgtcgggctgatgaaatagctaaacttgataaaaagatatcagatttaagagagtatgacaaaatctgcaccgccaacggtgggctgcctccggcagaccgaagaaagctctactatgatcatatctttctcgttgcataatccttgttcgaataaaatgtgtcaagtgatattgacaaaaccatatcggcataggctgtcagacttgctgagcctatcaaagtaatacttgctgcaatgggaattatttttttaatcattttgaaaatctcctttcatgtttagtgttgggtacaatactattatatatcattgcacttgttttttcaagccgcaatgcgcacaaagttctctgaaaaaatccggacagtttttatatgatgaattgacaaaaagctcttgatagggtataataaaagaaatgggtacaatacgaaaggattgatttctatgtactataacgaaaagcgcaaagcaatcacggcaaaatatgtgaaaacacatcttgatgacatcaaaattcgtgttccaaagggacagcgtgaaaaactgaaagctatcgctgctgaaatgggcatgagcatgaatcagatgttcattaaggctgttgaggaatatattgaacgaaactataagcctgaagaagcaaatgaaacagattgacaaatcggaatttaacgcacatctaaaaaacgagaattcatagaaacgtagccataaaatggtgatgaaaggacgtataacttatgagtaaaaaagtatttgttttggtacacgattactggcatcacgatgattccatcaagcctatgatggactctcctgtttctttcttttattataccactgtcacgatgttttggcaattttgtgttcagtttctagggtacattataatctaaactacgatcctatggaaaaggtgtttgattctgcttacagcacattggtttataccgaacaaggtggtcttgataccatgccggaagtcgcaggcgtgggactgttcgatggcagtaaacacgggatttatatcggcaataatgaaatgatttacagttcggaggctgttggatatattacaaaagactttgtttcaaacggcggttggtcaagctggtgtacctatgagggagtggattatccgcaggaggtgactgacgctattgaaagtttgaatgaggacagctcatcagaaaattaattttattggagtgtgataggttgaaaaaatcagttacggtaagtgtaaacgagaaaaagctctctgcgatagagatgtatctggagcagaaaaacacaactcttgcggcggagcttgaaaagtatgtggatcagctttacggcaaggtcgttccgcagaatgtgagagattttattgatatgatgtcggacagaaagcctgcgagaaagcagaagatcactgctcctgccgaaacggaaaagctgtccgagcagtaactcgccacggttcgcaccgtgtgccctcgtgtggcgttttcagagcatgggtggggtaactttaccctaaaggcagctggggcgaatttggggcattttgttgcaaagtttgagaatggcagggatcagatgatttcgggtgggtttgagggaaatttaatatattgcaggttaaaattttggcgtcaaagccgccaaaatgctcacaacggacgagcaaagctcgccgtgtttgcgagagttttgagagatctgaaaaatggagtcagaaagcgaaggttgagttttttatggagtcaaagaacagaagatcagcagaaaatagcgaacgttcaggcgtttgtgatgatgtcaaggtgaaatttccgctttatgttttcccagagacgatgcagaaaattgatatgctttatgaggctgacaactgcaagtcgaagacggagtttatagagaaggcgatacgtttttactgtgggtatctgcttaacaaggacagtgtggcagcggaatatgccgctcctcagatcactgcaataactgagggcatagtaaaaggcacggagcagaggctgtcccgtgccttatttaaggttgctgtcgaacttggtgcagtatcacatatgcttgcggcgatcaatgatattgatgatgaaacgatggtgaagcttagggctatgtgtactgacgaggtcaggaagataaatggggttattaattttgaaagggcggtgaggtatcaacgggcggacttatgaatatcattatagttttatcacagaattcgccaaacgtttttcgttgccgatttctgtagtatagtatcgttgttcaattccgtatattaattcttttaattctttttccgaacctatgtcaaatgtgtttttatcctcatttgttttaagattcttgcagtatttagaaatgtacttaacgatttgtttcttttctttcggattaaatttcttaagtgtctctaatgccattgtaatacgttttctatttgcggttttaacttctaaagttgagtatccactcgtcagattaataaatgacgaattgaggaattcagttgtttcttcatccgttgcttcacgatatagttcctctatacctttaaatattttctttaattttgataggctttgaaaataaagtgtgtcattatttttctgatatattgcgtctggagtcacattaatattaatgcttttactgttttcttcataagtaaaatcatctcctatatgtataaatctacgaggttttaagtttgctttgcttatattttgaaaatagaaaatgtcatcttgtattgagcaaagataatcaatagaatcaacttcagatttgctgagcttttcataattaactgatgagaagtcttcttttagaagctcaatacaaaatgtggtttttgaaaatgaagtaatcatataccattcattttcttcgtgtaatgttgatgacgaatattcaattgcatcatctaaattagacggaaacgagtatacatcttttccactaatcatttttttgtaagttggtgttctttttctgtcctttactttaacgattaggcatttcattttgttcctccaaattctataaaagcagtatcactaagtcgcttaagattttcagtttgtaattctttagcgtttcgatatgtttgtctagaaataatcattatttttgttcctttgtcggttgttatgtaatagtatttgtagccaattagtaaaagcattggattaaaaaactgtgtctgtgatgcgaatgtaaatataaatacgattatgtatatacaaactaatgtatgacaattatcaagtccaatgccaataaaaaaataaccaagataatttgcaaggaagtcattatttacttcatcaatgttttcacaattagatacattatcactagaacagccagcctttgtgataataatccaaaaagcaatcaagatgaaaggcatagcaattaagcaaacatctgtaagaaaaattgattggttcagaaagttccatttttgatctattccatatatgattactatccatatggttgatataagagtaaaaaataacttgtgtatgatttttatcatagagaaaaactcctttatattgagattaataaatgataactctttattatcaaccgttagaggaggaagtaaaatggaaagatatatagtattaattacgatgcacgccgatccggcaatggctcctggatatgatgaatggggaggaattcatacgtacatgaaagagttgctagatgagttcggaaaaagaaaaattaggtgtctgatgtttacaagaagatccatgcagtaccttccttacgaagaacagtataatgaatattgcacagtctatcgtttaacaaatggtgacaatgaaccaatgagtaaaacgcttttaaagaaatatcattctcaaaacgtggaacaaattcttgaaataataaagaagcagggtagactgcctgaaaagcttcatagtgtatattggaacagtggaagaatcgcagctgatttaagtgaaaaattagaaattccttttgttcatagcatcatatctaattcaaggggaagagtaaagcgtggagcttatgaaccaatgcccgagcgtgaattttatgagcaagaaatttacgataaagcacaatggcttatttgcgtttccgatgatgaggcagcggatcttatgaccctgtataatgttgataaagataagatcgtagttgcgggacagtatattcatgaatcatttgttatgccctcccatgatccaaatgatttccctagactcaactctacgatttcacgcggcagtcaaatagcagcggctgagaaatataataaaattgctcagcccaaatcatacgatacattctgggcgcaaaaagcgtttacatatatcggaagaatggataggaataaggggttgaaacacattttttcctcttggaatatgctgtataataagtataaaaatctttgcccgccattatggctagctggaggtagtttgccggaaattgaaatgatcagaagtgatttcaaagaaataaatcctgatttaacaatactggaacaatacggaaaaatcgtttggtggggctgtattgatccttatggattaagtactgttcttctcagaacatcggtattactgacacattcactgtacgaacccggcggacgtgttgctgttgaagcgatgtgtgaaggtgttcccgttatagggacaccaaacgggtttgccaaagatactataaccgactggtataatggttttcttgttaaattcggtgacgtagcggaattaagcgctcgcatggaacatttcataaggcaaccatatttaagcaatacattaggacaaaatgcgatagctgctgcaaaagaactaatgggttcatggcggtttattgaaaaacatttaaagtgctactttgattgtgaatcatcgcctaaagatgaaaataatgcaaaacctgtactatcacacaagaaaattaatctttacccttattgcatcagcagatattctgatgaaacaataaaacagtttttccataaatgcagtggctgtactgcagaacagctacatatactaacaaaccaaaacaactcgtcagatgtttatatggtaaaatgcaataacaatcaatatgttataaaaaggacttacacccgccttgcaataagtcctatgtataatcctgttcgtaaaaatgagtatgctcgtaatgccggtaaaatgtttaaaactgaattacaggcttataagagaatcaatagcccattattggtaggatatgatgagtttcatgctcttctcctgctaaaaaaagcagaacctttctatgtatcaagtgttgacagacttaagttgtgcataaaaaatgtcctgaacaactgtcagataagcaaagatgaacgagaaaaatacattgacataatattattgaatgatactcccgacaaaacaattgagaagctgaacaatgaaattgaagatttcttttttgacccttcttgccgtttctcaggtaaattatgttggcaaactgcagcagaaatgcttaattataatagatcaagcataccaagctgtatcttcatggtcttaattgattgcgtaaaacatttttcctcaactgatgaagaaaacactttggaaaggctatgtgctgtgaataccgatctgacatttgaccatgtttatttcttcgatggacaaatctgcatgatagatcatgaaaaaacagcggttggcgaacccgaagccggtgtagccaggttaatccatgattttattatacagcaaaaattagagaaatcaatgctgccggaattatttcttgcgatgaacgaaatagatgggttaagagtcagaaatttaatttcatttgttgcttttggcttttttcatgatataatagaaaaaaatgtaatctattgtaccaatgatactgaaaatctcaaaattttgcaggaacttatgaggttgtaaaaatgaatcttcttgtaattgctccacatcaagatgatgagattctaagcgcatttttactgatgcataatgtgctggagaaaaatggaactgtaaacatactgtatgcgacaaacggagattacaggggaatagactatgcatatacacgttattatgaaagtttgaatgcgctgtcattacttggtatatgtgaagatcatatgctgtacttaggatatgcagataccggaatgagcaaagaaaaaagctttctaatgcgcttaagaagcactcctgaacagcaaaattctcctgtatcatcttgtacatatcatccggcgaataaggaaactgtccattctttgcatacggaaactcaagctgaatacacaagtcagaatttccttgacgacttggtatacgcaataagatcatgttcgccgagtttaatcgcagccccgtcaatatttgatttgcatggggatcattatgcctgtgcaatgtatttatatgatgcactaagaatcattaatcatcccataaaagttctttcttatttgatacatactgaaaatgaagatgtttggccaaatagaaaaagtgatattttccaaccgcctaaaaatcttaccacttttcactggatctatgtttatggaaacaaagaagctgtttccgccaaaagaaacgctatttcagctttttcttctcaatcaccttcggctgataactgctttttgtattcatttgcaaagcaaaacgagcttttccttttagaatctatccaataataaaaatatctccattataaatataaatgcttttcagttcaagctgttcgtgatgattaatgagctgatttattgtcttgaggtaatgtttttttattttgtcaggaaatctgaattcatcagctattttttcagccgagatataatctgctctttgacttgcttttgtgtcaaataatagctggctgcacttgcctacaacaagaagcaccaggtattccctactggagataaaatcatcacatgattcaattaggttttgaacttttgtaattaatccggatttaaaaatgctgtacgcatcgtatagcatttttattaattcttctttgtttccagaagtgataaaatagtttacataatttagtttgctacgccaactatagtgcttatatcctgaatactccattatttctgtcgcttctttaaagcattttacagcttccgatactttgtcagccagtaaaaaagcgcagccttttatattaagtattcttccaacttcatcaaatacgccgtgcgattcagcatatttgatgccaaggtcagaatgagagacggccttattaacctctttcaaaagcactttgcacatagccttgtccccatattcgtgaaaggggaagcagtagaaggtttggctgttgtttactttttctattattttactgtaatattcatatgacttttggggttcgtatgacaatgaaatgcaggcaagatgactgagatgttcaatatacagggtctgggaattaggtaaagccttcaaagctgcaccaaaaacttccagtgccgcagaattgcccttggtttcttttatgtagattgcgtaattgctgcacacctttccaagataatcatccggattatctttcattaatccatctatgcagtttttaaagtacttataatgttcattcagaagatcatctgaaaatgcatagtctttgagtgcgatagtacccttaaaatagcagattgctaattctgaataggattcatcaagtaagtccaactgtcccgaattcaccaatgtttgcaagtggtctaatgtcaatcttgccttgtccaacataagtgatttaatgattgcatatacttcaagcttttttattaaatagtttgacagtgcgtgagcatttttgttattttcagaaatagttattgcaagttcaatgaattccaacattaacgtgaaattgcgcttttgaccaagttctttgattaacaaatctatttcttttgtagcttcctccagtttgcctgcgtaaaataagccatatattatgacatctttatattttccaggattatgggtacagaaatctaaaatcaattcggaaatattttgctcatttaccaaatcagacgtttctttcattacagcctgtttaacaaattcatttgagacaaatatatagcgatcctctctgacgatgattccttcttttaaaagtgaactgtatgataaattcaaatatgaacacaaatcaatgggaatgcgacagttcaacatttttagcagataaaatagttttttatcttttttcttacaagagttgattatttgcgatgttatatcggacagatcgtttggtgtcaacatatccaataattccattgctttttcgaagtttggcgtatgcattcttctttttagattttgggaaatgaattttatattataaaatcgcgtacctactctttttacaatttgattcgcagttttttctgtgatattcaattcctggataaaccaagtttttgcttgctcttcagtgagagtggcaatatctataatggcatatttattaattattttgttataagccatcaggttctgcttttgcaggtcatattctgattataatgtaccctagaaactgaacacaaaattgccaaaacatcgtgacagtggtataataaaagaaagaaacaggagtaccacaaaaaaagactgctgtcttgctttttggcaagatcgcagccttttttcttggggactttttttacagccccgttttttatgcctgttttatcggctttttttgtcgttctcagcttaaatcctgctgttctgccgcctgcctgtcaagctccatgcggtaagcagaaagtatctctccctctatctcattgcgaagcttgctgtcgatggggtgaacgatatcacggaaaacaccattgtcatcacggcggctgggcatagccacaaaaagtcgctcctctccctgcactatcttgatatcatgtaccgcaaaactgccgtcaaaggtcaggctcacaacggctctgagcttgccctcgtttataaatcttctgaattttacctctgttatagtcattttcatgcgccctttcttgtgatgtaatgcctgtagtaatatttttgcctctttttttgaaaaataatcaaaaaaggggtttatttttttttagaaatgttatataataaaataaacatacattctgaattatctattattctaaggagtattacaaagatgataacaaatgagatcttgaaaaatataaagcacgttcattttatcggtataggcggctctggtatgtaccctctggtgcagatattccattcaaagggatatttcatcacaggctcagacaataacgaaaccgaaactcttgaggccgtaagaaagcttggcatcgaagtctttctcggtcagagagccgagaatatcaagggtgcagaccttataatctataccgccgcaataatggcagataaccctgagcttatcgctgcaaaggcaagcggtgcgatctgctgtgaaagagccgagatacttggacttgtcacaagttggtatatgaacgctctttgcgtttcaggcactcacggaaagaccacaacttcttccatgctcacacagatattcgttcaggagggtactgacctttcctgcgttataggcggaaagctcccaagcataggcggttcaggcaaggcaggctcatcacaaactatggtctgtgaatcctgtgagttcgaggatcatttccttagacttttccctgacgtttcaattatcctgaacgttgacgcagaccaccttgagtatttcaagaatattgaaaatatcataaagtctttccataagttcgcaaccatggcttcaaaagccgttatctataatggcgatgacgcaaatactctgaaagccgttgagggtgtcaacaaggaaatgatatctttcggctgggataagaaaaacgattattctgccgttataaagtccaaaaaaggcttgcagacacgctttgagctttatcataagggcaagtttgtcagagagcttactatccatgttccgggcgaccataacgtcatgaacgcccttgcagctatcgctgccgcaagatattcaggcgtttcatgggagggtatcgaaaagggacttgatactttctttggcgcaataagacgtttcgagaagatagccgaggtcaagggcgttactatcgttgacgattacgctcaccacccaaaggagatcgagtgtacactgaaagccgcaaagggtcttgatttcaacagagtgtgggcagttttccagcctttcacctattcaagaacaaagatactcatgaacgatttcgtgaaagcgctttctattgcagatattgccgttatcacggatatcatgggaagccgtgagaaaaataccgacggtgtttatgctgaacagcttgcagagaagataccaaatgcagtttggttcaagaccgaccatgagcttgttgacaagcagactgcacagcagaaggaatataacttctcacagtgtatcgactatataaagaaaaactgcaaggagggcgaccttgttataactcttggctgcggagatgtctataagcttgcaaaaaggcttgcaaaagagctttaggcttagaagataaagatttattgatataacagaaaggacggagctatgagaaaagtaaccgagaacgagaaaatggtattcgagttcataaaggatcgcatagaagagggctatccgccgacagttagggagatttgtgcggagtttggctttaagtctacctcaacagcccatagatatataaataatctcaccgcaaaaggtcttcttgaaaagggaaataaccagaacagagccataaggctcacaggcggcaacggcatgaagatcccccttgtgggaacagtcaccgcaggtatccctatcactgccattgaggagataacagactatataagcttccagcctgcaaggcattacagcaatccgctttttgccctaaaggtaaggggagagtccatgataaacgccgctatccttgacggagatatggtagttatagagcagaccccatatgcagaaaacggcgatatagtctgcgcacttgttgacaacgagtcagctaccataaagactttctataaagaggacggccattacagactgcagcctgaaaatgacaccatggatcctatcatagtagacgaagtaagcatacttggcaaggttgtgggcgttgtaagatatctgtaaatatagataaagaagatttgtaggggcgaacagcgttcgcccgtgtcattaaagaaaacgggcggatagtccaacatagatatagaaaaaacttcgacaaacaaaacagttctaagtgtgtaaaggattggtaataatgagcagacattgtacattctgcggttctaagctggaggacggagctaagatatgcaccaactgcggaaaaatggtacctatcgcctcatcgacccaaagacgtggcgagcaggagtttatagaccgttcaaggatacagggcataccgaagcgtgtttacgaacacccgaaaagagccgaagcagaggaaagaatgcgccgagagcaggaagctcgcagggtaaagcgtgtaagagagacagaccgaaacagagaaatgagtgcggcagactataggcgcaccccaactgaacattcaagcagcggcaaagagaattatggtaagggcaaaaagatactaaagaatctgtttaagatcgcagtggtaatactggtgatatattttgtgatcgcctttgttagaatattcagcgtaagacattccacctacgatttcgataccgaaatgaaattggcaagcgaaaattacggcgaagccgttgacgcatatttcaaagacggcaagtggaaatataacatctttaaaaatcaggtgtcctatgagggaacttccgaaagtggcgacgattatgttatgatattcggcaagaatgacggtcagactgtcgtaaggcaaatgacaaagaacagcaagaaggtcgcttctgacagcataatgaacgatgtcatgggaatgttcatgttcgagaaaaaggtcacaggataaaaaaataagcgcataattatgtagttatttgtagtggtgaacagtgttcgcccgcattttgacacgcattataaaacgaaacggacgaagtaaaaaagcttcgtccgtttattgctttgcaggggatcggcgcaatttctgcattgcagaaatgcgacgtcccgctttttttgttgttcgtgttttttagcagcctaatttatactattgtcacgcttttcatcaaacattctgtaatactgcacagtttcatattcgttcagcgtgtccttgtatttgtcagccacatcatttatagaataccattctccgtcagccgtcttgtagccgtaagagcttattatcggaatgtcacagcgtatcttgtcaagctcctgctgatatctcgactttggaagtccagccgcttccatgacttcgtttgaaagatagttaaggcttatatcgtctatcttctccgcttcaacgcccttgttgctccaaataaggaaaggagtctgtcgaagtcttgagtaatcctccgttgaaagtaaagccacgtccttgccatagagatattccgtgaagtctatgatatgcggataatggtcgccgaacattacgattatgacctcttcctgcttgtgtcggaaatagtttataagctctcccaacgccttgtcagattgatagataagatttagatattcctgtgccgcagggttgttgtagtcctcaaaggttatctcatgaataacaccctccggatgatcatacggcgcatggttctgcatggtcgctgtccatacaaaataaggcgagcctgcgtgtctttcatattgctcttcgatatatctgaaaatggtttcatctgtgatatttccgttgaaatattggatatcgctcattctgtcctgacaattgtatatcctgtctttgaattgaagctgttcataggcgttgcctatatcccatagtccctcagagcaaggcgagatagcctgcgttgtgtagccaagctcgtttagccagcttacaagaccgttttgtttgtcattgagatattgggtgaataccgcacttcccgacggcaaaaagccaagagtgttgccggtaagaaattcatactcagagttgcaggaataaccgccatatgctgaaacggaaacatatccgcttatgctttcctcctgcaatttgtgatagttgggcagatagtctttgttagtcttgaactgagcgatatgctcaaagtctgcaaaggattcgttcatgatagcaatgatagcaggctttttgttcgtatcagccgtttcatattggtctaatatctcctccgccttttgcgttgagtagccgtcaggcttcgtcacacggtcaaacattccgtcaaagcagaacataaggtcatagcctacgcacttgtatgtgtctgcattttccgcgcctgaaaagttcagcctgatgtatctgttttttatgccaaggtcataggcgaacctgccgccatatacgaatacgaaacatcctgcgataacagccacacccgatattatcctgctgcgtatttttatcttccttacttttgtcgtcaccgttacagcgataataagaataagatcacaaagcacaaacatcactttgctgtctaaaaacagtgagtacattccgtttatctcactggctgactttatgttggcaaggtcggcaaactgaacaggattccccctgaactcggtgacataatactgtgccaaagcatatatggcaaatatgacgttcactccgcaaaaccaggcgtgtggcttcgggaatatcaccgcacctataagatataaaagccagcagagcaatattccaaggagaatgtaaagcacattgctctttggaaaatatgaccccattacaaagtccggaagaaaataagaatttagtccaagcataaaagccgccgtgaaagggtcgatgaagccttttgtttcactctttttcagctttttttgcattgagaaaaattctgcaataataaatatcagcgccagctcaacagcacaagcccctataagcgcataatttcgctctttcggcaggaagttgtccttgtccatgtatatgcccagtaaagcacagatgactcctaccactataactgccgctatggcacttataaatcgtaatgtttgcattccgtcaggtgacgcaaaccatgctcctatttttttcagcaagccttttttatcctttgcctgctgtgtttgaatgttttgttgttctttcattacaatatactcttttctgttgatttacacgcattttacaatacctattcattatagcatagctattagcaaattacaacagctaaaatcaacgaatattttcctgcttgatgtcaggtgttcacaattaatttaccccatgcttcaaagagtgtgtaaattgctcttgaaaaagggacggcaacgtgttataatatttatgtatttcaaaaaacataaggaaaagaggtaaatatatgtcacatgagaagatactggtgcttgactttggcggacagtacaatcagcttattgcaagacgtgtgagagatcaccacgtttatgcagagataaaaagctttgaaactccgatcgaagaaataaaagcggcaggctataagggcataatcttcacaggcggaccaaactccgtttatgatatgacttccccgcattatgacaaggctatacttgaccttggcataccagtcctcggcatctgctacggctgtcagcttatttcatggatgagcggcggaaaggtagaaagctgtaaaaagagcgagtacggcaagatagagataacagtctccgcagagagcaagcttttcaaggacgttcctgataagaatatcgtatggatgagccataccgactatgtcagcgaagcacctgagggctttgttatcacttcccattcagatgattgcccatgtgcgtcaatggagaatgcagagaagaagatatatgccgttcagttccaccctgaggtaactcacagtgagtatggtaacgtcattttgaaaaacttcctttacgaggtctgcggctgtaaaggcgattgggtaatggataactttatcgagaacacagttgcaaagcttaaagagcagataggcgataagaaagtagttttgggactttcaggcggagttgactcatcagttgccgcaggacttatcagccgtgcagtgggcaaacagctcacctgcgtgttcgtagatcagggtcttatgagaaaagacgagggcgactttgttgaggaaactttcacaagacttttcgatatgagatttgtaagagtaaactgtcagaagcagttccttgaaaagctcaagggcataacagatccagaggaaaagagaaagactatcggaacagagttctataaggtattctgggataagataagagaagaggcagacggcggctttttcgcacagggtactatctaccctgaccgaatcgaaagcggaaagggcgacgctgccacaataaaaactcaccacaatcaggtgaaaatgcctgaggacatcaactttgacggcgttatagagccattgggcgacctcttcaaagacgaggtaagaaaagtcggcgaaaagctcggcataccaaaggagcttgtatggcgtcagccgttcccaggcccaggacttggcgtaagaataatcggtgagataacagaggataagataaaggtgttgcaggaagcagacgccgttttccgtgacgagatcaagaaaagcggaattgagagcagcctgagccagttctttgcagttctcccgaacgtccagacagtaggcgtaatgggcgaccacagaacctatgaccaccttatagctatcagagccgtaacaacagacgacttcatgacagccgattgggcaaagataccatacgatgttctcgcaagaatatccaacaggataacaaacgaagtagaccatgtaaacagagtagtttacgatataacctcaaagccaccgggaacggtggagtgggaataaaaaacaaaggcgctgtaaaaaaagcgcaacaaagcccgtggattccctcgatatggaagcccacgggctttaatatatcacacagcaaaaaagaactatctaatcttgaaaaaagggtacagcaaacacagcggcacaaaaactgcgtttttgccgattattaaaatgttgaaaaatatctttttcaggctgcttttctgattgcgatcttcttcaagtgaaatttatgcagattaaaaccacagcaaatcatcgcaatttctaaattcatggcatttaagccacgtcttctggctctagtacggctctgttcagaaatccgatggtatggcgacgcagttcggatacacggaaacctacgctgtgctttcggagaacaagcttaccgttgtgtcgggtgcatttctcagttcagatatgatggaaaggcagagtttttcacagctgatggctaagtttgcggagaatgtgaagtattgaaagcggtgataaagtgccatatataccattcacagacgagcaaaaagtccttgccaacagcgtgaaccttgaagagtttttgcgaatgcgaggtgaaaaattagaacgtgccggcgtagagcataagctcatatattacgacagctcaggcaagcacgacagtataaccatccgtgggtcaaaatggttcgaccataaaaatcagacaggcggcggagcaataaagtttatgcaggagttttatggtatggactttcagactgcggtacaggaactgttgggacagagggtaactccgctgtcccacagtccgccgaaagctatcgcaaaggaagaaaagaaagagttcagactgccccaagcaaacacaaatatgcacagagtgtatgcttacctcataaaacagaggtttatcgctcccgaagtcataactcattttgcaaagcaacacacactttacgaggataaagaacatcacaatgccgtatttgtcgggcttaaagaagacggcgagcctaaacaggcacataagcggtcaacaaacagcgttggaggtacgtttcatatcacttgcggcggttctgatacacgttacagctttgcacatttcggagagaatgaacgactttatgtctttgaagctcctattgatatgctgatctttctgacgctgtatccgaaagattggcagaaacacagctacatcgctatgaacggagtttatgaaaatgccgttttgacagctttaaagaaccatattaacctgtcagaagtcattctctgcgttgataatgacgagggcggcatcgaggcggttgaccgtttaagggatattctaaatgagaacggatattcaaacgtaaaacgccttgcgcctccgtacaaagattggaacgaggtactaaaggcgaagaatggcgtatatgctctgcctgctgtaccaaacaagcataaggaagaatatcattgtcaggcggaaaatctgcagtatctcaaatgccgtccggataagctgacgtctcagatctatgccgccttcaaaaacgaacaatacaaatatctcgctgagtatgcacttgcgttataccattaacgaagaaaaataaaaatgaaccgaataggagctattacaaagctgttgtatgtcaccataaccatacaacagcttttatcatttgattggaaactccaattccagaacaaactccgggaactgctttggtattctcatctctccgccaagcttttcgacagtcctgcgaatgttgtataacccaaagccgtgattatctttgtcgagcttagaggtttctgtggaatttttgttgtctggatttggatttgataatttaatcacctgaacattctgtacaacagcacatttcaccgttataacagccgaatcggttaagctgagtttttcacaagcctcgatagcattatccaaagcgttggaaagcattgtacatagatcgactgcaggaatctcatcggaaataaaaccgctgaattgaatctgagtgccgatatttgcggctgattcgcttttctccgaaagtatcgaatcagcgatctgatttccgcttgaaaacttatttgcatcaattatctcctgcttggttatactttttacatagtcaagtgcttcatcaagctgtcttttctcaagcgtcgcctgcaaacatatcatatgatttttataatcatgacgaaattctctcaaatcgtctgtaagcttattgatcttttggtaatgctcaacttgacctaccatctgtttttccattattcctaatatgctttcgtagtattgccgtgaaatactgctgaatacaaatgaaataataattgtcaaaaaagccataatggtcagcactgtcaagaaactgtttattttattatcaaagaacaactcgctagattcaacagccatgtttccacaaagctctccgataaaaaccaggacaattaatatcaatatatataatcgttttggcagtaatcttatgctgttcctgatttgattttgatgatttttttgaagaaatctgagtaggattaatacaacaatattaaaaatcatagatgaaaaatttaaaaccgttgctctgtcaaaatcttgtacaaataaatcaatcagtatgcatccaattgattggaaaatagaatctaaaatcagtacaataaccgaaatatatacagaccataatttttttgatttgaatatcgacaaaatgcaaattagtagaaatgcataataacatattgttgccgttaggaaaataacaggtttgttatgatttctataccaggagcaaataattccggaaatcaaatacataagaaatacagtcacatattttctcctgtactctttggttccataaataagactcatggtttggataatcgtaaataaatatagtatagatattactgtaaattcaaatgtgtgtactaaattcatttctattctcctatactttttcttttaagataattcagatatttgcttttaaagtccttgaatttagagcttgaaataagcgctttttgaccgttagaaaattcaatttcctttttactgtagccgattatgtaattgaaattgacgatatacgagcgatttgagcggtagaaatactcttcattcaattttttcaccaacgaagaaattttgtttgaataaagaaaaattccttgagctgtgacaacttccgcatagatattgtcggcttgtgcatatattatttcgttttcgggtatcgttatattcttttgattaacagtatccttaactactatataagcagtttttgctagattttttataacagaatccaaagcttcgtacaaatcctctttttcaaacggtttaacgagaaagcgaaaagcattaactttcatactgtcaaaaacaacgtccttatagctgctcacaaatattacggtagtatcaacattgcgtttcctcaataccgaaacggtatcgagtccgtttttatctgtcatttgatgatccataaaaatcaagtcaaaggacatatcggcagctaagagttccatgccgtcggaatattcgtatataataaaattaagaccatgcttatctgcatatatgtataattcttcagacaacgtttttcgaaaaaaagactcatcatcgcaaactgctatatgcataataacctctccctattattttctgatattttttgttgttcttattatacaatattttgacattaatttcaagctattttgagctttacaagaaaaaaaggggtgtttacaagaattttgtagcctgttttagaaatcggtgttatcttaatggcatcgatttgtaaaggaggcaaataatatgttctataatttttggcttgcattttataaattcttaaagtaaggcggtgcggttatgccgatagttgaacaccagtatctacattataaaaatgttttatgttttgaaatgcagcttgattacggagaaatagaggactttgcccaaagaatcgattatagtcttgacgttttagatctatcccgtgacgggaaaattgttattactcaaaaatccccttttcttgagtttctgattcctgtagataaacaattttcaagcagcaagcattaccgctataaaccggagttcaaacttgtaaatgctataaggacaagacattacggttctttcgacagtattcaaaacaaagtggaggagcttaagaagtatattcaagaccagtcttttttgcccgctacccctccgtacttcattgttcaggatattaaaaacaaaatttatgatgtgtatattggtatcaatgagaacattttatgaaatgcgaaaacgaggttggattttagtaatctgatctcgtttttgttcctttacaaggaaaaagggggtgtttacaagaaatttgttgagaacagcatgattttgtggtatttttatggcgttagtaaactaacaaggattttaaattatggaggtaaaagttatgatcaaacagaaaacaaagtcacggctcaagcgaacgctatccggagtactggctttagctatgacagcgagtgtggcagctgtcatgccggcagcggctgaggaaaccgccaagtatccctatgctgtttttgccgcagacaatgacgcaggcatcacaataaacactgacaatttcacactcaacggcagtgcatatacaaagggtgtgtttggggcaaccgctcagtatcccaatatcaacggtactgttacagatattgacgatattacagatgaagacaatacagagggagaagaaaccgaagatgtatttgatgtaagctgcgatatgatacttattcacaccaagcttgcagacaaatattttacagaaaactgcgatacatacaacgaagattacacatattccgatatgaatattaatataaataattctgtctacgttacgggtagactgagtctagacggcaatatcagcctgaataacgctgtgggagctgtttcggacgttgatctttccggcggaaatcttaacggcaacaacacggtcatctattcaaagttcggcgatattgacatctcaaacagtcaggcttcggtaaacggactgatctatgctccgttcggaactgttaccatagactgcgacaacttcaatatgaacggacttatcattgctcagaatgttgttatcgacggatacggagcgaatattaactacagcagctcgtgggcagagcttgtcggtacagaatccgaagaactcagttggacaatggacgactggcagtatcttgccgatacggacgatgacggtctgcctaaccttatcgaaaaggaagtaggctcagatccttacaatcccgatacggacggagataatcttcccgacgggtatgaggcattaactcttggaacagattccacaaaacccgatactgatgataacggtgtacttgactgcgatgaggattttgatgaagacggtttgacaaatcttcaggagtacgagcatggcacagagccttacaatgaggataccgacggcgacggtcttaaagacggagaagagatcaacacttacgggactgatccgcttaaggttgacaccgatgatgacggactttacgacggcgacgagatctactttgaaaccgatccgctgaatcccgatacagacggaaacggtacccctgacggtgatgaaaagcgtttccaaacatttattcataaggtagaaaatgaagattgcgctgttgccgaggttcgtgtgtctatggagggcacgggaaatcttcagaagaccacaactgttgaaagcattatgaataaagacattctttgttctgatgttgtgggtttgatcggtgagccttttgagatcaaaacgacttcgaagttcgataaggctacgcttacatatgtgatcgataagtctaagcttggtgatactgagtttgacaacctactgtttttatggtatgatgaagaaaatgacaattttgatgagctggataccattcttgacgaggagaattcaactgtaagtgtggagactacacacttcagtaagtatatgattgttgacggaaaagaatggtatagagcatggcaagatatttacactaaaataaacgaatcaaaaggccagcatattccaaatgcaactgtattaatatcaaaaagttcaaatatatataatgttaataacgcaaatcgaaatgaacttatagttagtaatattgtagactcaatgtcggattcagatattatgagctttttgacctaccagaatgctggtggaatgaacaccgattttacgagtgtcaaaagtgcgttgaaatgggatccgatttattacagcagaactgctaatgctagttatggaattggtttagcagcagttatactcaatgatgaggctatggggtataactctaaaattatttttattactgacagcagtgtatcagttgacagtagatttcttaagcttgcaattaataacaagatacctatttactttttctgtattggtgattttaatacagctgcattgataggttatgcacagctgacaggcggcaaggtatactctgctaaaaccgctgctgaaataaatcaaagctgcgatgaaataggtcctaagacctttgttggagaaacagacactgatggtgacggttttacagatattgaagaaatgagcggtcttattgtaagctcaaattgcaaaattgttaataccgattatatgaaagctgacacggatgatgacggccttgatgacaatgaagaagtcgatgttgaacttacgaaggttgaagtacctggaaagcagggcaatccttcaacgttcaaatactatcatcatatgaattctgacccctctaaagctgatactgatggggatgggctggacgatatggaagattttgatccaaccaaacctctatcgaatgatgaacgaaatatatatgactttttcaataatgcagaagattatgaaataagatatgtacttgaaaatccttggatacagcagttaggtacgctcaaaggcatagaatgtgttaaaatttgcaggaaacatttagttgatcgagaccttaagaaaatcgaaaatgagatgattactgcaggtataatgtcaaatccaaaaaacggaaagcctatagataaaataatgcaatttttgtgcggacattatgggaacccttccacaatgctgttctccgagtatgaattgtataaaaataatatgagcttctctcaactcatcgaactgtcttggaatgtatggagcaatgatatgaaaatggttgctcaaatatggctgtttaatgtttccaatttgattcagcaaggttgggctgaatgggattattcgcctgaatataagttgtcgttagaacaggaaagatcactaaaaaatgttgtaaatgcaaagagaacaggtatattaagaggcgataccaaaagattaaatgctaacgaaagaaaagtagttagtgaattgctagaggaaggcagatcaattgaagtgttacctgaaggtacacagagttctcctgactttgtagtagatggtctaaaaacagagctgaagacacttgaaaatcataatttgaatactcctttgaaaaaaataagaaaagcctttgacaagcagggcgctgatgcaatgatatatgatgtacgtccagcacaactcacagaagcagatgtaaatattgtatatcaacgcataacaggaatatatggtggtaaagttccaggcataattgaattttggacaatagaaggaaaagtaatatataatacataggaggcagtatatgcgatttttatgtcgttgtggcaacatgcttactaatcaattggaccctaacgatacagagtattatgtgtactctgatcgtgaatggtctgaatttgaaaaaaaggggtggatatatttaggcacggaaaaacaacattgttcaccaccgacactatctgcgatctggctgtgttccaagtgcttgtgactgctccggccacatcgcccgaggcgtaggcggtggtcgtaagctttgcggcaaagcaaaaagctcctgcaaatgccgcagccattctcttggttttggctcttctcattacacatcattcctttcattattctttcttcttgcaaatattaaggacaaaagcattacagagccgatcataagatagatacatatgccattgtctgatgacacacctgtgtgagggttgtctgttgtgactgtgtgaggcgtgtcaggcaagcttggcttagcctcgtccaccattatgactatgggtgtgccgtcttcagcaatcactgtcgcatctgcattttctacggtaacattgccgtaaacatcgactgtaaacttaatgtccgttgcgataacataaccgtcgggagcggcgatttctttcagcgtgtaatttcccacaggaattttggttacaatatgatccgtgccgtcggaagtccattcatcaacaatatttccctcagagtcaatgatctgcatttttgctcccttaagctcgtttccgtaaatatcacgttttgaaatctcaacagtaataggcttgttttccgcagttatctcaataacttctccgtcctctgaaatgcttacgggatagcttttattgctgagaatatatcctctgggagcttttatctctcttacaacatactcgccgtaaggaatgtttccaaactcaaaatatcccttttcatcggatacggctgtcattatggcattgctttctgaaaacactttacagtcctttcggaacagtccgaacaccgcattttcaaggggttcgctcttgtcatcggtcttatgtccctctatcctgccacgcttgataatattttcaaactctccgcagtcgatatccacggtctgaatatcctgtcccatatactcgaatgtcacaaggtacttttcgccgttgaggacgtaatgttcgtcagtagcgatctcctgaacatagtacttgccgaagggcagagcagtgtcaaattgtgcgctcatatcttcttcaagactgatttcagaaataagaccgccggcagggatcgacgtgccgtttgctgctgtgatatcttctgcggcaaacagtccgaaacgaacatttttgtactctccgttactgccgataccgaacagttcatcattttccattgtcttagaaagccttatcattactctctgatattcattttcaaactctatatccacagtatctctcacctcaaattcctgtcctgcatagataagctctgcatatttaggctcgctgttcatcacatatccaaaaggagcttttatctctctgacttcatatctgccaagatacagcggctcagtttccccatagccgttttcatcggtcattatctccgctacaacatcgcctgcctttgcgtgaactgttccgtctgctgtaacaatatcctctgtggctgttacctgaaataccgctccactaagagcacattccgtaaacacaggcttgtatgtggtctgaccgctttccatgatttcgccgttctcgtcaacggatatggcgcttcccatagcggtaacacctgtaaatgcatcgcccgatttgtaaaccgatatctttcctttctgcgaatcgtttcctacgtcaatattaagcttggagtatgaaacgctgttgcctgtgaacttaaattcaaaggtcttgctgtcggagttaatggcataaccctctgccgccttggtctcggtaagagtgtactttgctcccacatacatctgtgcatttcccgtatccgcatgacctgtgctgtcggttgtcattttgcagattacatctcccttcttgtgaagctgtttgccgcctattgcaaaatcttccgccgctcttacctcaaattcaactcctggaagaggtttctttgtttcgctgtctgctttgtaaacttcaagagttcctctctgaacatcgtttgttacggtcacttcgtgagggatagtaagggtatcggctttatccgatttcgccgtaaacttcgtattctccgcagaaataacatacggctcgggagcggaaacttccacaagttcatactcaaagttcgggtagatgggtattgtctttgtatatccctgcgttccgtcggtttcgtattctgtgtaggtgcttgagacataaccctgttcatcggtcacaacagtacccacagactcgccctttttctgaacggtcttgccgttaaaagcaatatcctgcgtgggaacaatgtcaaaagcaacaccctttattggattgccgaattcgtcaaccttgtgaacctttaaatctacaagctgcaaagtatttggaatatccgcagtgtaagttatcacaggattcgtgccgtcctcaatatccgcaattgtggtcgttacagtaaatgaacggcttaactctccgttctcgtcaagcataatatacttgtcgttttcacgctctgttacggtataaacgttttcaaaggtttcaccgttaagcttgccaagagcaagattttcaacgcaagcgtaaccattgctgtcggtagtgacactctttacaacctttccatttagcgaaatatcgaaagtaactccttctatcttaatatcattaagaacatcatatttgttaagctccagcttaagtgtaaaaggcttgtccgttactgaataattgtaatccgaaagctttgcattctgaaaattatcaaggtcgttcactaccgaatttgcacggttcacaagatgatattcggtgtccagaacatagccgttaggtgcagtgatttccttaacatagtagttggtgttggggagcagatcgtaatcgaactttgcttttccgtcacttcctgttgttgcggtttttaaaagcttttttgcggagttatacagaccgtactttgctcccgaaagaacatcgtttgtattgctgtccttctttgtaagcacaagactgtaatttacaagctgatttactatctcagcactgctgtgaagtctgttatcttcaagtttgtttgatgaaatgggataaagattttctgctccgagaatatatttcttcccattttcatcagtcagagcatatgacttacctgtatcgtttcttatgataccgcagatatctctttttgaaacagcgtctttaagaccgctgaggctgtatgcttttgaagtctcaagactttcatcatagccatatccctttgctccgtttatctcgataaacacaagctcctttgcattgcctgagctgtcaagaggtacaagatcaaagaaaagctgaccgaagtgatcgcaggtgtcacagccactgtagtttgagcctgtgctgaaaacatatgcctttgagatatcggttgtagtgcgtgaggtatcgaatatgaggtcgtgattcgagttaagcttggttggcacatagtaacagccgtcccctgcggagtacgtctttccattaaagccgtcaaggtcgttaagatcgcctgaaaaagctttgtctgcggacttgtgaccctgcgagatatatctcataacaggcttgccgttttcctcgtcccagtaacccacaataaatttggtggacttgtagatgtcggagagggtcttgatgtcgctctcgttatcgcttgataaagcctttccatcaccgttgagaatggttttgtcaagcaccgcagttccaaatttagcattgtagcttgtttcgctgttgttcatcttgaccgtctttgttcctgcgtttgaggtaaagtcagatgtcggcgaaggcaaagtgacgctctttgacagcttttcatacctttcattatcggggacagtatactccgttaccgtatatgtcctgccatttgaagttgaggtcggcagatcgtttactgtgaaagtaccctttgtgtctgtgtttttaatggtcttaaactttgtagcctcgctgacagaagtcacatactttgaaaaaacatatccagttcctgcactgtttttgtctgcctgaacataatacttttttccgtcataaagacaggaaactacaaacgtggtcttgccaagaagagtattaagctccgccgccgttatctgattattgcctgaatcggtgtatgtcttttcaacggtaagattcggctcgttgtatgatgcaagtcccacatatcctacgattgggtcgagtctggttgaaagcaggcaggtctgatagtagctgttggcaaacaaagtttcctgctttttcaggctgttcttcatctgcatcgggatactttctgtaacatagatattgctgtcgccgcttgaagagaactgcctttcctttgaccatatggtgtaaacagtatttgttccgctcatttctgtttcaatgccgtagtccttgccgaaagtaccgctgaatttagactttatcagcgatccaagcttgctttcaaggctgctgaaattatgtgcaaggcttgaggctgtgacataggaagtgggcacagtcacttttgtttcgtatcttagattttcagcgttgtatttcataacgtgtgcttcgtcctttgcctgagctttggtggatttcatagcagagggaagcttgtaatgatccttcacatttgaaacaatatcgttgtacgctttttcaactcccgatcttgtacaccagccgccgcttgggtaggtgaagtcattccaaaggatatccgagcactttgaaaaggttgcctgcgtatgtcctctgtagcctaaaatgagctcccatatgaggcactgtgttgcggcatagtagtcacctgttttgtggcttgaatagccgtaatactgcacaagaccgagatacttcgccataggtccgtcggttccgcctatggacttccaatatgcaaagctgtctgccttgttcttatcggtcagatcaaatgtatcatactttgtaaagccgttctgagtataccaatccttgtagcttgctccctgcattgactttgcaggctcgatacaaaacgcccagtcggaagttgatgacggacagaatctgcatatctgctctccggctttgatatattgtccgcttactcctcctgctgcgccgttctttctgtttttgatagttggattgaccgagctgttccaggtatatcctattgatactcccgatgtggctgctgaaacattcgccgtcagcgtggtcattcctattgccgccgcaagcattgccgctgtgcagcgttttaatatttttcttatcttcatctgtaattactcctttgtttttttgcaaagaaaaaagagtcgaattttcgactcttttccctgcttattcagttgtttttagtcctccgtaagaaaccatattgccgtgccgtcaaagcctacattaaactcaatatcgcttgcatatttgaggacattattgccgctgtatatctcccacctgttgaacagtccgtagtctatgacgtgcagacatttttctctcgtttcactgactatgctgtagatctctccttcgtttcctgcatgatctatcagccatctgctgtctgcgtcagcatatgcgtccatgtgagcatatgacaggtcggtcatgtcatttctgaccgtaagatctagcggtttctcataaaatatatcatactcatctattccaaagcttacatggatatctcttttgccattgaagcttttggcatattcaagtatttcagaccttatgaggttttgttcatcatcgctcaggcttttgccctcgcacagctttctccatgctttcatgggctccgaccactgcatggtattttgcggttctgttgtgctttgctttgccgttgttgtctgcggtttctgtgtagcagttgaaggctttggtggggctgttgcagtctgcttttgctgtgtagttgttaccgcaggtatttgagtagtatcaacttctgtattttcctgcggctttgctgtctgagaataactctgctgtttcgtttgctcctgcggtggccgcagacttacatccttactgctgaccgtacttttcttggttgttttagctttggaagtttcggataccgtctgcgaactctttttaatggtcgttgtggtttcacttgtatccatttcttcctttgtcgatgtttctgcagaaactatagccgtgaccgtagtttgactagctactgaagagctttcgctttccgtggactccgatacatttccgcaggctgataaaaataccacacagaatattgatatgaccattgctcttttcatatcatcacgctccttgacaagcaatatatcacactagtactttaaaatccagactttttattgaagttctacctttgtgacaatttgcacagcataagctttagcaaactacatacttatctccggtgactcttcaaattcttcaagcggttcgatcacttcaggtcttgtttctctcacagcaaccagcccgataccaggcagatctactatgatatgatcaaactgctgcttgtacttttctatctgttcatcggtaagtgaacaagagtcccattcgccgtattcgttcagacagttgcccgaaatatagaaagtgccgtgaacaagtgtatttccaactatcctgttaggctttgaaccgttcagcagaaactcatcattgcaccacgctaaagccttgccgtcagattcaaaatatataggttcaatgcttcctcccactacttcctgcattgcctggatatcgtcctcgatatctttcacatacggttctttcagaggttcaaacacaagtatcctcattcttttgcctcactttcacaatactctttcagcggacaatcgccgcagtcatcaaacatcgcacaggtacgctgtatctcttctcgttcctgcacacactacccaaaatctgacctgtgaaccatttgtcaaacttgtaaagaatgctattgattgggtttaatagcattaatagagcgtcaaattccagtttgcacggctattctaactcacccttcttccttttatgttcaggctcattacgcaaatcttcaagataatcgtcaatcgtctgacttgccttgtccaaatcagcatattcttttttgaggtagcggtattcttcataaagtttttcccgttcctcatacaacgcctgcctttgacggtcaagcaccatttctgacggaaatctgccgtccggatacaataattttaactgacttccaacgctcttgtacttttccagtacaggagcgtttttctttgcataatctttttgtttccgtgctgaaagggacttgtacttgtcatgatgcggtttactgcgttaaaattgccggacaagttctacctggttttgtcaatatcacttgacacattttattcgaacaagaattatgcaacgagaaagatatgatcatagtagagctttcttcgggttgacggaggcagcccgccattggcggtgcagattccccacatactttcacagcgtgcattatcatgacatcttccgccggcactgttcatgctttgaatgatcccatatttcggctatttcaacttccgtgttgataaatgtaaactttttcagaaaacaggttgtaatatatgacaatttgggataaggctgtagacaaatggggcgattggcaagctgcacagcatatagctaagaaatatgatgatgacggatatcttcgcaagaaggaatagcataaacaaaaataagctgctacagaaaagtctgtggcagcttatcctttttagaacagtcctaattttaacctatcaatatcggctcctgatatctgtttgtacgaatccataagattttgaatcatatttaatgacgagagggtcgaaggaccagttgcatagtgtattgtcggcgaaaatttattatacgaaaaaatggctttggtttataagcatattacttcttcgttgtcacactcttaacaaccgaccattctccaaaatatttagtaccctttacaagcgtatatgaacgtaccttaacatagtatttcttatttgccgaaagctttgaaatcgttattttgtcggtcttgttgtttgcaacatcaagcttctttgcgcctgtaaacttagagtttgtggcgtactgcacctcataacctgttgcagagcctttctgcgcccaatcaataaagaaagcctttgacttcgctgtgagtttctgtatcttctgcttggcaggcagtatatcaaagcttgactttatctcgccgatatatgaacctgttcctgttatggtgacttcaacagtacccacctttgtgtttgcagaataagtaaccgtatagtcagtaccatcatctatgtaatagaacattattgatacttattaagacgcatttgactaatctggaaaataaattcccatttcatcttggttaaaatcgtatcgtgatatgctttcttcatcttcagttgtactgtcaaatactcgaatagatgatattttatctgtctgtttattatcaaaatgcagacaaataaaagcatcgaaacgccttagttgaatgcaaatagtatcattgacctcccatgcggctaacaaattagaatatgaaggagtatatcgttctataaatttatccatattcttcacagcttccggatcctccagaaactcattggaaaatatagtttcaagctcttctcggtctttattatgcatcgccccgaaaaatgtgtttaaaatatcagactcggtttcacatccggggtaatatattccggcaagcagatctccgccgcctgctcctctctgatcttcctcacattcttcaaaaatcaagctgtatacgccttgggcagacggatcagtttcctgctgtatccactcagtccatgttaatgaatagcatttttcagtagtcttaattacacagatcgaccatacacattttgcctgcaaatcagaaaaagattctgatgactgattttcataaactatctctaaattgtcaccctcaaatatattaaatatgtatttgataccttcatcaatatcaggctgtaatttcaaagtctgctctgaaaaaacgcttttaaaaagttcagcatcgttggtctccaaggcttgtatcagaacatccgaagtatttttcgttgaggtttgatcgataattaatttatcatcattttctattgaactttggctatcgtttaatatagtacagcctgtagaactcgccaccagtaaaaaaagcaaaatggatagtataagttttttcataattaatcacttccattaatccggcaaataaattcccgcattttcttccgataaattataatcaccgatagtcttttcatcgtctatctcggcaaattttagaaaagatattttatccgtttgttccttgtcaagtctaaaacaaaaacatatcggagtatcatttttcatggacgtaatataaacggtaatatttccatcatcaatttccgtccagccttcgtgaagttctcgcattggctgacagtaatcaaaaaagcgatctatttcatcgtccgttacgcctgaagccagcatattgtcagaaagcagctcacgaaatctctctatgcgatcgtcatgatttttttgctgataaatgtttttccaaagagtaaacgccatatcactttcctcggaattagcaggatacactacccctgcaacaaaaagatcttcacctccctgatccagtccggcatccggccaaatctggagtttcatgctgtagactccttctttctccttatctttttcatttatcgtccacgcattccaagtaagcttatagtagttttctgttgttttaaaaacgcataccggagaaacaatacatctttcaccaccgctcgaatatttatttgagcttgaattattctgcgtaacttcaacaaattcgccttcatatatgctgagcatatatccgatcccttcatccagatccggacaaagatctttggcacgaacagaaaacagatttttgattgcgtccgcatcgttattttccaaagcctttattactgtttctgaaacactcacattctccgtctgatcaataatgagatcaccttcataatggctgttcaatttttctacaacagaacaggacattaggcataacatcaatattacggacattgtgcagcaaagcaagtttttaaattttaacataatattctccttaccaaatcagagttacaatgtatgaacccgaatctttttctgaaatatcccattcgacttctcctgcattaaattctctgaaagaatctaacattatatctttgttttctccaaagctcaaaaaaatctatagtagttacggcttgtagatcctcagttttaacattctgaaccaacggatcaaatccagttagccaccattgtaattcatctggttcatgtttatacagctgctcatcatcactgaagattccatccccattagaatcatgatataattcaagagtcatatcaacagaatattctctgttaacctcggcataaagatatgagtattcaccattttccataatataatttccatactcatcaatttctccatctttcacctgataaatacctgtttcagcgcctgctccaaggttcatatagtcgcccttccatgaccatattataaattcttctccttcatctttggatttatcaccgtcaagatctacccaaaaaaatctgagattgatgaacatctacggttatttcaccgtccgaagctttgttaaccgcagctcggaaaacatcgtcatagcctgtggtataatgtgcatattgctgcaaacaatcaggtctcatatgatagataccatcatcatccatatctgcacctaacgtcaaggagaaaaatcctgttgtcatatctgcaacaacattcaattcaggaatatatgaagacaaaatcggatgctttctctcaaatactgcagcgattgttcctaactccgcaattttctttatcagccagacaccacctatctgataaaatattccaactgcaaaggttacgaaattcctgaatccttcactatgaattaatttgcctataaaattaaaaaagtcaaaatctataattttattccataaatctttacaccattcacaagctgaatcaatccactctttagctttttccaaccagctcttttcgcattcgggtttcaggtattcatacttatcgtaaaaatcatctttgctattattaataacatcagcgacaacgccgtcaatacgcacaacatattcctattattttattgccaaatgttctattttttattaatataaattattttatcaggatcaacatttttcaaaagatattctgacattatttcaaatccgtccataagagtttcaacagcaaaatgctcagagttcacataaattaaaattttttcattaacccctaatctagtatcattaattatccattttatctttgttatttctgaaacatccacactatatttgaatcccaaaatcttcctaacggttattttgctgccacttactacaatttttaattttcttatccacaataatgaaatagctattggaataaaaacgaataatattgttgaaatatacatagggaaatgcggaggattaccaaaaatcgtatacattacgtttaaaacaatgaaaaaagcagttataaaaacttcacctttataaatctctgacggtatcttcacagtaaatttcgattttgatttcattgatcagacctccttcatttcttattaattttgtgacaactctctccattcgtcataccattccttaatctcatcaaaaaaaccacttgctatattttccaatgtacctccagaaagtcctgaaattacaccatttctaattgttttataatgaaattttttaatacttccctgttttaattttgttattaccattttaaatgaagcatcatagctatttatgcctgaaagtcttttgaacaccggaatttttttcgaaagagtttttgaaagctttccagtaattttacttaaagcaacactaaaaaaagccactgttcctgtgcttaaaccagtatcaaataatatttcaaaagtcaatcttttttgtccccaagtgatattttcaagattttcgccaaaaaacgttgatattgccgcctctgctgaacaagcagcaattggattagtaagcaataataaaacaccgccagcaaaaccgcctatcgctgatccaatatatgattgccagttaccagcccaatcgcctgttatcgcacatgaaataatatcactaattaattgacctgaaacgcctacgattgctccaactacaccaacagcaattactggaattgccgttccaaatgtcgaaatactcaatataacaataccgacaacaatgacaatagtcacaaacacactaactattgactgccaattttccttgcaccactcacaagcactatcccatttctcttccaaccagcttttttcaatatccggttttaagtattcgtacttatcataaaaatcattcttgctcttattaatagcgtcagccgcattttagtcaatagccacaacatcggaaatgtattcactaatattttctttcaatgactcaagtgatttaattttgtcctcttgggtctgcgttgatgattttattgagctgataacatcatcaacgtcgtatatgctttcatctatggaaagcacttttgatttcagtgatttcaaatcagcattatcattactcctgtttctttcttttattataccactgtcacgatgttttggcaattttgtgttcagtttctagggtacattatacagagctatcatataaagaggattggacaccagggcaacgagcagaagctgatgcaaaatgtaaagcgttatctaaagctgatacagcaaaaacgattccagaacgtggtagcacatccgcttcaaaaaaatacaagaatgagtatggagaaaattcagttttaaagacacaagatgtcgatcacactattgatttacaacttggtggaatagatgatatccataatatgaacccattagataaaagtgtaaatcgaagtttaggaagccagatagcatatttaataaaaaatttggattatgggacagttttaagaaattttaaaatggtagatcaaaaaaatttataaggtggtaaaaagagatgtttgagaaattttatgattttgtaggtgttgaaaacaaaaataatgtgaccgatatgtctggatttatggacatttatggcggagaaacatttttgaatggtttgtatcgtatacacaacaaaaatgatgtaaaaaagtggaatgagatactcaagagagctttccctaaattcaaaaatggcatacaggtattcggatatgattggttaggcagaaattttgcactggatacgcaaagagatgtagtcttgatatttgaaccaggtacaggagagattcttaacactggggaaaactttgtgaatttccatgatagtgagataccgcaatatcatgacgcttgcttggcgtctgagttcttcaatgaatggtttgaggcaaatggcaattttgttttgcctcacaataaatgtgtgggttacaaagtaccactattcctcaatggggaagatgacatagaaaatcttgaagtatccgatatggaagtatattgggaaataatgatgccattaatgaatctttaatcaatattggcatatttgatatcaatttacggaggtgataaaatgcccacaaaccaagaaaaagtttcacagcttttagatactattaggagttgtagtaaaatacaactgtataaactctgactattattgagagcaaagacgatttttacgacgagtactactacatgaagcccgaatgtgaaaaaagccgttgggagaaattcaaagacggctgcaaaaaaagtcggagagtggtgcaaggagcattggaaagagattcttatcacagtaacaattgtaataggagcagtattagctatagttgctgttgttgccactggtgggatggctcttgtaccattattaactatgtcacttgcaatatttggaatttccgcaggccttgttacaacaattgcaacgataactagtctttctgttgctacaatagcgatactttcaactcttggttcaagtacattaaatataattgacacatgggaaaatattgataattcagtttttaatacatttcaaaatatattaaattggacaagtacaatatcgaattgtttttattccattggttctatttatagtagtgtaaaaggaatttcaaatgctgatttaagaaattatggaaagcaatggactactaatcctcaatttcgttcagccataagcggtgcaagtgaatataatttcacacttaaatctgattcgtcaactttctggtctggaattggagatgagggtatatgtaacggagatcaaatagcggcaaattgtgcggataaaatgggaagatctactttggaaacaactctttcatcgaagggtattgaacttccaaattgggatgtttccaatccttctacaataagcgcatggaatagtgcttcttcctcctacgcaatgcattcttcagggaatgtggaagcgttactcggaaatactgttcgaccaaccagtgtatggaatgtctttgaacgtactattttaagaataaatcctaatgtaggaaatatcacaatatatacgcctactgcagttaatgtgattacgcatactactcaggttggttcactaataaggagtttgtttataggaacttctcaaacgggaatattattaaatgattggaataaaaaatgaaagaaattaaaattacaggtacgaaatggtatgtcgatattgagtacaaagagaatatcgcaagatttggtggggaaatgtgcgtagatggtttttatgcaacagtaaatagaatatcttggataaaacatcaaggatatatcgagaagaatgaattgactgaacttatcaaagcggtgcgaaagcaaaataagaatagttcattcaaaattgagtttgtaaatgatgatggaagcgaatatgaataatatttgctggattttttgccgggtaaaggagtggtttatgagatacaataatgaagtatttgtaaaatatagaatagataaaaattctattgttttttggacttcggacattaatgaaaatatttccgatgttgtgactattgactaaaatgtggctgatgctattgattttgcaattgctctaaatgtgcaacatggttctaattatgataatattgaattacattttggattctcacgagaagagggaaatctttttaatgggaaaaattctccaactgttgaagagtttaaaaggagagcaaatgaatttggttcggaggttatgaaagattttgttcatgaggcattacagtatgttgaatttaacgataatttagacattgtggattttgctaatggaagtactgatagaatgatatcctatagtggagatattatttcgacaaggtatgacgatcaggattttttatctgatattgatccgaataatatacagtataaatttgagaacagtaacagtaattttctgaaagttcaacaggaatataataaggctgtaatggatggcagaatcgatcctaaatcggagtccatatcatataatggtggtattgatcaaattcgcaataatataaattacgatgttaaatctactttgggtgcttatattgatggtgaacttgtaggagaaaaaagaagagagcagataaatataaacagcatattgatgcctttataacatttttgcaagattaacttaatgagggatttgtttataatgaaacataaaaccatattttctacgatgataattattacttgtattcttataatatttttggctattgtaataggtttcggaatatggttcttaaacagtgataatgaaacagaagctgatttacagtggaaacgaaaaaccattaacgactgtattaatcaaacaagtcagaattatgatgagatacgtgagttggtttgtgatccgggttctgatgttgcacttttgggacacgattatgatttgctcagcaaattaacgaatcttgaaacaattactattgtcggagtcagtgacgcttcagatgcacagaacttttttgaagagttaactaaactaaaaaaattaacttctgttaatattgtagattcacctattggttcaataagaaagctggcagatatcagaagtctatcaagcttatgcattagatcaaatccttatgggggtgctcgttttaaaattgacgatattgacttgctcggaacagagggaagcttcaagaatttaaaatcgttggaattatacgatgttcaaattgaaaccttacctgatttatccgaattaacggaattgaaatcactttcaatttcaggagctgattttaccaagctggatgatgaaagtgttaattgggagaatattgtatcccttaatataaattctacgaatatacactcaattgataaagaaattataaataaactttataatctaaaagctttagatgtttcttattgtaatattacagacataagctttgtgttaaacttaccaaaattagaagagttctcatatttagggcatgatactcatggaattgatttgaaatgcttaagtgaacatccaaattataatgaagcttggatgaaagattaaaaagtttaatagaagataatgttatgaaagtaatatcaattgaatatccaactccattgaagaattgtaacataaaaaatgataatattgatatttttgtcaaactggaaaacggaaataaatattgcattactgttgcaacagtcgattggataagcgatcatgtgggagaaaggcatttaccaagcggatcacctgattaatagttaaagaattacaaaatcaggtgattgaagatgctgttaaagaatactcagaagatgacgcatactggctgcgggtattcagtatgtcttatggggatgaagtttctgattgatataaacttaaaactttatgacaatcaatatcaatcttagaaataatcaatcgtgataaaatatttaattatgctttaacttttattcaaatgttttgaagataatgatgctcaagaaggatcagaagtaaatgcttttcgacacactttttggatttcaattataacaagtaagtggggagagaatataggcttacaagctggtaatgctcatgaaaaaaatcaaaacgttattcatgaaatcaaagatatatactcgcataagtttaaaactttaagtgatgctgatcaagcagttgatttgttgaacaatgttattggacgggaaattggaaaaacaacatcaattgatagtacatccaaagatatagcaaaaaaaagtattagattactattatacaaatggattaaatattgtgaaggaaactgatgatggatattatgtgactgtaaaagaacgacattcatacgaacgatacaaagatgatttaattatattggaaacacttgatgaaaacggatttccaccagataataaatactataataaaaaaggtgattgaattggtcaagaaatatattagagtaattttgattggagtattgtgtatgggagttatactgagcattttttcaataataaattatcgtcattcaaaatcgttaaaggataaaattataaaaaaatgtaatgatgataccgagattattatacatatgtctgattttactagctttgaatgggataagtgtattgtatatggaccgtcaacgcaaacgaaagatatatgtgatgcatttgatataaattataatacatatctcgatttgaattatggaattattttccttaataataacaatgttacttatgaagaatttttcaaagtctcagattatgattttataaataaaattccagaatttattatttatccatatagacaaaacgaaagtacgcaagtaaaatatgcaagttttgaaaagaatgaagcggaatttaaatgtataaagaaacattctgataatggctattattataggctttaccctattaattaagtcgacatcgcacaaagattttgggttacacttgattttaaataagagcataaagtggtaacaaatgatccgacggcaacaacggctgtatattggtgagcagaatggtatgcgtttttgaaaaacaattaaggtgagatgagatggaatatttattatttgaaatactgtatcgaggtttaaactatgagaagatgcgaacaaagtcttgacaaagcttagctaatatgatataatagataagctgatttaagacagcacattagaaaacacgaaaaagatcggaagtcaaaaaacttttttgaaaaaacttcagaaaaggggttgacaaaagataaaaagtgtgatataatgtaaaagttgcacgacacaaaagagtgcaacgaaacagcatcttgaaaattgaacaaagacgaatagtacgaaacccttgagagattcttttgagaaaaagaattaaaggtctaacataaagacgtaaaagaaatgtacgttcagtgaaatgaactgaaacaggataacaagagcagagatgcttttgatatacaactttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaatgacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtcaacagagggaagcaaagccgcgaggtggagcaaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttctatggagaacagagaaggaaaagaaaacttctcataaacaaattctccggtcagcaaaggtttaagaaagtagtttttgttcaattttgaggatgctggaaacagtatctttaaaacagcacaatggagtacctagtccctgcatatgggggtgtagctcagctgggagagcacctgctttgcaagcagggggtcaggagttcgattctcctcatctccaccaagggacgaaggaagaacgaacagnnnnnnnnnnnnnnnnnnnnnnnnnnnnnnnnnnnnnnnnnnnnnnnnnnnnnnnnnnnnnnnnnnnnnnnnnnnnnnnnnnntaatgggcgcatagctcaggtggttagagcgcacgcctgataagcgtgaggtcggtggttcgagtccacttgtgcccaccagcaagagagatcttgcaaggaacgaaacttgaaaattgaataatgaaaagcaaaagtaatgcaaatgaggaaaaatgaacgacaataacgaaagttaaagtcgggtaaaaaacctgcaattagcataaaaattaagaggattagacataattcaaaaatggttaagctaagaagagcgtagggagaatgccttggcattaggagccgacgaaggacgtgataagctgcgataagctgcggggatcagcaagtatgaattgatccgcagatttccgaatggagcaatccgtatgtgtatgcacatacatcatatactgaatcaaataggtatatgaggggaaccgcctgaactgaaacatctaagtagggcgaggaagagaaatcaaccgagattctgtgagtagtggcgagcgaaagcggaagaggctaaaccataggtagcaatacttatggggtttcggacagcatttagtattgataatttctagttgaaacgtgtgggaaaacgtaccgaagagtgtgagagtcacgtaagcgaaagagaaagtcagcgagctgtatccaaagtaccgcgggacacgtgaaaccccgtgggaagatggggggaccatcctccaagcctaaatactacctaatgaccgatagcgaatagtactgtgaaggaacggtgaaaagaaccccgggaggggagtgaaaaagaacctgaaaccctatgcttacaagcaccgagagcacgtcaaagtgtgatcgggtaccttttgtagaatggtccggcgagttattgtatgcggcaaggttaagtgcttaaggcacggagccgaagcgagagcaagtctgaatagggcgagtaagtcgtatgcaatagacccgaaaccgagtgatctatccatgtccaggctgaagtggaggtaaaactccatggagggccgaacacacgtccgttgaaaaggccggtgatgaggtgtggatagcggagaaattccaatcgaactcggatatagctggttctctccgaaatagctttagggctagcctcgtgaaagattactggaggtaaagcactgaatgggctaggggtcgaaagattactgaaccctatcaaactaagaatgccagataattgattcacgggagtcagacaatgtgagataagtctcattgtcaaaagggaaacagcccagacccacagctaaggtccctaaacattgttaagtggaaaaggatgtggggttgcataaacaaccaggatgttggcttagaagcagccactcattaaaagagtgcgtaatagctcactggtcgagtgaccctgcgccgaaaattcaacggggctaaacaatgtaccgaagcttgggattctagatttatctagagtggtaggagagcgtcgaataaggggtgaagtcagagcggaagcgctggtggactttattcgagtgagaatgccggaatgagtagcgagaattatgtgagaatcataatggccgaaaatctaaggtttcctgaggaaggttcgtccgctcagggtaagccgggggctaaggcgaggcggagacgcgtagccgatgcacatacggttgaaattccgtagccaccgaaagatttaagtacagggacgctttagaagtgatgtagccgggcgatggttgacccggtcgtaagggatcgaaaatgagtagagaagtcatcatggaaagagacaagaaaagctgtatgaatatcttaggtgcccgtaccgcaaaccgacacaggtagataggaagaagattctaaggccaacgggagaagggttgttaaggaactcggcaagttgaccccgtaacttagggataaggggtgctcaagtgattgagccgcagagaataggcccaggcgactgtttagcaaaaacacaggtctctgctaaatcgaaagatgacgtataggggctgacacctgcccggtgccggaaggttaagaggagatgtgagagcattgaattgaagccccggtaaacggcggccgtaactataacggtcctaaggtagcgaaattccttgtcaggtaagttctgacccgcacgaaaggtgtaacgatctgggcactgtctcaacaacccgcccggcgaaattgtagtaccggtgaagatgccggttacccgcgactagacggaaagaccccatggagctttactgtagcctaatattggatttcggtatttcacgtacaggataggtgggagactgggaagcacaggcgtcagcttgtgtggagtcgaccttgggataccactcttggagtgctggaattctaacctgcggctttgaagcaagtcgagggacattgttaggtgggcagtttgactggggcggtcgcctcctaaagagtaacggaggcgctcaaaggttcgctctgcatggatggaaaccatgcgtcagagtgtaaacgcaaaagcgagcctaactgcgagaatgacggttcgagcagtaacgaaagttggagttagtgatccggcggtatgtgaatggaaatgccgtcgctcaacggataaaagctaccctggggataacaggctgatctcccccaagagtccacatcgacggggaggtttggcacctcgatgtcggctcatcgcatcctggggctgaattcggtcccaagggtttggctgttcgccaattaaagcggtacgcgagctgggttcagaacgtcgtgagacagttcggtccctatctgtcgtgggcgtaggatatttgcaaggagctgtccctagtacgagaggaccgggatggacgcacctctggtgcaccagttgtcacgccagtggcacagctgggcagctatgtgcggaacggataaacgctgaaggcatctaagcgtgaagccgcccttaagataagatatcccttctgtttacagagtaagaccccttgaagactacaaggttgataggctcaaagtgtaagcacggtgacgtgtttagctagcgagtactaatcggtcgagggcttaaccttgttggttatgactactccttttaaccaacagctttttcattattcaattttgaggattcgttcctcttcacttagtcggtggcgtttgagttgaggtcacacctgttcccatgccgaacacagtagttaagctcttcttcgccgaaaatacttggatggtaacgtcccggtaagatagggtgctgccgacacctagagccagaagacgtggcttaaatgccatgaatttagaaattgcgatgatttgctgtggttttaatcttcataaattccacttgaaaaagcctgcaataaaaaaagcggcataaatttaaaatattttccacatttttaacacggcaaaaacgcagtttttgtgccgctgtgtttgctgtacccttttttcaagattagatagttcttttttgctgtgtgatatattaaagcccgtgggcttccatatcgagggaatccacgggctttgttgcgctttttttacagcgccttatttttgtttatgctattccttcttgcaaagatacccgtcatcatcatatttcttagctatatgctgtgcagcttgccaatcgccccatttgtctacagccttatcccaaattgtcatatattacaacatgttttctgaaaaagtttacatttatcaacatagaagttgaaatagccatataaatttatcaaattccattagcatctatcactgataggtgctttttttcataaccaaaacaagaaatgtgtggaacaatttatgatataaaattacgaatatgctccccaatgctatagataccataagagtcgagaaatcggctcttttatacagtagagggatactgttggatatattccattatttcacacataatattaaggacaaatttgcttattctattgacatttcccttattttatgatatagtttaagggaaaataatggaggtaaggaaatgagaagttttaattactctgcttttaaagaacaaaagtgggattctggtattctcggacttatagcggccatatacaaagaggctggaaaacaggaacagtatctgaaacagcgtccgcaagagatggagaagcttgttgagatagcaaaaattcaaagtaccgaagcttcaaatgcgatagagggtatcgtaacaacaagcacgaggatcaaacagttggtcgaagaaaagactactcctcgaaatcgtgacgagcaggagatcgcagggtatagagacgtgctgaacgttatacacgaaagctttgacgctattccgataactcagaactatattctgcagattcacaaaatgctttatagtcatatgaacaatccgcttgctggcagaacaaaaagcgtgcagaattatatcagtgcggcttaccccgatggacatacagaaatactgtttactccgctcgcaccatatgaaacatctgaggcacttgacaggatatgtgaagagtacaatcgtgttatcggtaatttggaggttgagccgcttataattatccctatatttatccacgattttctctgtatacacccttttaatgacggcaacggaagaatgagccgtctgcttaccactcttctgctgtatcagaatggtttttacattggcaaatatatatcgctcgaggcaaagatctctaagaacaaagatctgtattacagtgctctgagtcagtcgcagacgggctggcacgagggcaaagagaatgctttgccatttataaagtacattttaggcacgatacttgcatcgtataaagattttgaagagcgtacctcccttgttcaagaaaaactgtctgcatttgagatggtcagaatggcaagcaaaagcaaaataggacgatttaacaagcaggatataagggaactctgtcctactctcagtgacagttctatcgaaggtgcactaagaaaacttgttgccgcaggagaactaaaaaaagagggcaagggaaagagcacctgctatttcagattaaattagattagaagatgttctacacatcgcatgactaggttttggcggacttggagcggcaggtgagtttttaggtaatgccaaggcggttagtttgcttgctatagaaaagataaagtcaggagataaagtcatttcaacagaccctgaaacaatgaaaacttctcctaaaactgtccttaaaacctacataagagaggtaacaacgcttgttcatctcactgtgaacggtgaaaaaatcgttacaactgttgaccacccgttttatgtaaaaaatcaaggctttatcaaagcaggagaactaatagttggtgatgaactccttgatgtaaacggaaatgttcttttagttgaaaattttgatgtcgagttgacagatgaacctgttacggtgtataattttcaagtggaagatttccatacttatcatgttgtcaagtgtagactgcttgtacataatgcaaattgtaatcaagaaaagcctgtgcttccaaaatatgatggaaaaacaacagagggcgttatggtaactccagatggaaagcaaatttcttttaaatcaggaaatagttcgacaccttcatatcctcaatataaagcacaatcagcaagtcatgttgaaggaaaagctgctttatacatgagagaaaatggtataaatgaagcaactgtatttcataataaccctaatggaacttgtggattctgcgatagacaagttccagctctacttccaaaaggcgctaaattaaccgtggtacctccaagtaattcggttgcaaataatgttcgtgctatcccagttccaaagacatacattggaaatagcactgttccgaaaatcaaataagaaaggaataaggtaatcaaatgaaaataaaacattttggaggaattgaatatgcaaataatatttctgaattttcagaaatattacaaaaaaaatatggtgatggtgtcaacgagttttggattactaataatactcaagagaatccttgcttagtggtattagtaaacaaagaaatggcgaatctcacctattttccagacgaggagtcactcggttttcagtcagttggttgccagacaaatcagaaaaatgactattgtattttttatactaatacgcctgaagaagagattgaaatcagaagagattcaattatctcagtagataaagctttcgaggcagccaaaaaatttttttataaacgtgaaatgccagataatattgaatggactgaaaattaaaggtttataattttcaagttgaggattttcatacttactatgttggtaagaacgggattttggttcataatgcagattactccacagttgttacacccgatatggaaaataaaatacttgaaggtgaacgtgtaggttcttccaacagaattaagggtggacattcacccaaaataaatgatgctaatcctaaatattcagtagaagtacaacaaacattcccagatggaactaaaaaaattaaattcataacagagtttccagatggaaatgtatccaaaattaaaacaagcactattttcccggataactggtctgatgctaagattattgatagtataaaacaagttggagatggcgttcctattggtaaaagaatagccgacaattcgtatttatatagagatattatcgatggagttcaaatagaagttataaaacaaggaaacaacgtaatcgcaggatatccaacaggtggcggaacaactggcttgccaactgggtttacatccaaataggaggaaacttatgttaaatgaatttgaagaatacataaaagggaatttttcagatgattattggtatgatgacgcattattcttatgtgaagattttctaaaacatttttcagatttagaatggactttactaatttctaaaatgcaaaattatgatattcaaagtcaagtacggcttgcagaatgtttggcagatgttaacaataaatatagtgttaagattctgataatattaactcaaacagaaaatagtaatttattaattacttgtattgattcgttaagagatgcaaatttttctttgttaactgttgaagaaaagcataacgtctcaataaatgccaaaaaagtactaataagttgctccgaaatggagaagaaagttattcgtaattttttaaacaaaatacaatcctcacaataatgtggagaaatttgtaatgaataagaatattatcaatctagtaagtaagatggatttaaataagtccgctgatgaaaaagaaataatggaggtagagaaccgcattggcgttaagctacctattcaatataaagaatttatgttgtattcaaatggtgcagaaggtgaattgggagaaaattcatatttggttatatggccaattgaagaaattatttcactaaatgaagcatattcagtaaatcaatatactcctggaattttatattttggttctgatggtggagacattgcatacgcatttgatattagaaatgaaaacatatcaattattgaaattccttttgagtcaattcatattgaagatgcacaactgtgcgcatatgatttcaatgattttatagaaaagatgtataatgaatagtcattgattaattaaaacatagtttgcatttgtgcaattcaatcagaaacttcactccagcaaattatacaatggctttcaatttacagtaagtgccttagctgtttttagtggaagcacttataattcaatgaaaaagcatcaagaaacgcttacttgtttcgttgcaggaacaatgatactaacagcaagcggacttgttgctattgaaaacataaaagcaggagataaagtcatttcaacataccctgaaacaatggaaacttctccgaaaactgttcttgaaacctacataagagaggtaacaacgcttgttcatctaactgtgaacggtgaagaaatcgttacaactgttgaccacccgttctatgtaaaaatcaaggctttgtcaaagcaggagaactaatagttggtgatgaactccttgatgtaaatggaaacatttttttagttgaaaattttgatgttgagttgacagaagaacctgttaaggtgtataattttcaggtagaagatttccatacttatcatgttggcgaaaatggagtttgggttcataattcgaattgtaagctgataaaaaatgatgacggcacatatgatgcagtataatgtcccccttgtcaagacacaaatgaaaaaaattatcgtgacagcgaaaactttgtatagccatccaaaaaataccacaaaaaaagactgctgtcttgctttttggcaagatcgcagccttttttcttggggactttttttacagcccctttttttacagatgaaacaattccatttaatactcgtcaatagtttaaaaatatgattaaaacgttataatattacgataaatattggatatatgcagtgcgagatgtcagcagcaaggcgtctgacggcaaggcaacaaaaaacatcatgccaagtgaaatacagggtattgcaggtcttacagcagagcttaaagaagttgcttactaataccgtcaatagctaactgttttttactgaataattttcctcctgcggatataattatattctgagtatgattattaaacgaggacgcagatatgagcaaagaagtatcattcaagaaccgtcaggttttgtcgatatcacttgacacattttatacgaacaagaattatgtagcaagtgagttcattgaaaaggctatattgttttatatcggctatctgagtcagcaagataatctcaactatatctctccaatgattaccgaaacagtgaaagcgcagatcaatggtacagaacagcgcttggcacgtttgctattcaaggttgctgttgagcttggcaagctaacgcacctgcttgcggtggcgaaagatgttgacgacgaaacgcttcgtcagcttatagtcatgtgcatcaacgaggtgcgtaaaatcaacggtgccattgactgcgaggatgctgtcaggtatcagaaggagtaaaacaaaagccgtgatcagagtgtgtctgattacggcttgtacataatactcggatttgattttttacttcttaatcatatacttatctaaatctgatgtttcacatctaaaaataaaccattcaggaaattcattcaatttgaatcgtataaattcatcaacagtgcgataaatctcatccttttcaggatcgtaatatgaacttctgttggcgtaaatcgtaatgcctgtaaaatctttctctgactccatcggacatttacacggagcatcgttgttggttatgatgatatgctcttcggtttcaccttctaatggtgacaaataaaattctccacaggcagataaattattctccactgaaaactgaatttcattattcatataatccgccagaacttctctgtttatccgatagataggacctctaagaaaatcctttattttagaaaataaacccataacaatctccttaatccaaacatttctcttcaatttcctgattggcaatgatcagcttaataaactccacgagattgtcagcgacgaaataaacttcattatccatctcgttgtctattctgacaatgcgaggttcgccgttttcgtcagcagatctgaaatccatgtaatacatatcatgacctgctgactgtgtttcaccgaaaggaataccaatgtcaggatactcccattcatccttccagttttcaaacctctcttccagactgttgtatgtgtcagcagtgggaccgattccgtagatcgttgtcagccagctctcatcaaattcatcagaaatcataccgccgttttgaaccttcagcagttcaatgtatgatgcaggcattttatatcctaaagtctgttcggctcttgcaatcatctcgtctgtaagctcaccgaatacataactttttccgtactcgctgtcagggtcaaacagcttagtcagatcaatatcaccaaataaattcatgaaatattcctccttggattcttgatatactataacgatgcaaaccaatcctatataaacagcttctattgttcggttgttgaaaaatcatctgtaacgcatgtttctgcttcatctgcatatacaaccatgatgactttcttagttttcagttaaattcagtaatgcgacctcatatttctccatacatgtaccctcgctgtgtattttatcattactttctaaattatacaacattcacgaagaaatatcaatccccaccgaaaggagtgacaccatgcccaagctaatcgtaactagcagatacgtgaaaaaaaggtgcagtaaaaaaatcgcagaacaatgtgaattacattgcaatcagtgaaggctctgtgcctgtaaaagaaacagtggaaatgaacctcagaaaatgaaaaaaagcctatttcatcggttttcaactttgtgagaaaccaacaaaataggcttgcaaattttgtgaaatagttttatgcgaaaatcagtaacgatccccttgaaaatgccgacacatttccaaaattcttgattaatatcaagtgtcgtggattcaaatccctttttgactgaaaaacatctacgatttcacactaaaaattttcgtccctaaaacgtcaaaaaagcccgtaaaatcggggctgcaataaggaacgtaaaaaaccgattgagaaagaagaagttatcagcaataggtttagttatgttaattaatagttaaaacaatcgactgtctaagaaacggtcggttgttttgctgtttatattaaattgaagaataagattgctctgcaaacatatgagtttacagagcaaatcaaattaagcaatgttgatagtattcagcaattcaccggaattattatcgaacacaaaaatgtagtcaccgcaggattcaaaagtgtacgaaccgccttctttgatctcatcaactgactgctttttaataagactccaatcctcaagcgaatatgtcagatatttacctttataataggttattgctttttgggagttggcataaatgattctttcgtgatttttagttttcttttcttcaaaatgtgatgtttcataattccataaaataattctgtcaccgtcaatttgttcagatacattatctgtaaatccttttgcgtaatgtgaatactgtgctatgataattaaatatttatcagattgtttaatcggctgatatgaataatcaatattaaaagttgtcccggattctacgactttaccattatctatatttattatataatagttgtttaatttccctgattttagcggaaacaatatcaatttattatcatataaagatgctgtcatatcagttttagataaaaaaatctgttttgcattcttcttattatatacattgcaaaaaactgttttttcatttttatcagttattttcaagtaacaatgattgcggttattgataatttgtatattggcagaaaaaaaatttttttcaacagttatattatagtcatatgggcatttatctaaatcaattattttcatatcatcaacactactatatgcttttatgtcataacgcatattaatatcggaataattaagaacatataatatgtcatcgacgaaatacatatcgtaaatactatgtgatatgttatgtattttaataacattaccaaaatagtcgagctgaaatatttttttagaatcaactgagggagaaaagaatataaattcctcgtcggctgttacagtagaagtttttgcaatagagatattacatattttatctatatttccttttgaatttttacaatagattccatcagagtcaagataaacaattaaatcattaacatgacaagcatgagaataattatctttaacatggatactaatatcgccctgatttgtgaataaatgtcttaaaataagtaagccgataattataaatattagcggaaacgcaatcatattttttctatatttttttctcataataatcctcaaatttctgatttcacaaaagcacctattaatgaaataaaacaggctgattggcaaaatgttaatgtaaatcagcctgctaaattatcatattgaaacgctgaaataaaaccttattttttctgtattaaataacccacatcaaaaatacaaccctctttattcgcgatttcatcaatagaattaaaataggtcgtatttccatcattgtgttgtgcttcagtatagttgctgtatctattaaatgtcgttatcatacctgagttatcatcttttattccagcaacagaatgctgtttttgatatgtgacaacttttgcgaatgctcctaactcaattgaactttcgtacttatatgaaaaataagcaacattaccatttgtaaactcgctatccatttcttgagctaaagcattgccaaaatcaaatgcatattctaaatcaccaattttagggttcttgtaagttttatatgttaggttgagagagtctagccaatccgatactttatccgggttactaccataaaaaccatcttttaaataatcggttttattggaaaataatccaccagtaactatatctaaaactaaagcattatattcaaactctgctgcggttttgaaaaagttaacattttcaccagctaatgttgctgcattaaaggctgccattaattcgcatattactccatgcataggcacatctgcaaacattaatccaccatcatctgaaaaatttccgttggattgattaataactagcatcttttcgttataaaaatatatatttttatcatcgccatattttttaagaccaattttggtattattcgtgtaatttttcatggctctattgattttatcattagaagtataagtccagccaacatactgcatataagcatcgccaaacctcgtccaatcagcaatagcacaagtcataaatcttgcattatttattctgtctgttgatactgaaatttgattgtttttatagcttaagtataaaggtttacctatagtatcgttgttttcataatacaaaacttttgagcgtattaccagaccattctcaccaagcaatcctttagcaccgttattataaggtagtacttcccataattgtccctgcaagtttaagtcattgcccataaatacagaataacttccgtcatcattcaagtgcagagttaataccaattcttcattattcaatgcatgaattttataatgtcccccttgtcaagacacaaatgaaaaaaattatcgtgacagcgaaaactttgtatagccatccaaaaaatatccaaatatgaattcaaggcgtgggagagttggcaaggagatagctcatacccttacaacaagctgtaatcaggggtattacgcatttgggatagatatgaatcccgacccgaaggtcacagagcttgcaagatgtataaccgcaaggcaggacagcgggataggtcatcataagggtgaaaagtcgggagtgatactcgttaccgagccaatagctgtgcttacccctgcaaaggcagaagtaagacaggagggacgaagatttaaacttcccaacgagcctatgtttacgataactgtaacggacagacacggcgttgtgtactgcgggtatatcagaaagcttatgcctttggagtgctggagactgcagggctttaccgatgagcagttcaacaaggtcaaggctgtgggaatgtccgacgcacagctttacaagcaggcaggcaacgcagtaaccacaaatgttgtggaggcggttgcaagaataattttagaaacggaaaaaggagaaaacgcatgagcaatgtgataaagatttttgagaatgatgaatttggttctttaagaacgttaacagatgaacacggaaggatcatgttctgcggaaaggacgtagcttctgcattgggctacagcaatacaaaagacgcaataagacggcattgtaggtggggcgtgaaacacgacctacctcatccgcagtctccgactaaaaaaatcaaaatgatttttattcctgaaagtgatgtttacagacttgttgcacatagcaagctgcctggagctgaaaaatttgagtcatggatttttgatgaaatcctgcctcagatcaatcacaccggaggttacgtttcaaatgaggatatgttcatagaaaactacctcccctttctggaagaaccgtatcgtaatcttttccgcctgcagatgacggctatcaaaaagctgaacgagcgtatcaggcacaatcagcctttggtggactttgcaaatcaggtagcaggaacagaaaatctcatcgacatgaacgcaatggcaaaacttgcggctgatgagcattttaaaatcggcaggacaaggctgttccgctggctaaaatacatgggagtgcttatggcgaataacctcccctatcagcagtttatcgaccgtggatatttcgcagttaaggagtcggtgttcgaggtggacggcatgaaaaagacttatcagcagacgcttgtgacgggcaaggggcagagatttgttattaatctgctgaaaaaatattatggaaaagaggttttgcaataatgccagaaaagccaaaatgtccgctcataggtcagaacgggaatatctttaatcttatgggcattgcttcaaaaacgctgaagagaaatggcatgtcgaatgatgccaaggaaatgtgcgaccgtatcacctcttccgccagctatgatgaggcactgagtattatcgatgagtatgtggaaatcacttcggctgacgatgaagaaaccgaagattttggaatggagatgatgtgaatgacgtatttattcataggaatgctgataggcgggattatcgggtttacggtcggaggtcttgccatagcttttaaatcagccgaaaaggagcttgcccgtctggataaggaggtaaaagatgcacacaaacagaataaaagcaaaggttgatttcaagttctgtatgggaagtatcaacgcaatgctgagagccacaaagcccgtactttcggaaaggcagtataaagaattatgtactgaggttaacaaggtcgacggctatcttgagcagaaacgcataatattcagctatgtagacccaataatcaaagggtaaggtaagcaaaattaaataacaactagggtcgttttgccaacagcagataaaaatctggtgcttgcaaagcgacttttctgctgttggttttaacggcagaaaggaagaaaatgaacagttttatgtcatgggtaggagggaaaaaggctctcagggacgccgtgcttgcaagatttccgccttactatgaacgatatatcgaggttttcggaggtgcaggctgggtgttgttccataagccgccgggtatggattttgaggtgtataacgattttaacggaaatctctcaaatctttatcggtgtgtgcgtgataaacccaataagctgaaatacaagttgcggtatgtcctcaattcccgtgaagattttgaccgtatcgctttacttcataagcgtgggatttttgaaaagctatgtgatgcagacagagcgtcaaaattctatcagctcataaggtacagctacgctagcggccttgacagctttgcaagccagccgcattcgatatggtctgactttccgatgatagatctggcggcaagacgattgcagaaagtagtggttgagaacaaagattttgagaaactcattaagcagtacgacagacccgtcagctttttctactgtgatccgccgtactttgctactgaaaattactacaaggacgtgggatttaaaacaaaagaccatattcgactgcgtgatacgcttttggatatcaagggcaagttcttggtttcatacaacgattgccccgaaatacgggagatatgggataagccgaatattcatatcgaggagataagcagaatgaataatcttgctcagcggtacgacggcggctgtcagtatgcggaactgctgatttcaaattatgatacaagcgaaagagtaaaggcggcttgtcagctttcgctgtttgacgatgaaacaattttggaggtttaattttatgaaaaatatgatatacacaaaaggatttatcaacaattcaggggacatagaagtgcccggtgtatttttggaagaaggtgcggaagtcgagctgaaaatatcggtagcgaggggtaaatttgaaatagcacttttcccctcagaggacaaagtaccgttccgtgactgtggaatctcggaggaagagatacagcgtacctgttccatgtacgaagactgcgacgggtgtccgcttaatgactactgcggagaggaatcggaggtggtttcatgaaaatacttgtgtttgaaccgatgaaaaagccgtatgtgaaggatattaaagataatattcacgctatgcaggaaattgtgggcggcagcatagaacccatatattttgaaccaaagcaggacgcaatcgtctggtgtaatgacgaatttctgctgaacggttcagagcctaacaggattgtgggtgcaacacttgtccacggcactttttacatctcaggcaactatcaaaatgaatacggcgagtgggatagctgttcacttaccgatgaacagatcgaaaagtacaaggagcagttttctcatatgatagttgatctgccgggcattggtcttgtggctgtgaatgagtgtcaccctgaaattgtccagtcggaagaagtagccgaagatttagaagattcggaagaacccgaaattacaatgtaataaatgaaaggaaaaggtgatgcaaatgaaaatttcagcaacgatcaacagactggtggacaagcccgacagcaatatcaaggcttttgcaagcgtaagttttgacggattttacgccgttcacggtatcaaggtgtgcgagggagaaaaagggcggtttgtttccatgccgtcaactcagtacaccgaccgtgacgggaacaagcagtatcaggatattttccatcccataagcaaaggagcaagaaatgcactcaaccaggcggttctgaacgcctatgatatcaagcttcaacaggttcagcagaccgagatcgaggtggagaattctcccgatgaggagatgtccgatgatatttccgatgaacctgaaccggaaatatcaatgtagtacaaaggcaggctgtgcaaattgtcacaaaggtagaacttttgcaaaaatgctggatttatacaaaaaggtgtgatatattgcttgacaaggagcgtgatgatatgaaaagagcgatatatatttcaatactttgcacagtaatgctgactgcctgcgggaatgtatcggagtcaacgaaaagagcagaaacctcagatgtgagccaaactacaactacgttgacaacctctgcagcaacggcaaaggaagaaaaggatacaagcgaaaccgctactacgataaagagttcgcagagggtatccgagaattcaaagccgacaggtaccacagtaactacgaccaagaaatctggttcttcaaatgcgaacggaaattctaatcagggtcagaataataacggtcaggaaaataactatcagcctgtgcagaatgatccgcagcccgataactcgccgtccgataataaccggagcaataacggagcggaacagaataacgatccgacgcctccgactacaactgcaaagcctgcggtaacaaatccgcccactactacaactccaaagccgcagattacagtaccgcagactgaaccgcctgaagttgtaattgaagatacaacaaacttgcaaagtgttctgaattatgtaaattcgcttggaagatcaatcgatgaatattacaacattggtgcagggttgagtcacgatggttctgattatggaaaagccgaagcggtgtataattggattcgggataatgtcagcggaaattgtcaagtgttctcagtggcaacaatgtatgcctgcaagggaatcgggcttgaatgtcggtatgcgtttttctcccccgatgactggtatggacacatggcaaatctggtaaacgtgggcggagcatggtatgtgttcgacacacagggcggcagatttttaaagtcggataaatacggtgatattacccggatatttgatgaaaatgacaacacgattgaactgtcggtaagcgaatctgcttactaattaagtaaacaacaaagttgcaataaaggcgctgtaaaaaaacgcgcaataaaaaaagactgcaaccacccttaaaagggtaggaaagcagtcttttttgtggtataataaatttgatgaaaaaatactttgtttgacgatgtttaattgttgagggttcggatcctttttttacgaaaaagcatctacggttttacacctgaaatttttaccctcaaaacgcaaaaaaagctcgtaaatacgagcttttcgagaggtgcatctattttattgcacaagtatgaactgtctgtacgaaattgactgcgtgagaaaaatagattaagaaagccgcatcatgggattgttatctgatgcggcatttcattgtaattctgataaatttaaatgccgattccgtaagtaattgtcatacattaactgcggatcaagcatgcgtacttcaacgacaccaagaccgagttgttttaatatgtctatttttacaaatcccgggattttatcttcgcctttgcgtttgggcatcaagaagtaatttcttacttcgctaaccttatatctttccaatacatctcggtaggcaagataatataaatattgttttgaaacatcttcaacgctcggttgccctgaaattgaatcatctgtccaatttggacaatagtacttagcatcaaggatataaaaaacatagtaatcgggatttgctttgcgttcaaagcgcagataatctggtttaaatgtgtcttttggaattccgctagcacctttacgatatcttttccatataggttgttttattagttcaactagggtaggggtcttacccttgaaatttttgtttatcattgagtgatcaatgtaaggttcgatcttgtttagagaatcatttttttggcttgtaaatactttcgcacaaacttcttcccatatagtttcaaaagatcgcgtaccaataagttgtagttcattttctccaagcaagacttttccgctgttgaaatataatttcaatgctgtaagcaccgaaagttttctatcatcgaatgtttgcgatattgtgctttcaagcacatttaaaatctgttcttcatctccaaatgcactctcatcttcatcagaaacataaacggatggaaggctaaagaaatttgttagcgaagttttttctatttcttgagaacattttgtaataacgaactcatgtagacgttttaaataatcgaaatcattattaacatttctgcgagtgtatagttctacataatatggtctgttgttagatagtatgggataagtctcatcaattgttttttgccaaaggatttcgtcgcttccgttaatttcaattattgtctcatccgtttcgtatgcaccatttgatgcataatcttccaaaagaaagagcatgactgaaagaagtttgtctcgattatgatttccttcatcagcaaaaaggtctatgttatagatatcctgttttgatttctctctactgtacttttcaattactctaagaacctgtgccaattctctttgcggattatatgaagggagcttttggttttcaccaatatattttgggtacacataaataagcctattatgacagataactataccaacaaatgtaaatttatataccgcatttaaataggttttgtcattataattattgaaatcaacatcttcgtcttcatcgacatcattatccaatttgctcttgagttttatgatttttcgtgcaagtaaatccttaacgaatctaacaaaactatcttcatcactttcaaatgaaaacatattcttgcttcttagatcggtagcaggatatagccagtcctctctaacgtaagcggatataatactcataagactatacctctacagattaacattctttttccatttttgcggcatcacgctctgctatctgatttgcatattctcttgatctgaaatctgaaccaaatatagcaagacctcttgatttaaactctgcacaaatgtaagaaaaacgatttaatttatcgctatcgcacccttcaaaaagttccttatgttttgtctttgctgcatcctcaaataaatacataataactttttcacagaatagtgtactgaattcttcatcctcatgacctagtgtgaataaacacgttccggtagaatcttgtgttttcataaaaaatggtcccatcagcttatcttcatgagcttttattctgtcatttgacaacttagcatttatcgcacgacgtaaaacattccactcaacggctccgtcggcaagattaaacgttccactttgacattctgtagcagtttttacaccagttgagggatcaatatttaccttgaattcttcatcatcaatgccaatataattaaagttccacctacgcttaaatgctgtatccattgggaatacaccctgatccgcactattcatagttgcgaaaatatacatattatttggaatcgccaatttggaataagcggaagctgcaccgccaaagtgttcagctaaatatgcccgtatatcctcacttgcgtttattgagtattcacttcttccggtatcgtccctgtcgagcaattgaaacatatcgccaaaaacagccgcagccttagctcggtttaattcttcaataataagataatgtttgtgaggggctgtggttgaagcatcttccaatgccgcgacaagcgttcgcataaatggaccaggaacgaatttataagttatcataccaccaacgtctactggcttatatgttcctataaactgcgaatacgaataatctgaataaaaggttactcgttcataatcatcagatgaaacatgatgttcatctaagtatttcttaaaaaagtagcttttgccagttcctggagccccgaaagcaatcacattgcgcttgtccctttcgtcaagaggggtataattaaatgtcactaatgacgggataaaatacggtcgcatatcaaaaatatttagataatctgttacttctgcaggaattatagcagtaccaccatttgatattctgagaaaagatgcctgatatatgccacaagcatgatcaccattattacaacgaatacaattaatgggcgcagaggatgctgcaactttcccatctagccactcatacatgcttcttatgtccatgcgtccagatatagatgagacattggtttcaagcgaaacaatgtactcagagggggttatatgtcccaaataagaaacatacgctgctgccttactatatatggtaaggaaaaagaatcgttttttctcgcttcgagcaatgtgatatccatttgtagcgttatcagtaaatatcctaatctgaggtcgagctcgctccgttccagtgattgagatatcagcatatgaaataattattgtttctgttgagggtagtgtaacctcatctatgtccccagctcgatttactctgggatagtgaagttgattatcaatataattgcgaataatttctgtagaattcataatgttctccttttagtagtttgtaacaacaatatgggaggcatctcctgtaaatctatttctaatatttaccgaatatctaattggatattcagccaccacattttgcccatagagttctgtagtaagaggtgttctactaattaccattagtgctcgacaattcaaattatagaacgctcctgctaaccgtcgttgttcagcttcattgaaatcatctgttaaatttccatattcatgaaacgtacaatcatatggtgggtctaagaaaataaaatcattcgtttgtgccaagttgaatacattctcaaaatcatcgtttagaatgtgcgttctttggagcagatctctgtgaccttcggtaataatgtttacattaaaatgcttgtatcgcccatatggtacattatattgcccttgagcattaaaacgtaacattcccgaataagctgtcttattaatgaaataatataatgttgcaggcaaatattccgaagggataatgctgttatacatatctcttaatctgtaatagagtggttcgttcccattttctattctaatttctggattgcgcattttttttgtactgtatacatcttcattatgctcatagatttcatgcagagtttgtaattcatccataactcgatcatactgagttgccagctgcctatagaaatttataagaggttcatttatatcattgataatggcattgttgggttcctgttgaaaaaagacagcgcctccaccaagaaaaggctcaatgtaagtatcgtaatcagcgggaataaaatttatgaattgggggatttcccttcgtttccctccacggtatttgataatagcatccattgatattgctcctaattactattcttttaattcattatcatgaaccgactggtttggctctggtaaaaactctacgatatcatctatcttacagtttagcacctgacatattttttcaatcgaatcgagggacacatactcatcacggtgcatacgtgttgaaatattagtgccatacatacattatatcatatctttcatacatacattatatcatatctttgtcgaaaaagcaacctcaatccccgattttacgctatttcaaacttcgactccactggaatcaaagtacctctcaaaaaagaaaagagccaagcagcaaattcctcagctccataatcttattctatccccgtaaacatcacctgataattcagccctaatcctgtataataaaacttgacacatacaagacaatcaaagtataataaaaaacaaaggagtgtgtcatcaatgggaacaggaaaacaatatgatgaagagtttaaaaagcgggcaataaagctcgcaagcttcaggcagcaaacaagcggatcaaagagctcgaaaagaaaaaccgtgagcttgaagagcttaatgaatttctggaggaagcatctgcttttttcgctgcgaaccgtcggaagtcaggaaagaagaacggttaaagttcatttccaaaaagactgatgacggtaggatcacaggaaggatcagtttttactgcaaggctttagaggttacaagacaagcattttacgatcatctcagccataacttgcgtttagctccgacgctgttattttctatgggtgtcgtccccagtctttgcttaggataagtttaacagacgttcagccttttgtcaagactatatgcgccttttcgacattacatacaattgcgatcttgcgggcttagcacatatgcacaagtggcatgagtacataaaatgcccgtcacggcgagcatcaaacccctcccagcgtatcatacctatgggcgggggcgaaaaaatccgctaccataaatgatagcggattgggtgcagtggcacgccccctacattgtaaagtttacaaacaaacttattgagcgggactaaagtttgataacaaaaaaagccatgacggacaatgcccgtcacggcgagtgactggtcgaggtgacgggacttgaacccacggcctctgcgtcccgaacgcagcgctctaccaaactgagccacacctcgaaataccactgtaatattgtatcacacccatcaaaccttgtcaaggcgtttttttctgttttgtatcctctttgctttttttactgcgttgacctttggtgtatgacgaatttattgaaatcattctcattgtaacttattttcattgacatatgccttgcgttgtgatattatatatataaaggtgttctcgtttaaaagtttttgtatgagatgatgaaattgatgaatatgaagaaaagaatgttgagcattgtcctgtctggcgcaatggctgtttctactgctgtgtctgctggatcgttcagtgcctttgccgtggcgcaatgtgttgcgtattcaggctctaatgtgaatgctcaggactatgtgcaatggtctgacacagtgaaatcttacctgacagtgtgcgacaacggcaattatatgcgtgtccagtcaggcgctatcgagggcaagctccttgtggaatattacagccctgattttgaaccgctcagcactaagcttatcgacaatgaactgccgatctttggtgctttctatgactccggcaataattattatgtccttagcggtcaggaaaatccgaaacaaaacgactccctcgaggttttccgtatcacgaagtatgataagaattggaacaaaataaagtcctgcggtctgtatggagctaacactacagttccattcgatgcaggctcggcaagaatgacccatagcggtgaccacctgcttgtgaggacctgccacgaaatgtataaatcaagcgacggcaataatcatcagtctaatgttaccattgaagtggatatgccttcaatgactatcactgattcatataccggcgtcatgaacgttgattatggctatgttagccactccttcaatcagtttataaaaaccgacggcaaccatatagtcgccctcgaccatggtgacgctcatccacgttctgccgttctggtgaagtataattctgattttactacaggcaaattcttcccaagctattttgataaggtcagcaatatcgacgttgtaacataccctgaatataccgccggtcactataactatacaggtgcggctataggcggctttgatgtgtcatcatcaagctatatcgtggcacagagtacagttgaccttgattatatcaatacgtcagaaacacgaaacgtctacgtttccgctgtttcaaaggacctttccacaaacaagctcaataagataacttcttatgcagagggtacagcttcagcttctgctccacagcttgtgaagataaataataacagctttttgctattgtgggccagagatacaaaggtaagctgtgtgaagctaaacgctgacggcacagtaaacggcagtatacacacctttgagggaagtctttcagattgccagcctgttatcaaaaacggcagagcagtttggtatgtttacgataaaaataacgtgaccttcaactccctgaacctttcaaatcttgacgatataaagacggttgacgtcaaaacaggtcatgactacgaaacaaagtacgcatcaaaaactgacggcactgtaacacagacctgcaagtcttgcggttatgtgaataagttcacagttccgacctctaccactgtttattggcgtacagacatttcgaatacgtccttttcaagcgtattgagcaaaactcagttcagtgtgggcgacagcattgatttctggctttatgacgatacagactacacagttgaattttctgatcgcagcatggtaagtgtaaataagcttgaaaactatgctaatgatatcagacgtatcacattcaaaaacggcggttcactcattgtaaaaatttatcctacatacaatccgtctgtagcaaagacatacaaactcacctgcggatgcacgagccacacatatggcagtgctgttatcacaaaacagccgacctgcacatcagagggcacaaaaacaaagacttgcacaaagtgcaatgcgacagttacagaaacaattgcaaagctttcccacagctacacaaccacagttgttgcacctacttgcactgctgacggctatacactccacaagtgttctgtttgcggtacttcatacaaggatagcacaactaaggcaacaggtcacagctacggaaattctgttgtaacaaaacagccgacctgcacatcagagggtacaaaaacaaagacttgcacaaagtgcaatgcgacagttacagaaactataccaaagacttcccacaaatatgctgacacagttgttgcacctacttgcactgctaacggctacactctccacaagtgttctgtttgcggtacttcatacaaggatagcacaacaaaagcaacaggtcacagctacggaaattctgttgtaacaaaacaaccgacctgcacatcagagggtacaaaaacaaagacttgcacaaagtgcaatgcgacagttacagaaactatagcaaagacttcacacaaatatgccaacacagttgtttcacctacttgcactgctgacggctacactctccacaagtgttctgtttgcggtacttcatacaaggatagcacaactaaggcaacaggtcacagctacggaaattctgttgtaacaaaacagccgacctgcacatcagagggtactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcacaactaaggcaacaggtcacagctacggaaattctgttgtaacaaaacagccgacctgcacatcagagggtactgctataaagacttgcacaaagtgtaatgcgacagttacagaaaagcttcctgcaaagggtcacactgcagttaccgacaagggctaccctgctacttgcaccaccgcaggcaaaacagacggctcacattgctcagtttgcaatactgttatcaaggttcagacagtgataaatgccacaggtcacaaatcaagcggttggatagtcgacaaaacggcttctatcggagttaaaggctcaaagcacaaggaatgtacagtctgcaagaaagttcttgaaacggctgaaattcctgcactttcaagaattagcatttcaaaggcaagcgtgacactttctacttcgacctacgcttatgatggcaaggcaaagaagcctggtgtaacggtcaagctaaacggcaaaactttgaagaatggtacagattacacagtttcctattcaaacaacaccaaggtaggcacagcaaaggtcactatcacaggcaagggcaattacacaggctcagtttctaagacctacagtatcaaaaataacttcaagaaagctaccatttctggcatttcaaacaagtcatacacgggcaagaatatcacgcagagcattactgttaaatacaatggtaaaacgctgaaaaatggtactgactacacagtttcctactcaagcaacaagaatataggtactgccactgtaaaagtcacaggaaaaggctcttacgcaggcactatcacaaagacgttcaagataaatcctgccaagcaggagatacagaagctcactgctaagagcaaggcattctttgtggattgggcgcagaaaggttctgctactggatacgagatacagtatgccaccaactcaaagttcacaagtgcaaagaaagttaccataaaaaacaacaagaccgacaagaccactgtttcaaagctttcgggcaaaaagaaatattacgttcgtgttcgttcgtacacaactgtaaagggtactaagtattatggtgcttggtcggcttcaaagagtgttactactaagaaataattttatatgagaacagcgtatcgcagggggctgcggtacgctgttttatttttactttgatattgcagttcgaggcctcaaaaattattcttttcctagtctttcagaaacttcaagcaccaatcgttggtctttttccgaaagtttcgaccctgcacccaatttccgtcttactttgggtaggacggattttttttgttcccggtgagatagaattgcgttatgataaattttgaaatcactcgccgtgacgggcattttatgtactcatgtcccttgtgcatatgtgctaagcccgcaagatcgcaattgtatgtaatgtcgaaaaggtgaatatagtcttgacaaaagaccggacgtctgttaaacttatcctaagcaaagactggggacgacacccatagaaaataacagcgtcggagctaaacgcaagagtccatcataggcttgatggaatcatcgtgatgccagtaatcgtgtaccaaaacaaatacttttttactcataagtcatacgtcctttcatcaccattttatggctacgtttctgtgaattctcgttttttagatgtgcgttaaattccgatttgtcgctcaattttaaaaagtaaactaataaaagtatatcacaaacctcactgtctgtcaaaccaatatttatttacgctttccccttaatcaaaccgacagccttagcccccatagaaacagtatgactaacactcatcatattgaccctgacgctcgtatccaatccatacatctgcgcaatcctcggaacttccgttgccgacaagcaaattcccaccgcaagcagagcgtgctgagtgtaggtcagcagtccgagatagagtatcgttgtctgcaaaaacgccgtcagacaggtggcaataacttgtttgcaccagctgtaaaaaccgtccgtgtaacctctcggaatgccaaaaagatacagacttcccacagcaatctgacacagcatgatgccgccacgcttgatgtttgaaaacacaactttcactgtacaatagccgaaaagtatgataaaaaacaggctgaacagacttacgtccatcgccagtgccataatcacggtcagccccgaatcagctactgtcgttgttgttcccgatatgaaatttccaagcaaatcgcttgaaaatgtaccctgcaaattaacgcaaaacgagtaaagtctttgcggaacaacagtaaccaaacttgccgccataaagcctttcagcacattcagacaagtgtttttgatgttcgcctgaccagattcataggctatcgccgtgtcaaataccgctacgataagtccgcagacaaacagcatccatgcgagactgtggaacaatgctatgaacgactgcacccacgacagagcgaaaatactgcttgtgcttgcattgataaattcaaaaagatcggctactgcgccgtaaatgaggttgaaaagccactcaaacataatattccatatctcgtcggtaattgcgtctaccgcagaacctaccgtgttatcccaaaggcttgatattccgtcgcctatccagtcaatggcgtcgccgatccaatcaaacatccgcaccacctcctgcctttgttatctcgccctttactctgtacagcgagctgcggcgtcctccttggatatgatagcgaggtatccgttctaacaatccacggttttcaagttccgtaaatgcacgatacaccgtgcttttgtgtatactcaaatcttctgctatcctgcgcacagagggaaaacattctccgtttttatccgcacggtttgcaagataacagtacacagccacagccttgtggctcagacctaaatcgtaaattcttctcggtaatatcaatttgcatcagcctcctcacgttttaattttcgcttttctcatcggaaattcatcaaattcttcatcatcgacagacacttcaatttccgcagcaacagcttttttctgcggatatttaacctccacatctctgattaattcatcacgatttttgtaacaaacctgccttgctgttttatcagggagacagtattcttcctcaaatttaatcccccatttaaagaacaatttcagctttgaaatcatcgggtgtgttcctgttttcattacgataaattgaccttttggcatagatttgagttcgtccacagtcataagcggtctgcctatcatctgaagtgactgtgatttttcctttccgcacgacacagaacctgacaatacagtttgctctcccaacgcttttgacagtacttccgctgattgagaatttggcgcaaaacctccgaacacggtaagctgagtgttgtcggtgattatctccatgccctgttttccgtagttctgttcaagctgtgcaaaggactgaattatcgcaacgattgatatttttcttgaacgtcctgccgagaacattgcttcagcaccctctatcttaggaaaagttccgaactcgtcgcagtaaaacataactctgtttttaagctttccgccgttttcatctgcaatgactaatatctcacggtatagctgttggataagcagactgaccataaagtacttgcttgtatcttcttcgggaagaacaataaagatagcagacttttcattgcagaacttctcggcgtctatcgccgttccaaagcacagcatttgttcaagttcagaatcaagaaaactgtttaatcgtgataatgccgtactcattacagacagcattgactgatcggaagcgttgagcgccgctcctgcaagccatttggctttgtgttcgcttggaagcttgtccataagctttgtaaaatacatcttaggctttgctttcggcgcaggctgatactttgccaaaaggtcttggatcagcttaaaaactgaaacaatatgcctttcgtttttgtcgccaaactccgccaaaagcaggataaccgaggcaagcaagccctctgctgcatcgtaaaagaacgcattctgaccgtagcttgcactgtcaccgccgccgatattgataattgtctttgctgttatctttgcatacttttccgcttttgcctttgctgaaagatttgatttgtctgcaaggtacatattcatgtatttattcacaaggtgcaaaatgttgttctcatcactccttgtcggatttcttaaatcaagcacagaaacattgtagccgtaatactttttggcgatagttccgtaatttctcgccacatctccctttgtgtctgtactgacaaacgacattcccgaagcacaggcaagctctatattcggatacaaaaagtaagcggtcttgccgactcctgcggcgccgatcataagagtatgcacatcaccgtcatccacaagagcaacagcctttttgcccgaacctctgcacccaatcaccgtaccttgaatagcaggaagattttcacctttacgccatttctcaggctcaaatggcagagggataaaagtctgctttatctccgatttagtcgcccacctcgcagttccatgctgaccgtcaccgatctttttagcctttattccgttaagtgacttattgtcaagtaaatttaccaatactgcaaaaacaacaaaaatcacaaccaaaattccaattaaaatcatttgtttttcactcaaaatttcacttccaatcaccataaaatactctttcttctgtatttaaataacatagttagtttgttatcttcaaggtattgcgctgtgaggcggagggtatcgcattacccgaactccatacacggttcgggttcagaaataatatctatatcctcgcactgctcctgaatcggtacacttaaagcttcctcaaccgacaatctgacagcattatccgcaagctgatacagcattttcgcagtcagtaccgactgttcacgagtacaggcagtccgcttaagatcacgcaaaacctcctgcatacattcctgcaaagccctttgtttctgtgcctttttgcccttgtcggtgtaaggcttgtactcatctttcagcttgaattttaacttttcaaacatcagattttcgtcctttggtgcaataaaaaaagcagagcttgcaagtgcatactcagccaaatatttgtattgtctgtttttaaacgttgcatagatctgcgaggtcagcttatcaggacggcatttcagatacacaagttcgctaacttctttcagatattcttcctttcgcttatgaggaacagcaggcaaaaatttcgctccgttttttgcctttaaatcttcattccaatctttaaatttgggagcaaatcgccgtacattttcatagccgttttctctcaaaatatcccgaagtctgtcaacagcctcgattccgccctcatcgttatcaacgcagagaatgacttctgacaggttagaatggttctttaacgctgttaaaacggcattttcatacacaccgttcattgcaatgtagctgtttttctgccattcctgcggatagagtgtaagaaaactcatcatatcaatgggagcctcaaacacgaacagcttttccgacttgccaaagtgggaaaagctgtaacgggtatctgaaccctcgcaggtaatgcggaaagttttcccgaaagaattggttgaacgcttgcttgcctgtcttggaactccgttttcatcaagccctacaaacactgcattgtgatgttccttgtcctcataaagcgtgtgctgttttgcaaaatggctgataatatcgggagaaatgaacctctgctttatcaggtaggcataaaccctatgcatatttgtgtttgcctcgggaagtctgaactctttcttttcttcctttgcgatagctttcggcggactgtgggacagcggagtcactgtctgaccaagcagttcctgcaccgcagtctgaaagtccataccataaaactcctgcataaactttattgctccgccgcctgtctgatttttatggtccgttcctgcacacaatacccaaaatctgacctgtgaaccatttgtcaaacttgtaaagaatgctattgattgggttttatagcattaatagagcgtcaaattacagtttgtcgaacagttacaacaaaatattattgagcacagtcaagcaaaagcttggctgtttttttatgtgaaaaaatggagtgtgaaaaaattgaaaacctacatctaccccgaaaacctgagagccaacgtaaagctgtggttctggaatgttcgtgattttatcataatctgcggcggaataattctgtcggtaattgtgcttgtgaatctgtggaacgtcctgccttttgcggcgaccgcctgctttgcgtttctctcgcttcgagttgacgaaacggcgattatggactatatttttaatgctgcgaagttctttctgacatcgcagcaattgtatttttggagggaaaattaaatgacaaagaacaaaaacagcgttcagggtcttatcggctttgaacgtttttcacgtttcggagtgaaaaccgacaaggccgaaatagcatttttcagcgtagaacccaccaatatttcagtgctttcagcggctaatattgacgtgaagatacatcatctgatgatgctgttaagcacgataccggactttgaaattcttgctttggactcttgcgagtgttttgatacaaacaagatgtacgtcaaaaagcgtttgcagaccgagcagaacgaggcggtcagaaaactgctgcaggcggactatgattttcttgacgagattcaggtagagatgtcctcggcaagacagtttatgtttgcggtacggttcaggcgtgaaaaggacgagcagatattcagcacgcttaatcgtgttgacaaagcaatctcagaacacggctttacggctcgtagaatgagtaagtctgacataaagcgtatgcttgcactttacttcggaacgagcatatcgggcgagggaatccctgatattgagggagaagcggaatttaatttggaggaattgcatgagaattaatttacgaaagaaaaaaaatctgacggacgaacagcttgaaattatcagcacaaaggatttctttgaccgcactgttccgggcgtgatacgtttctacactgaccactatatctgcggaaacttctacaagtcctgctgggcggttacggaatatccgacttcaacggaagaaacggctatccttgctcaccttgccgacagaaacggcgtaacgctcagaatctacaaccgccttgtgacgagtatggagcagcggaagatcgttcagcaagcgatgcgtaaaaaccacatgatgactaccacaaacgatgtgaacgagagcataaaggctcaggataatatcaacgatgttgtagaacttttgagtgaacttcgccgcaataaagaaccgctcctgcatacggctgtatttattgaactgaaagcaacaagtgaggaaaagctgaaagaattacaggcggatatacaaatggagcttacccgttcaaaaatcagcgtagaccgtctgctcctccgtcagaaagagggctttttatcggttttgccgactggcaataatgtgttcgcaactcagtttgaacgtgttcttcctgcaagttctgtagcaaatctataccccttgaattacagcggaaaaaccgacgaaaacggcttctatatcggcagagataagtacggcagcaacgtgcttgtggactttgataagcgtaccgaggataagacaaacagcaatattcttatcctcggcaacagcggtcagggtaagtcgtatctgatgaaactgcttttatgcaatcagcgtgaggcagggaaaagtgttttggtcttggatccggagcatgagtatgaggatctctgttcaaacttgggcggcacatatattgatatgatgtcgggtgagtttatgataaatccgcttgagccaaaagcgtggtcagaaaattctcgctttgaaaatcaagaaaaggaaaccgatgacagccctgaaccattccgaaaagtaacccggctaagtcagcatatcagctatctaaaagactttttcagagcatacaaagactttacagacgcagagatcgacacaatagagataatgcttatgaaactatatgcacgtttcggtattgacgatcttacagatctcgataagttggaaagctgtgactatcctgtaatgtcagacctgtatgagttggttgaaaaagaatttatggcatttgataatgctaagaagcacctctacaccgaagaaatactgcagaatatctgtttgggattgcactcaatgtgcaagggagcggaatcgaaatatttcaacggcagaacaaacatcaaagacagcgagtttatctgtttcggagtaaaaggtcttatggacactaacaaaaggctcaaggatacgctgcttttcaacattctcagctatatgagcaatcaactgctcggcagaggaaatacagttgccgcagtagacgagctgtatttgtttctcacaaatatgacggcgattgagtatattcgcaacggcatgaagcgtgtgcgtaagaaagagtcctcgtttattctggcaagtcagaatattgaggactttcttttgcctgaaatcaaggagttcaccaagccgctgttttctattcctgcacatcattttctgttcaatccaggaaatatctcgccaacggcattcattgacaccttacagttggaagagtcagagtacagtcttatcaagtatccagaacgaggtacttgcctgtatcggtgtggtaatgagaggtatctgctgcaggtcattgctcctgcttacaaggcgggtttgtttggttcggctgggggaagatagatttttatatgggataaatttcttgacttcataactgaaatttgatatactatctttaacgaactgatcgataaaacgaaagatatttgaatggagttatagtgctatggaaataaaaaaagccgaaatcaaagatttggatattgttattaaattaaaaatggatatgtttaaagaagtaggttcaatagttttgttacaggacaatgctgaaaaacatatatatgaaaaatataaggaactgtatcagcaagagaaatgttgtcattatttagtgtatgaaaacgatagtgttatagcgtgcggtggtgcagtgatcaaggaagatgttccgttttgtttcttcaaaactccaatgtatggatatataattgatgtatattgtattcctgataaaaggagaaacggttattcttcaaaaataatagaagagctgattaaatggttgaagagcaaaggcgttcataatataaaactaaaaccatcagcagcaggaaaacacttgtacgaaaaatttggcttttgcgattctggagaaatggagttgtggatttaataattgaattgttatttgatctatcaatagactaaaactatatgtttaatatacgagtcgcagtaaattgcggctctttttggtgcagaaacgtaggcagataaaaatgcaaaagtaaaaatacggcatatggaaaacacgttatgctgagaacaacagaaatatatttgaggattgggttcgtcatagtggcgagcccattttgtttgcaacggagcgtggtgcacttgaatatatgcacggcatagaaatgaaaacacagggtgcatttactgaatttgaagttagtgaggtgatctgatgtcgtcagcagttgcggtggctgtgaaaaagatagccgtatatattctcggagatgaaaacaagcgtggcaagctgtttgtggcagtcggcagtatcatcgccggctttctggggcttatgttcctgcctattgctgtgatctcaagtattggaagtatgaatatcgaaccgcctgacatagacaaaagtctgtttacggagtcggctttgtttgagagtctggacagcgaacagcaggcggagataacaaatattcaaaatcaagggcaagcaatagaggacgctatgacaaatgcaggggtgagagatcagacgatcaaagctcagctgatatatatgtcatactttgatgaagtgcagaattttaatgctgagtcatatgcacatctgtttgtcgttgctccaaatgacagtgatttaattgcggcgataaactcaacttacggtttggatattgactatgatgagttcgtccgcacatacacttttgtaatgaacagcaccataaatgcgtttatgtttactgatacaggcacgaaaaattgtgctgatcttgcggcttgggctgataatgcttacatctcaggctggggatatatgaacggttttattggagaaagaaatgaaactgacagaatacgttatgcggataatgcagggcttgtgctgggatatctgaactacagtccgaccgataaaaagtttgattccgattacgatactcttgtttacacagagcagggtggtattaatgataatgctgatttgaaatcactgaaatcaaaagtgctttccatagatgaaagcatatacgacgttgatgatggtatcagctcgataaaatcatcaacgcagacccaagaggacaaaattaaattacttgagtcattgaaagaaaatattagtgaatacatttccgatgttgtgactattgactaaaatgcgactgatgctatcaataaaagcaagaatgatttttatgataaatatgaatacctgaaaccggatattgaaaaaagcaggttggaagaaaaagtagataacgcttgtgagtggtgcaaggagcattggaaagagattctcatcacagtaacaattgtaataggagcagtattagctatagcaatggtaacaagtgtttcaaaactagctaattttggaactagcaatcaattattaattaacattccaagaacttttgaatttatatcaggtttatcaggtctattttcattaaatggaagcatcatcaattggttaaaggagaagtgataattgaaaatgcatatggaatttgtaacagtaggcaaagcaagtagcgataaaattcatgtaaaatataatgataaaatagcaacatttcatggagaaataggaattgattattttttggtgcttgctaataaaatagagtggtatccaaataaaaaagcaacaattaatgaaaaaatagaattgatgactatagcaaacaaaacctttttgggtgagaaacggttgtattttatagcagatgatgcaatatggtttgattggaaaggttctccattaattgttatagaaaataatattataaaatcaataaaaatatcatgtgtttgtgaagtactagctgaagttgatgagtttaacgatatttccgatttttgttatctaaaaaaatatattgctgaattaaaaaaagcaaagaaactttgtaaaaaacactccattaataagtatgatggttatggacataaaaaattttattataagtgtacaaaatgtagaagtgtttgggctttaacagaacctgacggcaattttaacggaagattggaaaaactataggtttatagctttagacacgataaaatatatgatcaattatatttccaatcaaaagtgtggaattgaaaaaataagcagtaaaatagcggaatatattttacgttttgatagtgctgataagagtaagtacgttttttacgataagtatgaatacttaaaaaccggatattgaggatggagaatggcgagatcatgtatgaggctttcagagatgcgactgacggaactgcagggtggtcattctcagatgagacttacatagcaacattatactggaaggagaaataataaatgaaaaaagtcatcagctttatttcgagcttagcattggtgatatctctgagtagttgtgccattaaagaaacgcctatcataaacggtgttgagtataaatacaacgatcagttctacgcagatacggtagatcaattattgacatacatagacgatggggataaagacggcgtaaaatccttactgtgtaacggtctgaaaaattcagatggtattgacgctgatatacaagcgctgattgatggatttgaaggcgatataattcgcacgacagagtatgaaaaggatactgtgaacgccagttcttcagggaaaaattataccagtgcttttctttccagatcattttatattatcacggataagcaaaaatatggggtatatatagcagtttgtcccatcgatgaaaagcatgatgatggggaagatctggtcggcgtttataacatatccataaatactttggattatgagtccggtgatatcgagtgtaatactgccaatactattgaaattgcagaccataattgctgcgttgcttccggttatggcgacagcagcagttatttagtggctcagacgggcaataagtacgaagttatagatatttacaggataatcaatccacaaagtattgtaaaatatgatgatataaccgcatggaacagcagagattttctgagctttaaggaaaaattcggtgctccgtatgccgaatctcttgacaatgacaaggaacatgttttagccgatgtatatatgtatgaaatttcagatagcaataaatatgcgatcgtggctgttggcagagatgacggctcgatcaatgcgctgtctgttaaggatatagacagccgttggagcgaagataatgaatatgaatatattttagagaatgaatagattaatggcaaggaattaaataacaaattagtagcgaaataatcggaacaaaattcaagtacacggtattaacattgacaccgttttcttcacaccatttatgcactgtaagtccgctgcttttctgtgcctggatctgggctgaccattcggtcaggcgaaattcgttctttaccgttgcgatcgttgttttcattatctttatctccacatctaattttgtctaagcagctctatagactttttgagttcggataatttactctatgtagttgcttgaagtttattatacttctttagtcatcggtggggtagatgcggagggtttgacggttacattcaaattcacggcgtcaatgatagatgatattttagaagatgtccccgtgattgatacaaatagatatacttgatgtaaaaatagaaaatgtttattcgtcgcttgatgagaaaggaaatgtcatgaaattgcaaaaacagattacaaacgaagaattgcttgaacttacaagaaaagcatttgagaatgatgaggttgctgaatttctttgcggagaaaaaggatattcagttatgggaaacagggatatacctattaatattcctacagatttcggacgcattgtagaaaaaggaatatatgagttatatttgactacaaatgatgaagtaattatcaagaaattccgtaaagcaattatgacactaaatagtacacctattcaagtttggtgtgcatatatggcttgttggaatcaaattttcaatgaacattctaaatatccagcaccgtttaaaatgattgatgatacccttttaaagacattaaaaagtaccttgataaacaatgaatcatctctacgtaattgtaaagagtggatggggattaacaaaaaaaatggattatgggattacataattcgtatagataatgtcttaaaaaaagattatggggtgagtatattatgaatatagacgaaatatttagtaaaggtgcatcttatttaatatctgaaaaaggttatgaagactatatttcaggcaaagatgttacattgtgacgtcctgttggagatgatactgttgttttggttgcaccaagtgccgaaattgatgaagctataattaaaaccaaatccggatgttaaccctaatataggaaaaattggcaacacgaattcgataaatgggatcccaaccaaacaattaaataatctatataattcattaggaagagattctgagtgcttacgtttcattcattgtatttactatacaagcgcagcaagagtttacataagggttctctttaaaatacccttaaatacttttattattgtgaggtttagactatggcatttgttaatgaaaatctgactccaacgcaaagagaggaactggctaagaaaaagattaagaacccatacgggagctttagggacacgacagaaggtatcatgcccctgtacttaactattgacaaaaattctgaaacatggttagcacattgctataaccatcatgacacgaataatgatatagaggaatttatctttatgtataaatcaaatccgatacctgttcaagcaataaagagtattcatgaaaaacaagtttgttggaaaataacacgtattgatttcccgaaaggattgctaaacgataaagaacaccttcaaattttgttaactgacgcgttcaaagcttacaacatatccggatggcctggcgaagaaagtggacagactaaggtaatatatggctatgagtaaggaggcgtattgtaatgttgacgttattggaagcattagatgagctcaattcaaaatcagaaagtgaacttacgcttgattatcttgaagaacttgctaaaaaagtatctatcgaacctgtgccccatttaacgattaaagactctgagatgacctaaaattggtcttatcagagccttttttacattatgctttttaacgaaatgtcattttaggttgtgcatttattctggcagcaggacgcaggcgcagaaaccgggttcgggctgatagcaatatatggtgaggtataatgtcccccttgtcaagacacaaatgaaaaaaattatcgtgacagcgaaaactttgtatagccatccaaaaaactggtgaaatgcggtcaaaaaagtcctttgcttccactatctcaagctgttcttctgacagttcttttttcttttgcattctacttctcattaacagtcacctcctgtttttccagatcaaattcattctctccctcaatatcggggatatcatctccggaaagacttgttccgaagtacaaagccagcatacgcttgatatcagatttgctcatccgccgagctacaaatccgtgttcggaaatcgctttatccactcggttgatggtgttaaagatctgctcgtccttttcacgtctgaaacgcacagcaaacaaaaactgccttgccgtggacatctcaatctgtatctcatcaagaaaatcatagtccgctttcagcagttttctgaccgattcgttctgctctttttcaagccttttcctaagatgatttttgttgctgtcaaaacactcgcaggaatccaatgccagtatttctaggtcaggtatggtactcaataacatcataagatgatgtattttgacgtcgatattagctgctgacagcacggaaatattggtaggttctacactgaaaaaaacgatctcgactttgtcggtctttacaccgaaacgagtaaagcgttcaagacagataagaccctgaacgctgtttttgttctttgtcatttaaaatttcctccataaatacaattgctgcgaagtcagaaaaaacttcacagcgttaaaaatatagtctatgatcgaagtttcgtcgacccgaagagagagaaacgcaaagcaggcggtcgcagcaaagggcaggacgttccagaagttcaccagaatcacaaccgacagaattattccgccgcagattatgataaaatcccgaacgctccagaaccacagctttacgtttgctctcaggttttcggggtagatgtaggttttcatttttatcaaacctcctttggggtataaaaatacagccaaactttagcttgactgtattagcagtatcttaaatatttcataccattaaattcatagtccggattcttattgaagaagattttttctttgaaattatctttttcacaacagacaatgttgaaaacgaaaaactgatagtaccactcacccgtgtcataataggtgtttctttcattaaaaacaatccgtccatattgatcttttctcaaaacaaaagcagttttatcaaatcctccataaaaatgaacttcgtactgattatcaccgatcggtttcacccctatctttttaccaaagggagaacgattgaattttccatcatacagctgactttctgtaaactgccgactttttgtacctctattgtgcatcccgttagtatcctgataaaaaaaagcagaatgaaacaatacattttgttgtatttcatcaggattgattcttacaggatagaactttatggcatttcttgcttgtgcaaaatttgcatacctgacgttttttctgtattcaatttcaatttgctgaacaaataacatagcgtacaccactttttgttttgaaataataatgtcattatatcatacgtttaacgtaaaatcaagcttttcccttgatcatattcaccgccttagcccccatagaaacagtatgactaacactcatcatattgactctaacgctggtatcaagcccgtacatctgagctatcctcggcacttcgttagccgacagacatatccctaccgcaagcaatgggtgctgagtgtaagtcagaagtccgatatacaagatcgttgtctgcaagaaagccgtcaggcaggttgctatgacctgcttgcaccagctgtaaaatccgtctgtgtagcccctcggaactccgaacatatacaagctccccacagctatctggcataacattatgccgccacgcttgatgtttgcaaacacaactttcaccgtgcagtaaccgaataagatcataaaaaatagactgaacagcgaaatatctgaagcaagggcaaatatgaccgcaagtccggtgtccgccatcgtgtcgctcgttccggatatgaaatttccaagcagttcagttgcaaaggtaccctgcatattgacgcagaatgaataaagcctttgcggaacgaccgtcacaagacttgctgccataaaacctttcagtacatttatgcaggtgttcttgatgtttgcctgccccgattcataagcgacagccgtatcgaacacagctacgataagtccgcagacaaaaagcatccacgcaaaactgccaaacagtccgacaaacacctgtacccaggacagagcaaaaatatccgttgcagtctcattaataaatgtgaatagttccgctatcagtccatacaccttattgaagatccattcaaacataatatcccaaatagcgtcgcttatcgcatcggcggcagcaccaactgtgttgtcccagagcgatgagataccgtcgcttatccagtcaatggcgtctgagatccattcaaacatccgcaccacctcctgcctttgttatctcgccctttactctgtaaagcgagctgcggcgtccgccttggatatgatagcgaggtattcgttctaacaatccacggttttcaagttctgtaaatgcacgatacaccgtgcttttgtgtatgctcagatcttctgctatccttcgtacagagggaaaacattctccgtttttgtccgcacggtttgccagatagcagtacacagccaccgccttgtgacttagtcctaagtcgtagatccttcttggaaatatcaatatgcatcagctcctttacgttttaacagttgtctttttctttgccgtcagctcctcatattctaacgtgatctcttttttcttctgcggatatttcacttcaacgtcttttatcagttcatcacgctctttgtatgaaacggcacgggcggtcttatcgggaagtttgtattcttcttcaaacttgataccccatttgaagaacagttttagcttgcttatcatcgggtgcgttcctgttttcataacaataaactgtcctttcggcatagatttcagttcgtccacagtcataagcggtctgcctatcatctgcaatgactgagatctgtccctgccgtttgataccgaaccgctcaatacagtctgttcgcccaaagcttttgaaagcacctctgcactttggctgtttggtgcaaatccgccgaatacagtaagctgagtgttgtcggtgattatctccataccctgttttccgtagttctgttcaagctgtgcaaaggactgtattatcgccacaatggatatttttcttgaacgtcctgcggagaacatagattcagcgccctctatcttaggaaaagttccaaactcgtcgcagtaaaacataactctgtttttaagcttgccgccgttttcgtctgcaatgactaatatctcacggtaaagctgctggataagcagactgaccataaagtacttgcttgtatcttcttcgggaagaacgataaagatagcagacttttcattgcagaacttctcagcgtctatcgctgttccaaagcacagcatttgttcaagttcagaatcaagaaaactgttaagccttgacaacgctgtactcattaccgacagcatagactggtcagatgcattcagagccgctcctgcaagccattttgctttgtgttcgctaggaagcttgtccataagctttgaaaaatacattttaggttttgctttcgggtctggctgatacttagcaagtaagtcctgaataagcttgaaaacggaaacgatatgccgttcatttttatcgccaaactccgctaaaagcagtatgacttcctccttagctcagtcggtagagcattcggctgttaaccgaagggtcgttggttcgagtccaacagggggagccagagagctgtagcttttgctatggctcttttttcttatttacttcttttacattgaaaaaggacgaacttttgtggttcgtcctttgtttgtattatttctttacaagatctttaataacttctcctgccacgattagtcccaccactgacggaacaaatgccgttgagcctggaatatcacggcgcactgtgcattttcttgccgtaccaggaggacaaatgcagttcttacggcatgaaatagccatatcttctatcggtctgataggctgttcctctgagtaaacaactttaagcgactttatgcctgcctttttaagctctcgtcgcatgactttcgcaagagggcagacctttgtctgataaatgtccgccacacggaatgctgtagggtcaagcttgttgcctgcacccattgaggatataacaggtactcctgcgacgtctgctcgctttattatctccagcttgcctgtaacagtgtcaatggcgtcgataatgtaatcatactgagtaaaatcaaactgatccgctgtgtcaggcatataaaaacacttgtatgtgtttacctttatgtcagggcagatgtcgtgaacacgctcctccgccacgtctaccttgtattttcctactgtttttcttgtggcaattatctgacgattgatgttggtcagacacactttgtcatcatctataaggtcaagctcgcctacaccgcttcgtgcaagggcttcaactgcatatccgcctacaccgcctatgccgaaaatcgcaaccctgctgtttctgagcttttccattgcttctttgccgaataaaagctcggttcttgaaaactgatttagcatataaacactcctgaatactgttttattcttctataatatcatatctatgcccttttttcaagtgcatttttgtctgcttttattaattttctgataaatcctatatgtattatataatatctttgttacagttttcgaccgcattttcgttgcgtttttatcgaaaatgtgctataatattatatgtgataatacgcaaaaagtaataaaaaggattggtaaaaacatggacattaacaagacccttgcggaagaatttaagctcagacaggagcagatagacaacactgttgcacttcttgatgacgataaaactataccgtttattgcacgatacagaaaggagcttacaggctcgctggacgatcaggtgcttagagagatcgctgacaggctcacttacctgagaaatctcgaaaaacgtaaaggcgagataatctcttctatcactgagcaggagaaaatgacagacgagataatgtctgctatcgaaaatgcaaagacccttgtggaggtagaggatatctacagacctttcaagccgaagcgtaaaacaagggcttcggtggcaagagaaaaggggcttgaaccactggctgaacttatcctgacccaggataagaaatgcgacccgcaggtcgaggggacaaaatttatcaacgaggaaaagggcgtgaagtcggctgatgaggctttgcagggtgcaatggacataatcgcagaggatatctctgacgacgctgacctgagaaaatacataagaacgctgttttcacagataggcgtgataagctcaaaagcgtctgacgagaataccgagtcagtgtacgagaattattacgactatgccgaggctgtgggaaagatagcaggtcatagagttttggctttggatagaggcgaaaaagagggcgttctgaaagtatcagtgaatgtcccagagggcgcaggagagagagcctgcgtgtcaagatatgtgaaaaataagtcagagtgcggacagcttgttacggctgcttgtgaggacggctataaaagacttatttatccgtccatagagcgtgagataagggcggagctttcagcaaatgctcaggagggggcaataaaggtgttctcctcaaatctcagacagcttcttatgcagcctcctgttaaagacactgttacccttggtcttgacccaggatatgcacacggttgtaagaccgctgtagtggacgctacgggcaaggtgcttgacactgcaataatctacattactccgccaaagaaggatacagagcgtgctaagcgtatcctgacgggctttataaagaaatatggtgttacgactatctccataggcaatggcactgcttcaagagaaacggagcagttcacagccgagcttatcaaagaaattccgcagaaagtttcttacatggtggtgtctgaggcaggcgcttccgtttactccgcttcaaagcttgcggctgaggagtttcctgagtatgacgtttcactgcgttcagcagtatcaatagcacgccgtctgcaagaccctctggcagagcttgtaaagatagacccaaaggcaataggtgttggacagtatcagcatgatatgccaaaggcgagaatggacgaggctttaaagggcgttgttgaggactgcgtaaactcagtaggcgttgaccttaatacggcttcatactcattgttgtcatacatatcgggcataaatatgacagttgcaaagaatattgtttcctaccgtgaggaaaacggtgctttcaccgaaagaaagcagcttatgaaagttccgaaacttggcgcaaaggcttttgagcagtgcgcaggctttttgagagtgcgtggaggaaaaaatccgctggataacacggctgttcaccctgagtcatataaggcagcgcaggcgcttattgacaggtgcgggctgagccttgcggacatgggtgacgtaaagcagatagctgagaaagtcaatgcaatgggcatgaagaagcttgccgcagatatcggcattggtgctccgacgttaaaggacatagtaggggagcttgaaaagcctggtcgtgaccctcgtgacgagctgccgccaccgcttatgagaagcggtgacattatggagcttaaggacttgaagccgggcatggagcttatgggcacagtgagaaacgttatagacttcggagcgttcgttgatatcggtgttcacgaggacggtcttgtacatatttctcagatgtgcgacagatatataaagcaccctcttgaggtcgtaaaggtcggggaggtagttaaggtttgggtaattaacgttgacctgaagaaaaagcgtatttcgcttactatgaaaaagcctaaggggtaaggatccaaaacgaaataagttggaaaagtcctaaataagtgggacgttggtcttacacttttgcggcagactgaaggcgctgtaaaaaaagcgcaacaaagcccgtggattccctcgatatggaagcccacgggctttaatatatcacacagcaaaaaagaactatctaatcttgaaaaaagggtacagcaaacacagcggcacaaaaactgcgtttttgccgtgttaaaaatgtggaaaatattttaaatttatgccgctttttttattgcaggctttttcaagtggaatttatgaagattaaattgaaaaacttaaaaatatcaaaaaatcttgccttgaaaagatgtttgtgtaaggaaaatcgattaaattgaagatgcatacgacaatattgatcgcatgatagaaaaaaaaaaagaaaagcagtaattatgctgcataagggagtgactactaatgggatttgacagtgagacagcgtttgaaagtgccttgataaaatgtcttgtggaagaaaagggctggaaagacggcgtaataaaatatcctaccgaaaaagatttgcttgataactgggcaaaaatcatctttgaaaacaacagagatattgaccgtttgggcgatttcccgatgacagatggtgaaatggcacagattatggggcagatagccaagcttcgcacgcctttgaatctaaacggatttattaatggcggaactgtgcagattatccgtgacaacgaaaatgacacgcacaatttcaagaagacgatatcgctcaaaatctttgaccgcaatgaaatagccgcaggcagaactcgttatcagattgcacagcagccgaaattcaaggcgaagaacagcatttatcccaatcgccgcggcgatttctgtctgctgattaacggaatgcctgtcattcacgttgaactgaaaaaaagcaacgtacctgtcagtgaagcacagtatcagattcgtaaatatctctacgaaggtgtgtttacggggctgttttcacttgtgcaggtgtttgttgcaatgaatcccgaagaatgtacctattttgccaacccaggaagtgatgataagttcagaaaaactttctgctttcattgggcagataaatataacaatccgattaatgattggaatatgattgccgagcggcttttgtcaattcctatggcgcacgagatgataggtttctatacggttgcagatcagaccgacaacacacttaaagttatgagaagctatcagtattatgctgcaagtaagatttcccgtcgtgtcagtgagatgaagtgggacgataaaagcatttacggcggttatgtatggcacacaaccggttcgggtaagaccatgacaagtttcaaatccgcacagcttattgcaaattccaaggatgccgacaaggtagttttccttatggacagaattgaacttggaatgcagtcgctgcgtgaatacagaggttttgccgatgaaacagatgacgttcagtcaactgaaaatactgaagtgctgatttccaagctgaaaagtgataatgtaggcgacactctgattgtaacctctattcagaaaatgagccgtatcaaggcagaagacggaataaacaatgatgatattgaaaaaattaataacaagcgtattgttttcatcgttgacgagtgccacagaagtgtattcggccgtatgctttcatctataaaatacacattcccacgcgcgattttcataggtttttcgggcactccgattcttgaaatcaacaagaaaaaggattccaccacagctgatgtattcggcgatgaacttgagggcacaaggtatacggttgccgacggtatgcgtgacggcaatgtcctcggatttgacagcgttcctcagcctacatataaagacaaagacctgcgaaaagcggttgcacttgaaaaggcaaaagcacaggatgaaaccgaagtctttgccaatgacagcaagaaaaaaatttatatgcattggatgtatgacgtacctatgggagaacagcttgatgatgacggcgattcgctagaaagtatcgagggatgtcttacagatgcacagtataaccgtgatgaacacagaaaagcagtaattgatgatattctagataattgggtgagccagagccacaacggaaagtttcatgcaatactcgcaacaagcagcatccccgaggcaatcaagtattacaaattgtttgcccagcgtgactgcggtttgaaaacaactgccgtttttgatcccagcgatggaaacaacgaaagctctatcgaaaaaattgatggtatagcccagatgctcgaagactataacagtctattcggtacgtgctttaatatctcgggatacgcctcatttaagcgtgacgtgtgtgcaagattggcacataaaacaccctataccgctgtagaaaatgagccgtctaagtgtcttgacattctcattgttgtagatcagatgcttacgggttacgattccaagtggcttaacacgttgtatatggataagttttataagtggtcaaatatcgaaatgattattcagggcatttcgagaacaaaccgtgtgttcaatgatgataagccccatggaatcattcgttactatcgcagaccatacactatgaaaaatattatagaatatgctttcgagcaatattcgggacaaaagccttacggcattttcgtagcaaagctcatacaaaatcttgaaaatatgaatgctgctttttcggatatcaatgatatattcaagattgcaggaatccctgattttttcaagacttcccgatgatgtgacggagaaaagaaagttttcaaaactgtttaaggagctcaacaaattccttgaatcggcaagggttcagggctttgtttgggagaaacgtgactatgaatttgaagacgataacggaaacaaggacattgtaacgcttttatttgatgagaacatttataacattcttctgaggcgttacaaagagctgcgcacgggtggatcgggcggttccgacgatgagccgtatgatattgaaccttatctgatgtcgctttctacggataaaattgatgccgaatatatgaattcccgtttcagaaagtatatcaagatgatgggtgacggcactgatgaacaaacacgaaatgtcatgttaaacgagctgcataaatcatttgccaacctatcgcaagatcagcagaagtatgccaacattcttttgaaggatattcagaatgctgagcttgttattgatgatgacaaaacaattcttgattacatcaccgaatatcagtcaagagcaaaaagtgaccagttctgtaattttgcaagaaacctgggcattaacgaaactgctttgaagaagttcatgtcattgcacgttacggaagaggatataaatgctttcggtagatatgataagcttgttgagcaggttaatattgatgtggcaaaagaatatttcgagaaagcagagaaaaccgaaatccccaagcgaaaggttcgctcaaagctggataaacttttaagagagttcatcctgagcggcggctttgaaatttcaactaatgaataataacataatgtgagccgtatggagtcaagattcattcttggctcctgtttttttctggtgcaatgcggtcaaaaaagtcctttgtatcgatgatctcaagctgttcttctgacagttcttttttcttttgctttctacttctcattaacagtcacctcctgtttttctagatcaaattcagtttctccctcaatatcggggatctcttcgcctgaaatacttgtaccgaaaaacaaagcaagcattctttttatctcaggctttgacattcttcttgccgcaaatccatgttcggaaatcgctttatccactcggttgatggtgttaaagatctgttcgtccttttcacgtttgaaccttaaagcgaacacaaactgtcttgcagaggacatctcaatttgtatctcgtcaagaaaatcatagtcagcttgcagcagttttctgaccgcctcgttctgctctttttcaagccttttcctaatatgatttttattgctgtcaaaacactcgcaggagtccaatgccagtatttctaggtcaggtatggtactcaataacatcataagatgatgtattttgacgtcgatattagccgcagacagcacggaaatattggtcggttctacgctgaaaaatgctatctcagccttatcggtttttacgccgtatttagtaaagcgttcaagaccgataagaccctgaacgctgtttttgctttttttcatttaacttttcctccaaaaatataattgctgtgaggtcacaaagaactttacagcattaaaaagatagtccattatcgacatgtcatctgctcttacagttacaaaagcatagcaggctgtgactgcaaaggggataatgttccataaattcacaagcactatcacagacagtactatccctgcacagataatgataagatcccgaatgctccaaaaccacagctttacgcttgctctcaggttttcggggtagatgtaggttttcattttgctcctcctttcagcataccgactgctttagctcccatagaaaccgtatggctaacagacatcatattgactctcacactggtatccaatccgtacatctgagctatcctcggcacttcagtagctgacaggcaaatgcccactgcaataagagggtgctgagtgtaagtcagcaatcctagataaagtatcacagtctgcaaaaaggctgtaagacaggtcgatatcacttgtttgcaccagcttgaaaagccgtctgtaaagcctctgggaatgcctatcatatatatacttcccactgctatctgacacaacattatgccacctcgcttgatgttcgcaaacacgacctttaccgtgcagtaaccgaaaagtatgataaaaaacaggctgaaaagtgaaacgtcagatgcaagaacatacagcacagaaagccccgaatcggctatagtgctgtatgtgtcagacaaaaacaccccaagcagatcataggaaaatgaaccctgcaaagctatgcacagctcgtaaagccgctgtgggactaccgcaaagagagccgccgccataaagccttttatcacattcacacaggtctgcctgatgttagccgctcccgactcgtatgccatagcagtgtcaaaaaccgccatgacaagaccgcagacaaaaagcatccaaccgagagcctgaaacagactgacaaaggtcctcacccaggcaagagagaacagatcggtcgccgactgatctatgaacataaaaagctctgccaccgcaccgtagaccttgttgaaaagccactcgaacataatgtcccacacagcgtcggatattgcgtctaccgctccgcctatggtgctgtcccacaggcttgatatcccgtcgcctatccagtcgatagcgtcagatatccaatcaaacaagcttatcacctcgtttctcggaacgatttgtattagttatctctccctttatgcggtacagcgaactccgccgaccgccttgtgggtgataacgtggggaacgctctaacgatccgctttcttcaagctcgttaaaagcacgaaacaccgtgctttttgaaatgctcagatcttccgctattcttctcacagatggaaaacattcgccgtttttgtcggcacggtttgccagatagcagtaaacggacacagctttgtggctaagtcccaggtcgtagatcctttttggaaatatcaataaacatcactccttttatgtcttgacattggtctttttctttggctcttcctcaaattccacaggcagcatatcttttttcttctgcggatatttcacttcaacgtcacggataagttcatcacgctctttgtatgaaacggcacgggcggtcttatcgggaagtttgtattcttcttcaaacttgataccccatttgaagaacagttttaacttgcttatcatcgggtgtgttcctgttttcataacgataaactgtccttttgacatagatttcagctcgtccacagtcataagcgatctgcctatcatctgcaatgactgagatctgtccctgccgtttgatacagaaccgcttaatacagtctgctctcccaacgctttggataacacttccgctgactgagaattcggggcaaaaccgccgaatatcgtcaattgcgtgttgtccgtgattatctccataccctgttttccgtagttctgttcaagctgtgcaaaggactgtattatcgccacaatggatatttttcttgaacgtcctgcggagaacatagattcagctccctctatcttaggaaaagttccaaattcgtcgcagtaaaacataactctgtttttaagttttccgccgttttcgtctgcaatgactaatatctcacgatatagctgttggataagcaggctgaccataaagtacttgcttgtatcttcttcgggaagaacgataaagatagcagacttttcattgcagaatttctcggcgtctatcgccgttccaaagcacagcatttgttcaagttcagaatcaagaaaactgttgagccttgaaagtgcagtcgacattaccgacagcatggactggtcagacgcattcagagccgctcctgcaagccattttgctttgtgttcgctgggaagcttgtccataagcttagaaaaatacattttaggttttgctttcgggtctggctgatattttgcgagcaagtcctgaataagcttgaaaacggaaacgatatgccgttcgtttttgtcgccgaactcagctaaaatcagcatgacagatcgtgtacaccatttccgagaaaaatgttcccgtaagatatgtagttccagcggatcagactgcaacccttacgtcagacgcaacaacaaccaagacattcaaaaatatcctcaagaaatttactctagaggtgacaaaacaggacgcagagatggtcacagcacagggcaacggaacacttgcgggagcagtttacggactgtacaaggacggcgagcttgccgatacctatacgaccgatgaaaacggatatttcaagacaaaagagtatgtctgcggaaactacactgttcaggaaatttcgccaagcgagggctatctgcttgatgaaacagtttactcagttggtgcagaagctgagaattatttcattgagcataacccactttctatgacagtgactgaggacgttatcaagggaaatatcgcaatgatcaagcattccgatgacggctctactcagatagaaactcccgaagtgggagctgaatttgaggtgtatctgaaatcttcggggtcttatgcaaatgctgttgaaacagaacgtgattacctgacgtgcgatgaaaacggatttgcacaaaccaaggatatgccatacggaatttacaccgtgcatcagaccaagggctgggaaggtactgagtttattgctgattttgatgtcaacatcagcgaaagcggacagacctaccgctatctcattaacaatgcaaagtttgaaagctatatcaagattgtaaaggtggattccgaaacgggaaaaaccattccttatgagggtgcaggatttgagatctacgattcaaacggtcagaagatctcaatgacttttgcataccctacccccacaacaatcgacactttctacacaaacagcgagggctatctgatcactcccgaggttcttccctacggtgaatattcgcttgttgaggttcaggctccctatggctatgcacttgacagtacgcccgtgtctttcacagtttctgctgataacgcagagaaagaaaatgccctgacggttattaaagtccgcaaagaaaacaccgctcagaaaggcaggatcagcgttcagaaaacaggcgatattttcacaagcgtgacaacggcttcctccgcatacacaaatgaaaacggtgaaatgatcgtgaatccaacaacttacactcccgtgtttgcagacggagatctcagcggtgcagtatttcagataaccgcaaaagaagatattgtaacggcagacggtacgattagagcttatgccggagatgttgtttcagagatcacgacagacgaaaacggctatgccgaaactgagccgctttatctcggcaagtatgaggtcagagagataaaagctccctatggttatgtgctgaacaatgagcctaaagatgttgaactgacatatgcagggcaggaatttgaggtgagagatactgtgaatacagcttttgaaaatgagtatcagagcgtgaggatatcgctttctaaggttatggaaagtgatgaactgttcgggatctacggcaaggactgctatacaagcattcgtttcgggctattcgccgcagaagatattactgccgctgacggttctgctattcctgcggacggactgctttcagaggtttcacttgatgaggatatggccgcaaaatttgatgtacagatacctttcggcaggtattatgtcaaagaaatttctactgatgaacactatgttcttaacggtgaaaagtatcttgtgaattttgaatatatgggacaggatattcagaatgtggatattgactgcggacagtttgtaaatcttctcaagcgtggcaggatagagggacataagaccgatgacaagagcgaaccccttgaaaatgcggtgttcggtctgtttactgccgactgtgtgaagttcagcagagatactgcaataatgactgccgcctcagataaaaacggatattttgtgttcgacgaaatcccatacggcgagtatattgtcagagaaatcgaagctccgacgggatatattctcagcggtgaaagctatcccgtaactgtttgcgaggacggcgaaactatcacaattcgtacagttaacaagcctattaccgttgaagtgtctaaggttgatgtatacggcgaggaattaatcggcgcagatatgcagcttgaaaatgctgacggtgaaatcattgacgaatggatttccgatggtacaaatcacgttgtttcaaagcttggtgcgggtgaatatgtgcttaaagaaattgccgcacccgacggttatgtgattgcaactgacattaaatttactgttgatgtttacggcaatattacggtagaaaacgttgaagccacagtgacttcggagaacggcaatccgcttatcgttatggtagatgacacaacaaaggtgcagatttccaagcaggatatcaccacaggtgaggaactgcccggcgcaacgctccaaatcattgacgaggacggaaatgttgttgaggaatgggtatctacagacgaagctcacttcatcgaaggcaagctgattgcaggcaaggagtacacacttaaagagattattgcacctgagggctatgagatagcaaatgagataaagtttactgtgaatgctgacggaactgtgaccgaggtcgttatgtacgatgagcatacgcctgatcttgaaacccctcctacggtcacaatagatactcctcatacaggtgtatccgcagacaatggtgctgagctttatctcgtagccacagcggttattatggttttcggtatggtcatatacaaaaagaacgataaggaagcaaaagaaaaaagaactgtcagaagaacagcttgagatcatcgatacaaaggacttttttgaccgcattgcaccaggcattatacgcttttacacagatcactacatctgtggaaacttctacaagtcctgctgggcggtgacggagtatccgccaagtacggaagaaacggctatacttgctcaccttgcggacaggaacggtgtaacgctccgtatctacaaccgccttgttacaagcatggagcaaaggaagatcgttcagcaggcaatgaggaaaaaccatatgatgaccaccacaaatgacgtcaacgagagcataaaggctcagaacaacattgacgatgtggtagaactgctgtcggagcttagaaggaacaaagaacccctcctgcatacggccgtgtttatcgagctaaaagcaattactgaggacaagctgaaagaactgcaagccgatattcaaatggaacttacacgttccaaaatatctgttgaccgtttgcttttacgtcagaaagaggggttcttgtctgttcatcctgcgggcaataacgtgtttgcaagtcagtttgaacgtgtcctgcctgcaagctcggtggctgatctttatcccttgaattacagcggcaagaccgatgagagcggcttttatgttggaagagataagtacggcacgaatattcttgttgactttgacaagcgaaccgaggacaaaaccaactcgaacattttgatacttggcaacagcggtcagggcaaatcttatcttatgaaactgctgctttgcaatcagcgtgaatcaggcaaatctatactatgcttagaccctgaacacgaatatgaggatctgtgcaataaccttggcggcacatatattgatatgatgtcgggtgagtttatgataaatccgcttgagccaaaagagtggtcagaaaattctcgctttggaaatcaagaaaaggaaaccgatgacagccctgaaacattccgaaaagtaacccgtttaagtcagcacatcagctatttgaaagactttttcagagcgtacaaggattttagtgacgccgaagtcgatacgatagaaattatgctgatgaagctgtacgcaagattcggtattgatgacttcacggatttcagtacgcagaaaaacgaggattatccgattatgagcgatctatacgaactcatagaaaaggaatttatggcattcgatcacgagaagaaacatctctataccgaagaaatgttacagaacatctgtcttggactgcacagtatgtgcaaaggagcagagtcgaagtacttcaacggatgcaccaacatcaagaacggcgagtttatctgttttggagtgaaaggtcttatggacacgaacaaaaggctgaaagatactctgttgtttaatattctgtcgtatatgagcaatcagcttttagggtgcggaaatactgttgcggcagttgatgagctgtatttattcctcactaatatgacggcgatagaatatattcgtaacggtatgaaacgtgtgcgtaagaaagagtcctcgtttattctggcaagtcagaatatcgaggactttctgctgcctgagataaaggagttcaccaagccgctgttttctattccggcacatcattttctgttcaatcccggtaatatctctccgactgcatttattgataccctacagttggaggaatcggagtatggattgataaagtatcccgaacgaggtacttgcctttacaggtgcggtaatgagaggtatcttttgcaggtcattgctcctgcctacaaggcggcactgtttggttcggcgggaggaaggtgatgtaatgtcggcgacagttgcggcggctcttaaaaaggcagccgtatatattcttggtgatgaaaaaaagcgaggcaagcttgtgactgtggtgcttagtgctgcggtgggtttgctccttttgctgtgtgctcctgcggtgatgctttcttctcttggggaggtcggcgaggaagctcaagtgcctgaacttcacattaatgccgatgatttttacagctctcttgacagtgaaagcaggcaaaggctcgatgatatccgatcagcaggtaatgacattgcaaacgctatggacgaaaagggtgtcaaggttcagaccataaaggctcagctgatatatatgtcttactttgaagatgttcagaattttaatgctgagtcatacgcaaatttgttcgctaatgctccgaatgacagcgatttgattgcggcgataaactcgacttacagtttggatattgactatgatgagtttattcgcacatacacttttgtgatgaacagcaccataaatgcgtttatgttttctgatacaagcacgaaaaactgtgctgatcttgcggcttgggctgataatgcttacatctcgggctggggatatatgaatggttttattggtgaaagaagcgaaactgacaggatacgttatgcggataatatccaaatatgaattcaaggcgtgggagagttggcaaggagatagctcatacccttacaacaagctgtaatcagggatattacgcattggggatagatatgaatccagagccgaaggtcacagagcttgcaagatgtatcaccgcaaggcaggacagcggtatcggtcatcacaaaggcgaaaaatccggagtgttcctcataacagacccgatagctgtgcttgaccctgcaaaagcagaaacaagacagcaaggccgaagatttaaacttcccaacgagcctatgtttacaataactgtaacggacaggcacggcgttgtttactgcggatatatccgaaagcttatgcctttggagtgctggagactgcagggctttaccgatgagcagtttgaaagggtgaaagccacaggaatgtccgatgcacagctttacaaacaggcaggaaatgcggtgacaaccaatgttattgaggctctggcaaagtatattttagacattgataaggagaatgcgaatggaacagataatcaaaatttttgaaaacgagaagtttggtcggatcaggactataactaaagacggggaaccatggtttgtgattgcagatgtatgcagagctcttgaaatcagaaattcaaggatggttgcaggtcgtctggacagggatgagctgatgtcagttaaactgacatcaggtggtcagcggcgtgaaatgaccgtaattaacgaaagcggactctatgcggttattatcagaagtgataagccgcaagcacaatcttttcgtaaatggctgacttccgaggtgatcccaactatcagacgcacagggggttacgtcagcaacgaggaaatgttcatagaaaactacctcccgtttctcgacgagccgtaccgtgacctgttcagacttcagatgacggctatcgaaaagctgaatgaacgtatccgtcatgataaaccgctggtggagtttgcaaatcaggtggcaggaacagatgacctaatcgacatgaacgcaatggcaaagcttgctgctgataaaaatttcaatatcggcagaacaaggctgtttcgctggctcaaaagaacgggtgtactgatgtcaaacaatctgccatatcagagatatatcgacagaggatattttgcggtcaaggagtcggtattcgaggtcaatggtctgaaaaagacttatcggcagacatttgttacgggaaagggtcagctttttatcataagtctgctgagaaaatattacggaaaggagatgtcgtgatgtccaaaaagccaaaatgtccgctgataggtcaggacggaaatgtatttaatcttattggcatagcctcaaaaacgctgaaaagaaacggtatgccggataaagccaaggaaatgtgcgagcgtatcacgtcttccgaaagctatgttgaagcactgagcattatcgacgaatatgtggagatcacgtcaattgatgatgaacagacagaaaccgaagattttgaaatggagatgatgtaaatgacgtatttgttcattggaatgatgataggtgttatcatcggaacaacgataggttctcttgccgcggcttttaaggcagcggaaaaagagatcgcacgtctggacaaggaggtaagtgatgcacacaaacagaattaaagctaaagtggacttcaagttttgtctcggcagtattcctgcaatgctgagagcaacaaagcctgtgctttcggaaaagcaatacaaggagctgtgtaatgaggtcaaccaagcagaaggctatcttgaacagaaacgcatcatattcagctatgttgacccgataatcaagggctgaaaacagcgtaaaatctaatatttattaaggtcgttttgccaacagcagatcaaaaatctggtgcttgcaaagcgacttttctgctgttggttctaacggcagaaaggaaaaacatgaacagttttatgtcatgggtagggggaaagaaaaatcttcgtgacgaggttcttgcaagatttccgccttactatgaaagatatatcgaggtgtttggcggtgcaggctgggtgctgtttcacaagccgcccggtatggatttcgaggtgtacaatgacttcaattcaaatcttgcaaatctgtaccgctgcgttcgtgacaagcctgcaaagctgaaatacaagcttaggtatgtgcttgattcaagagaagattttgacctgacttcaagcctgcataagcgtggtatactgccaaggctttatgacgttgacagggcggctaagttttatcagcttatacgttacagctatgcaagcagtcttgaaagttttggcagtcagccacattcaatgtggtctgattttccgatgattgatcttgcggctaggcgtttgcagaaggtcgttatcgaaaacaaggattttgatttatcgggcttttttcttttgctccagtaaaaataaatgggcagacacgctggctctaagaacaatttttaattgatattatgctaaaacgcactaccatagctaatgcgtctgtcggttaatatattcatatatgtaacgaacaaatccgcaggcgatactgcggatttcgttttaatttctatgcactttctaattcttctgttggctcaataaacacgctgacagttccattaaactctccgttcatctcgaatctgatatcaagacttttatcttcattttgatgaataagaattcgtttgacaagcattcgcaaattaacatcggatattgaaccttcggacaagatttcatcaataatctgagttgtattattaaggtgttcttttctctgcttgcagattttgtcatactctcttaaatctgatatctttttatcaagtttagctatttcatcctcacgtttggtgatcatattgttgaaaacttgcgtgtgttcacgatcgtttattcgttcgattattaagtcctcaatttgctgtcggagtgataaaatcctatcattgagctgctgtatctgacgttcatacagcggctttttctttgaccagtcttttatgatcttattgtatctttcaccttcagcaagaataatatcacgcagtctaagtatttcatcttcgaccagttcatcaagttgattttcacggactgtatgcggagtgcagtattgtttaccatagcgatgattgctgttgcaagtgtattcaacgtactctttgcctttccattttcttgtgcgagctacaaagcaagccccgcagtcggagcattttattaatccggaatagcgatgaagattcctgccattttgcgaacgtggattaatctgtgaacgctgttccagtaaaaactgtgcctgtttccaagttgtttcatcaattattggttcgcagaaattctcatggcgatactgttcttcgggcggaatgaaagttttggttttgtatatttttgaagttactgtcttatgattaaccattgtgccaatgtataattcatttgtgagaatgcgtttgactgctgtttgtacccacaagtattttttagagatgtcgggtttccaatctgctagctttctgcgctgatagtattctggtgattttattccacgttcgttcatcttctttgcgattgtggtcaagccgtagccgtcaacgtatagcttgaatacttcctgcactatccaagctgtttcatcgtctaccaaaacagtatttgtgtttcggccacgcttgtaaccgaggggtaaggactctatcagaccttttcctttctgcttttgacgtacacctgcttttacttttttgctgatgtccttagcataaaaatcgttgaagatctgcttgaatccaatcatcaaatcgtcattctcgttactggaatcaatgccctcagtcacagaaattaccttaacattattctgtcgcaagtgatcaatgaagagttcagtctgcgttctgtgtcgtcctaatctagatagatccttgaccagaactacatcaattttaccttcgtcaacagcaatttcaagttctcctaagccttttctgttaaacgtcattcctgaaacattgtcatcaaagctctctccgacgatttcgtaaccattctgctcagcgtaatcaactaaaatctgtcgttgattttgcagactgttcatttcctcatcttcgtcacgagataatctgtagtatagccacgctctcattttatcgacctcctttaaattcggcaggcacgctatggtgtgtctgcgttacctatctgaacttcgttcagattgacactaccacaagccgacctgaaagtccagcgattacgctgttttatcaacaagttctaccttttcaataaaatcggagtcggagcatttggacatactatctgaattcaaatagtcgttaatcatggactccatgaaggtatcaaatgtctttccgtcgccattatagataacagtgactgaattgattttcgggatttctctttgtcttggcatatttttatcgccctccttactgtcttttcagtttctttttctctgatttttaaactgatcatttttaatcattcctttcttaaaatttcgtttgacatcatcaacaacgcccgcaattatgccgatttcacgcagttttttgcacttacgacccctcaatcattcaaagctcaaatttatgaccccataaaaattatgcacaatcattttgctgaaactgcgtattttcggcacttttgcggcgagctttgctcgtccgctgtgactgtttcgggggcttgataactacaaattatcggaggatgtttacaatgactcattatcaattttcacagatatttttaggttttgctgcaaaagatagatatactgttgccgaatctttattgtatcatttagagaattatggcgtgcctgtatggtatgatagacatgatttaataattggagataatcgacaaaaagaaaattttgaaaaaggtattatagaaagtaaatatgcaattatcattttttcagaaaatacagaagattgcttttgtctaaacgaagaaattgatgttatatataatatgcacaaaaaagaagaaattagagtattcccgatattatttaacattacatttgaagatctaccacaaaagtataaatggataaaagaattgatatacagagaaattagtgacaaatcaggaagtgcaattactgttagcagtattgtttgtcgttatttaaaagatatatccgattctcttccgcataaaaaattatatgattttactagtattaatttaaaatgcgataaaaatggatacatcaaagaattgctaaagcaatattatagtattgaccaccataatcttaactcgagattaactattttatatagtgtgtatcttttcataaaaagcagcattacatatcagcaaattgtatcgataaaaccgatagagtggctattcagcataactaagttggatttaaagatagattttaaagaattgcgaattgctgaaaacaatctaataattttactgaatattatagatgactattatactctgcaataatttgtaatacaatgtctgtaatctttatagcgtctctggattttccaagtacgtctatgtatttttctaaatagggatattgcgttatattattagatatatcattgtatatttttctcgattcaaaaccggaacttcctattggaattattacttttctgtttttctttgcaatttgatattcattccaaaccccgatggaattatgttcttcatttctgcgttttgaatcaccaaacaagaaaattacgaattgacattgatcaataagattttctctatgattgtgtatttgttgttctgacatatgctcagcaaaaggcctcatttttaaatggtgttcaatatttgtaatatgtacttctgaaagataatttaatccatagccgcttatataattaccaagtttatatcccataccggaataaagttgatattttttcaacaatcgataagttagttccttggcaagctcgtttgcgaatttatcatcatcatcattaagattaataaatgagcctgaaataaaaacacgatatgaacgtatcttgttagccagtcgatttaaaatgttaggaatttcattattggatttgacttgcaaaactttgatatggtatcttgtttctaaatcttttataaacgccttgtgttgacaagtatttttcttttctataattgtataatgaaagttgtttttatcatttaaataggtggaaataaatgaaagacatgataatactattgtatccgagaaactataacccaaaaacaaaaatgtattagatataagttcctttttaaaaaaagtaagcagtaattgatgattatcattatatttttcaatatcagctttagttattactatattatcagaatcgctaacatcaccatttaatttatagatggtaacatctgtttgaggaactaaactgactaaatcggaatctcggattattttattagaaataatcctgcgttttgataagttatcttcgattactgaatcatagtttgttgtccatatgtttttgaaatttaaatccattattgaatttaatagttcgctttcaaattcaaaatttttgttcaatacggattttactatcgtttgcaacgctgtttttccatatctatttgaaaagtattgtgctatcgaaaacaaatccgtatcttttgtgatttttatattcaatttgtgagcgcattcttccaacagcttaccccaacttgggaatccgacactgcaagaactacctgcccctaaaaataaggatgattcatctctaataatatgttctgccatctcatttataaactctttttcattcatactatcctcaccataatttgtagttatcacgacttcgacctttgaagtctttccgtcgtaagttatggtgcagttatcattgactgtaagccaatgatctgtgtcagcaggcacagggttgttccatgaaaatcccgaagtgctgtagccaagctgagtaagagtatagtacaccaagccagagcaatcaattccaaggtttcggatcgtatccacgcttagagcctgatactgaccctgatcatacgcataccagtagcccttgtttccataggtatacggcgtacccagcaaagtcgccgcctttgcgatcaccgtatctgccgacgggaacgctgcgttttcagtcgatgagcttgccgcattcgctgtaataactccgctcatagatgagccgagcatagaaaaagcacagagtcctgccatgaaccctgcgctgagtttctttaatattttcgatttattgaacataaagtgcatttctccttttcatttttacaaagaaaaaaagagccgtttccgactctttttttacattatttatcacaatgctcctttgctttcaaatagatgttctgaaatttctcggtatctctgatatcatcaaacacactccagttcagatagcccaaaagttctttgcaacataacgtgggcgatgaaacgcttatgtcatacatatcatatacaagcttgtttaccgcaagcgaggtgtatggctttctctcaggcagttcatcagcggcgatggcaaaattcaatgcttttatcagattttcaaatgcctcatcgtagtcctttgaccgtactgcgaccgcagcaatgtgagtgtataccaaagatataagcctgtaatggaaattataatcttcattttcaaatattgcctcagatacatcaacgatcttgttcagaatttttatcctgtctgtatctttaagctgaggatcattctcacagttcagatcagctctggtaagcagagaataacaaagttcctgcaaatgaagaataatatttttctgacaaagtaccattttttcattacctgctaaaagaaattctttgaccgtatttttggcagcagaaggaagctcatcagcatactccaacgccttttctttgttgccggcccaatagtagtaatagcatatatccactctcatccaatcaattattttcctgtcattacaatttgccagaatatattccgcaatttcagcagcctccgccgatctctccttgcctgcttcttcactcttactctcaacacaaaacaaatttgccgcaagcttagctgacatcatatagttatttggaaatctttttaccgcctcacgcagcaatgctacattttccgcccgcaaacccttgctctcgttcacatctacctgtgctaatattttttcggcttcttcgttgctgcatattttctccatacccaccagctcatcaagcgaaacgctaaatatctgagctattgaaggcagcattacaatatcgggataactctctccgcactcccatttagacaccgcttgaaaagacacattcaaacgtgtagccagctgttcctgcgtaagacccttttctttacgcagtcgtttcaaattctcactaacatataatttcataaaaaacctccaagtattcaaataatattcaacagtactgctatgtttttattataaaggagaactgccgaaaaatcaataactcggtgtttgaatattgctcaacgtggggttgattttttcaataatacatttaattttgtttctcaccctcactttcacaatactctttcagcggacaatcgccgcagtcatcaaacattgcacaggtacgctgtatctcttcttgatataatccccttagagtagacacatgaaataataaaatggtgtaactctaaagggggttattttatgtcaaagaagaaatcacttacaagtgaagaacgtgttgcagcagtacaggaatacctcgatggtaaaggtggatacaaggcaattgccagaaaatacaacataggggctacaacgatgaaaagaatggtatgccgagctaaaaccgaaggaatcgaatccgttgcaaaggcatcaccgtatcgacactataccaatgaaataaaagaagcagcagtagaagattacctcaatggaaaaggaagcttaacagaaatatgtataaagtataaaatctcaacggatattgtcctcagaagatggatttcatggtataataatgacaagagatttaaagagcataaacgctcagaaagaggacttgccatgaacaaaggtagaaaaaccacacaggaagaacgtgcggaaattgttgccttctgcattgaaaataataagaactacaccctgacagttgaaaaatataatatttcttatcaacagatatattcatgggtaaggaaatatgaaataaatggtgtagaaggactgattgaccatcgaggaaaatcaaaaaaacaagaagaccttacagaagctgatcgtcttcgtatggagaacaagatattacaagcaaagcttaaagatcaggaaatggaaattaaactgttaaaaaaactcagggagctgagagggggcggtcactgaacggagtacgaaacgtggacaagtatattgcaatcaaatacatgaatgaagcagagcattatccgattcagaagctctgcgctgctgtacacgttgcacgctcggcttactacaagtggctgcatcggacaccgagccatagccagcagatcaatgagcagcttgtagaatggatcaaacagcactatgaggagcgcaacggcatcttaggttatcgtcagatgacggtcgtgatcaaccgtgagcatgatgtacatttcaacaagaagcgcatctacagactgatgcagattcttcatctgaaatctgttacccgtgtcaagaagaatacatatattccatcaacgccgcaaatcacagtggagaatattctgaacagagatttccacgcagataagccgaacgaaaaatggcttacagatgtaactgaatttaaatattacgtaggaacagagatcagaaaactgtatctcagcgcaattcttgatttgtatgacagacgaattgcaacatacaaaattatggaaagcaataacaacgaacttgtgttttctacatttgacgaagctgttcgattgaatcctgatgctcacccaatcttccacagtgaccgtggctttcagtataccaacaaattatttcatcaaaaactgactgatgcaggaatgatacaaagtatgtcccgtgttgggagatgcatcgacaacggaccaatggagggttggtggggaatcttaaaatcggcgatgtattatcttcgcaagtttacggataagaccgaactgatttcagcgatagaggaatacataacctattacaacacaaggcgttaccagatcaaactgagcagcatgacacctatggaataccatgaagcgtatgctgcttagctggtcggtgggtgccgcggcaagcacctttctccgttcgtcgcttcgctcctcactccaaaaggtgcttgccatttgctaacaacaaagcagcctgcacaaattgcacagactgcttttagtcacaacatagaatatttttgttttttgcgctgtctacttgacagggggcgggtcaaaaatgtggaaaatattttaaatttatgccgctttttttattgcaggctttttcaagtggaatttatgaagattaaaaccacagcaaatcatcgcaatttctaaattcaaggcttttgatcctcttctgcgagctctggtatatgacctgttccacttgataatgccgtttgcaccttccgactggatacttcggttcatacgcagcagtgctccgtgaatgctgttcagattgcagagcacttccttgtgaaactttgtcagttcttcattcaagcgaattttacgattccctttgcacttacagcatttttctttttgcagacaattactgcaatcttcacattgataaaattcttctgttctgccatatttgtttcctcttacaggtctgctgtaaagataatgaaacttttttccgttaggacacattggatcgccatctgtatctatcggaaaatttactgctctgtacggatcatcacgatattttttgtccttgctttccttttcatacatagtaaatttcatgtattttttcatgccgtgttcttcacaatacagataattattaaagctgccgtatcctgcgtctgctaccggatattcaggatatttttcgtatatctgattgaacttttctatcaaaggcttgaaacattccatatcagacgcatattgttttacgtcgaatactgcgatatattcatcacagacacctaattggatattgtagcccggaagaagctgatcgttacccatatagtcctttttcatacgcataaatgttgcgtcacgatcggtcttggagtaactattgcgttcatctccgcatatctttatgtgttctgcatacttttttagccttgaaatgtattccgaaagcttgtcataatgcctctgttcaattgttttatgatgtccccgtccccgaattgcagtttccgggtcaaagccgcaaagctttacatattgctgctgtatttgctctaaatactcaatagcatattcttcacgaatgccgaattttacgcagaatgaagagatcttttcattcatttcaccaagcaattctgttatccttgcaaataccttcagacggtttttctcacagctttttttccatacccagctgtatttgtttgcgttggcttctatctttgttccgtctatgtaaacgtggttgaggtcaacattttccaccgtaaaaatgtaactgttgatatccgcaaagatctcatctatttttctatttaggacattgttcataaaattgcctattgtcgagtggcttggcggaggattatcctgcagcagccacataaagcgaatatcggttttgcagagtttttctatttttcgcaatgattcgtatccgttttccataaatgcaaacagtattactttcagcaaagtttcttcttcatatcttggacggcctgtcctgcggtcctcagtcgtcaggtatttactcaggtcaatatgattcatcacttcacaaaatgtatataccgggtcagttgtttcaattattttttcaatttctattggaaattttaattgatatggtgtataatattcttgtggttggttattcatgatactttaattataccacaaaaaaagactgctgtcttgctttttggcaagatcgcagccttttttcttggggactttttttacagccccaaactattcaattagaaaatattgcgtataagaagatagtattaccaacttgtattaaaattgtaacaaagaatatgatgttcaatctaaggcagcaagagatgcttttgtagaatttttgatgtggagaatttcaaatgaataaaaaaatatatgtttgtattataataatcctcgctatcctattgcttattacaggaacatattctattgtacattatttcttcaactataattgtacaaactggtttaaaaaaagtgtaaaaaatgattcctatataatcattggtgaagaaattggcgatacattttggaatagcgattctaaagcgattattactataaaggacaatgataggtataaatttctggtttcgtttgaaaccagaatagaaaatgagggaaatgatcttacagaagaaaattatgatatagaatacaacgatgaatatataaaaataagtcttatcaaccatgatggaagtatttgcagcgtttatcgattctattatagtgatttttcctgataataagcggtaaatatagtggtggtattcctggcataattgaattttggacaatagaaggaaaagtaatatataatacataggagggatgaaaatgagagtatattgtcgatgtggaaatatgcttacaaatcagcttgaccctaacgatacggaatattatgtttattcagacagagaatggtgtgagatacagaaaaacgaatacatacacgttttggacattccctatcctcgctataatgtttggcattgcgaaaaatgtggcagaataactttgtttgatgattcttacaatttagtaaaagtatataagccggaagaatgaatgcaatccaaagcatttatggaaaatcagcagttaaagagaattatttggacaaagtaggcattgtaatatgtaagaactatttcgacggctttattgataagagatggaaatatgttgtattataacaaaacttagtaacaaacggtggcgcagattatattgatgcatcaacaaataaaaaatatgatataaaaagctttcgctcatatccaaatggtcaaaccgctccaagaaaaggcgcatttaaattacaaaacgcaacggcggatgttacaaaagaaatcaagaaaggttattatgtaataatagatactgttggtttaacaaatgagcatttgtttgaacttaaagctgcattggaagaaatgggatattctgagtatatcttgtggtactattaatggagatgctatatgtttaggaattacgaaaataaatcattttcttatcttagtgaacctcattacgaatctatttatgttgcagattgtaatttttttaaagtaaatcatagcaattttgaactatatgattcaatgattttcgaaagccaattggattattgtactttttcaactgctcgtattggtaaaaataaatttgggtattcatcattatctaattgcagtatttgccatactaattttataagaaatgagtttaatgatattaatcttagttctatctccttttttgattcattaatatgtggaaacaattttgaaaaatgcaaatttgaatctgttatgtttgaaaatgttaatttcgagaatagttatttttcagattgtttatttcacgatattaatttatgcagattaaaaccacagcaaatcatcgcaatttctaaattcatggcatttaagccacgtcttctggctcttgtgtatgaccgattccacttgatgataccatttgcaccttcagattgaatgcttctgttcattctgagaagcgctccatgaatacaattaagattgtttaaaacctctttgtgaaatgctgtcaattcttcatttatgcgaactatgcgatttcccttgcatttgcagcacttttctttatgagaacagtttgcacattcttcacactgatagaattcttctgttctcccatatttgtttccctttatgggcctgctgtaaacgtaatggaattttttgttgttaggacacagcagatcaccgttttcatctatgcggaaattcactgctctgtatggatcattatggtatttaatattcttgctttctttttcatacatggtaaatttcatgtattttcccattccgtgttcttcgcagtacagatagttgttgaagcttccatagcctgcgtcggtaactggatattcaggatactttccatatattctgtggaatttttccataagcggcttgaagcaatccatatccgaggcatactgctttacgtcatatacggcgatatactcatcgcaaacgccaaattgtatgttgtaacctgggagcagttgatcgtttcccatatagtcttttttcatacgcataaatgttgcatcatggtctgttttggaataactgtttcgttcattgccgcatatttttatgtgctctgcatacttttttagtctcgcaatataacttgtaagcttatcataatatcgctgttctggagttttatgatgtccacgtcccctgacagcagaagcaggatcaaaaccgcaaagctgtatatattgctttaatatctgttcgagatattcgatggcatattcttcgcgaactccaaatttcacaccaaatgcggctattcttttatttatctcacttaacagttctgttatctttgcaaatactttcacgcgatttttctcacagctctttttccatacccagctgtatttgttggcgttggctgtgatctttgttccgtctatgtacacatgatccatatctacgttttcttgttcaaatatgtaagcattgatgtcagcgaatatctcttctatttttccgttaagcacattgttcataaaattttctatcgtcatatggcttggcggcggttcgtcctgtaataaccacataaagcggatatctgttttgcacagcttttctatttttcttaatgattcatagccattttccatgaatgcgaacagtattacttttagcaaagttttttcatcatatcttggtctgcctgtcctgcgttcctcagtcgtcaggtatttatttaggtcaatatgatcaataacttcacaaaatgtatataccggatctgttgtttcaataattttttcaatttctataggaaattttaattgatatggtgtattatattcttgttggtattttttcatcaaatttattataccacaaaaaagactgctttcctacccttttaagggtggttgcagtcttttttcgacttcgacctttgaagtctttccgtcgtaagttatggtgcagttatcattgactgtaagccaatgatctgtgtcaacaggcacggggttgttccatgaaaatcccgaagttttgtatccgagctgtgtaagcgtgtagtatacaagacccgaacagtcgatgccaagattatttattgtttcgaccgacagcggagtgtactgtccctgattgtatgcgtaccagtagcctttgtttccaaaggtatacggcgagccgagcaaggttgccgcttttgcgatcaccgtatctgccgacggaaaagctgagttttcagtcgaagtacttgccgcattcgctgtgataactccgctcatagatgagccgagcatagaaaaagcgcaaagtcctgccatgaaccctgcgctgagtttctttaatattttcgattttttgaacataaagtgcatttctccttttcatttttgcaaagaaaaagagcctgatttcggctctttcgtttgcacattttaatatatttcatcatatctttggctgcttatcaaatccgcccctgacacatatgattcatcaatatctattatttcgctgaatccgcagtcgttattcagcagaaatccttgtccctgtgtatcaagaacaaaccatgttccgtttaccttaacaacatttgctacatgaccatacagttttgacggcgtccatgcaagatagcattccaaacctgtacctttgcacaaatagtaggtctgccacgaataattcacacaagtgcccgaaccgttttcagtcatccagttgtataccgcctctgccttgctgtaatcagagccgttatgagataagcttctgccgatatccatatatcgttcttcctcagtaggcatcggcgagggtggttgagtctgcggcactgttgtagtctcaggctttgtccttgcgacaggcggatttgttaccgtaggtactgccgatgctgacggctttgccgttgttgatttggtggcattctgaggcttctcattggacggctgggcgttctgctccgctaagttattatcctgagaattgttggatggagtattattctgcacagcttggttattaccctgtacagcgttattctgcccctgaaccgaattgccgcctgtatttgaagtgcttgatttcttagccgcagttacctcagtatctgtcggctttgaggaagatgataccgtctgcgaactctttttaatggtcgctgtggtttcacttgtatccatttcttcctttgccgatgtttctgcggaaactatagccgtggccgcagtttgactagctactgaagagttttcgctttctgtggattccgatatatttccacaggctgataaaaataccgcacagaatattgatatgaccattgcttttttcatattatcacgctccttgacaagcaatatatcacactaatactttaaaatccagactttttattgaagttctacctttgtcacaatttgcacagcataagctttagcaaactacatacttatctccggtgactcttcaaattcttcaagcggttcgatagatcgtgtacaccatttccgagaaaaatgttcccgtaagatatgtagttccagcggatcagactgcaacccttacggcagatgcgaccacaaccaagacattcaaaaatatcctcaaaaagtttacagttgaggtaacaaagcaggattctgaaacaacatcagaacagggcaacggaacacttgcaggagcagtttacggcatttaccgtgacggagcgcttattgacacctacaccacagatgaaaacggatatttcaagtccaaggagtatgtctgcggaaattacacagttcaggagatttctccctccgcgggatatctgcttgatatgactgttcattccgtaggcgcagagccggaaaaatacacaattgaaagtaatctcatttctatgactgtgactgaggacgtaataaagggcaatatctcagtcatcaagcatacggacgacggctcgactcagatcgaaacgcccgaagtcggcgctgaatttgaggtttatctcaagagcgtaggcagttatggaaatgctgctgaaacagagcgtgatcatctgacttgcgatgaaaacggctttgcacagacaaaggatatgccatacggaatttacacggttcatcagaccaatggctgggaaggtacggagtttatagctgattttgatgtcaacatcagcgagaacggacagacctatcgctatctcattaacaatgcaaagtttgaaagctatgttaaggtggtaaaggtcgattccgaaagcggcaatgtcattccttacgagggcgcaggctttgagatttatgattcaaacggtcagaagatttctatgactttcagctatcctactcccacaactattgatgtgttttacacaaacagcgagggatatctgatcactcccgaggttcttccctacggcgaatattctcttgttgaggttcaggctccttacggctatgcgcttgataaaactcccgtagcattttcggtttccttagaaaatgcagagaaagaaaactcgcttactattgtcaaagttgaaaagcaaaacaccgctcagaaaggcaggatcagcgttcagaaaacaggcgatattttcacaagcgtgaatatggcaagctctgcttatacagacgaaaacggcgagctagttgtcaattcaacgacctacactcccgtgtttgcggacggagatctcagcggcgcagtatttcaggtgatcgctgtagaggatattgttacgctcgacggtacaacaagagcttatgcaggagatgttgtttcagagatcacgacagacgaaaacggctatgctgaaactgagccgctttatcttggcaagtatgaggtcagagagataaaagctcccgatggttatgtgctgaacaatgagcctaaagatgttgaagtgacatatgcaggacaggaatttgaggtgagagatactgtgaatacagcttttgaaaatgagtatcagggcgtgagaatctcgctttctaaggttatggaaaatgatgaactgttcgggatctacggcaaggactactatacgagctataatgtcccccttgtcaagacacaaatgaaaaaaattatcgtgacagcgaaaactttgtatagccatccaaaaaacgtaagcaaaatttatgcagcattgcatacagacttggcttggtaaacctgcacaggcaacttgtagccaagcgcctgatggggtctttcgttgttgtaatccttgatgtaactaccaatctgctggcgcagctctctgggattgctgtattcattgatataaatcaactccgttttcaagctgcgaaaccagcgttcaattaccacattatccacccatctagcttttccgtccatactctggcggatattcttcgctttcagaaattcaatatagtcattgcttgtaaactggctgccctgatcagaattgataatttcaggattgccgtattgttccatggcatttgtgactgctgctaaaaccggtgcagtatccagcgtatcagacaattcatagcccacgataaaacggctgtaccaatcaataatcgctgtcagatacatatggctacgccccattttgatataggtgatgtcaattgaccatacctgatttggtcggtcaatttttagatttttcagcagatacggaaattttaaactgttctttccgggctttgaaagattggatttcggataaaccggacagatattcatttccgccatataacgtctgacaagctttctgccgattgcaatcccgtcttcctgtacaagcttttctttgattttccgatgaccaatgtagcagaattttgtgtgccagtagtcaatacgtgatttgatgtattcctcacgctccaaggctttttctgccggttcaacaggctgatagtacatcgaagtgcggttgatttcaagcagttcacactgttccttaatgttcagcctatcattcttcataaccagacttttccttccagtcaggtccgagcacttcttcagatttttttttgagccagtccacctgaactgtcaggtgaccgattttctgcataagcttttcttcccgcttttttgagttctcagctgctctttttgcttccttttctgattttgaaccattaaaggcacgggatgcattctcaagaaattcctttttccaatttttcagctgattgacgttgattccttcacgacttgctatctcgctgatcgtctgctctccctccagtatttctattacgatttttgccttgtactccggtgtgtatgtgttcctcttcgccattatcgtgtcctcctgtttctttcttttattataccactgtcacgatgttttggcaattttgtgttcagtttctagggtacattatagaaacaattgctcccgacggttacgagatcgcaaacgagataaagtttactgtgaatgctgacggaactgtgaccgatgtcgttatgtacgatgagcatacgcctaaaacggatactccgtatacaggcgataaccacagtgactttgcggcatttgcacttatgggcgcttcgctcataatctttcttgtgctgatcattagcagaaagaaaaatgatgacaaggagcctgaagatcattcagctctttgccccgaatttattgaaattgatgaggattgatctatgactaagaaaaacaaagttattcgcactattgcggctgtgaccgcagtcgcactcctcggaggaggaatttatcttcttgtaaaaaacgatgtggctcagaaaatcaattggcaggatattctgatctatgctcctaccccgatggcgagggaaacgcttgatgaggcagtcaacaatagttctgacaagccatcggcggacagagttcccgaatatacaaaaaaggagcttacagcacaggtacggcagctttccaacgagcatagtgactccgtggcttggctgtatattcccgatacgaatatagattatccgatcatgcagtcgggagataacgattattacgctcacagggcgactgacggctcgtatttgtatgcaggctcgctgtttatggactatcgctgttcaagtgatttttctgactttaatagcgtgatctacggtcacaatatgggaaacggaacgatgtttgccgatattccaaattacgaaaacgaggaatttttcatgaaccacagctttggctggctgactaccgatgacaatcttcggctgatagatttctttgcggttgcaagaactgttgacacaagtggactttatcttgctgatcccacttttgaaaaatgggacttacagctcagaaactgtgcaagtatttacaaggaaatcggtatttctgctgacgatcatttaatcactctttccacttgcacaagtgcggagggcaatagcagaactgttctgataggaaaaattattgaggagagtgatgtggaatgaagttaaaaaagacgaaaaagaaggtcattgcagcggttgcaagcgctgtgtgctttgccgcaatgcttacgaccaccgcctacgcctcgggcgatgttgcgggagcagtcacaagcacttggaacacagccagatcgcagatagtgtcggtggtgaacaatgttgtttttccgtgcctcgtaagggttgcagtctgatccgctggaactacatatcttacgggaacatttttctcggaaatggtgtacacgatcttctcattattgctgttgtaaacgggaatatcggaaagaattgcaacaccgtccgaacctgttttaattgtgtaggtcttaccgttgcccgtaatagtgaactctctgtcgccgttctgattgtcctcggactgcttatttatctttatcgagcccgttttaagttgattgttgaacttcacattcacagtcagatcaacatctccgcttgtcagcgtaacattctgagccttagggacttcgtatcttgtatctacattgatctcggatacggtgtaggtgatcgctttgcccgtagatgtgttgtatacctttaatccgctaaattcggcaacgccgtttgcattggttttcttggtgtaactgctgccgtcgtttcctgtgaccttgaactctctgccgcttacgatctcgtcatcggcggtcttattgaccttaattttgcctctcgtaaaatcttcggtcacaaatatattttcgtcagcctttaatgcgaacacttcttcagagatactgtaacctgtcggtgcggagatctccttaacgtaatactgcttttcaggtaactgaatggaacctgttccgtccttgccgatagtgatctcgccgaccttgtttttacaagccttatcggtatatactccgtattttgcaaccgtgccgtctaccttgcttgtgcctgaaatcttaaccgttctgtctgaaacaagaaccttagttatttcaaatttcacatcattttttgttatcctgaacgccgacatattcatagcggtagcagtcttaccgtcagttttgttgttgataacaacgccctccgaaccgctggattctattctccaatgctttccgcctgcacctgtgccgtcgcctactgtctttgaatttatgagtttttccgaaactccgatagacttcagatagcttattacatcgtttcttgaatcaaattcgcccatatatatccaagcgtgatcctcaccaaccggattctgagcgaccaccacagaacctgctgtaataaccgaaccgtcagcacgctcccaatacgggcggtccgttgtcttgatgtttttcttttcgacttcgacctttgaagtctttccgtcgtaagttatggtgcagttatcattgactgtaagccaatgatctgtgtcagcgtgagaatctcgctttctaaggttatggaaaatgatgaactgttcgggatctacggcaaggactactatacgagcgttcgttttgggctatttgccgcagaagatattactgccgctgacggttctgttatccctgcggacggactgctttcagaggtttcacttgatgagaatatgaccgcaaaatttgatgtacagatacctttcggcaggtattatgtcaaagaaatttctactgatgagcattatgttctaggtggcgaaaagtatcttgtgaatttcgaatatatgggacaggacatccggactgtggatattgattgcggacaattcgtaaatcttctcaagcgtggcaggatagagggtcacaaggtagatgacaagagcgaacctcttgaaaatgctgtgttcggtctgtttactgccgactgcgtgaagttcagcagagatactgcaataatgactgccgtttcagatgagaatggcttttttgaatttgatgacgttccatttggaaagtatatcgtccgtgagatagaaagtccaaggggatatattcttagcgacaaagaatacaccgttagcatttcggaggacggtgaggttattgagataactgcggaaaacaagcctattactgttgagatttcaaaacgtgatatttacggcaatgagcttgagggtgctgaaatggtgcttgaaaatgctgacggtgagacagttgataagtggacttccgacggcaaaaatcacattgtttcaaagcttggtacgggtgaatatgtgcttaaagaaattgccgcacctgacggttatattattgcgacagacattaagttcaacgttgatgtttacggcaatgttacggtagaaaacgttgattcaaaagccgtttcggataacggcgatccgcttatcactatggtggatgatacgactaaggtacagatttccaagcaggatattaccacaggtgaggaactgcccggcgcaacgctccagatcattgacgaggacggaaatgttgttgaggaatgggtatccacggacgaggctcacttcatcgaaggaaagctgatcgcaggcaaggagtacacgctccgtgaaacaattgctcccgacggttacgagatcgcaaacgagataaagtttactgtgaatgctgacggaactgtgaccgaaatatcgtgaaataaacaatctgaaaaataactattctcgaaattaacattttcaaacataacagattcaaatttgcgtcggtatcaggtttcatataattgggtttaatgggattgtagcctgaatcaacaagtaatccggacatttcctcaacatctgaaaaacaatcgctgtgctatctgatttctcctaagtgtttgacaaatagctattccatttattcatattactgattttagaatctattttagataaaaaatttgactttataactttatcgacagcaacataaaaagtttccgtcctgttgccaatgttattataatccagcatatatttttcttgtgtatcggtattgaaatagtaaataaattcatcaccattttgctgataaacccataccaaatattcattgggatttatatcatagcaaaaataataacttggcagataattggtatagtcctcaaatccaatggcatatctaatcaaatgctcattttcatcggatataatcatagttttatcaggttgccaacctttattgctttcaataactttgattgaaattaaaacattattatcagtttcaattttttcattaaacagtgttttttcattcttacacaaaccaacaataatgcctgaaataattactgcagaaataataatgccgacaactaccaatacttttttcatactaaacctcaattagctaagtcaaaataataatcgcaaaatgcacttgcaaaaccatatatcatattttcagttattaaattacaagtagatgaactatacacgcaaccagcagaaagaaaatccataggaagtctaatatatgatgtagcaagtattttcaaatcagatcgttcatttgaacctgtaatattatatataaaatcagaaaatctttgcttgttgttcatttttattaaataattgttaagcaattcatttaagtccatattgggattatctttatactcatagtataaacaacctaattgtttagcttgctctttagtaatataatctttaggcagttctccagtgtttctcaactgtctgaataaacataatattccgtatcgtttgaatcaagctgatttgtgagcatattcccacatcgacatacaaatctcatattatctctcctataaattgtatatttttatgttatgttacaatagatagttgacaaaacaaattgaaaaacaacttccaaaatgatataatgttaagtaccaccaaaacaagaatatcaaaaaggaagttgtctatgaacattatagcacaggaagcacattttcgtcaacgggtagttaaatattcaaataaaaaaggagtaacagaagcatcaaggcgctatcatgtaagtcgtcaggcgatatatgagtggagggcaaggtatgacggcacatggaaaagtctgaaagaaaaaagtcaccgtccacatcatcatccaaatgaacatacagcagaggaaaaagaaatgatactgcgacgttatccacggtataaggacgatatgattatgctctgggatagtctgcgaaaaagcgggtataaacgttcatatggaagtatgcttagggtgataaagaaatgggtaaaaccggagacagaaaagcgcagagcaaggaaaaacaagccgtatgaaagagcagtatatcccggacaaaagatacagatagatgtaaaattcgtaccgagctattgtgtcgcagatggacggaaatactaccagtacacggcagtagatgaatgtacgagattttgcttccgggagatgtatgatgaacatagcacttatagctcaaaggattttcttgaaaagctgttcaaagcatttccgtttccgatcagagagatccagacagataacggaacagaatggacaacggctttactcgtcagagataagcaaagtaaaactatgtttgaacaggtgctggaaaagaacgacataatataccacaggattcgtgtagcgacacctcgccacaacggcaaagtagagcgacagcacagaacagatgaaaagagattttataagaaaatacgtatgtacagtcttgaagacggcagaatgcagctggtaagatataataaaaaatccaataatatacccaaagtatgcttgaatttcagaactccaaacgaagttctgcaagatcatctgtatgtgatgtgagtcgccgcagcttttcattctccgctcgcctacggctctctccaaatgaaaagctgcaattagttacttaacattattttttgagaagatgtgtcacctatcattgacaactgaacagctgtattaaatcacaatatcttagtaaagtatatcttcctgcgaagctcagttatctgcaacgtccataagctcaacagcaatatcgtcagacccggtatcatctgcatcagcctgaatatcgtccggcttatcgtcctctatgaaagctcctgtaaaatcaatacaaacattctcgcttttaccaaaacgagccattgtcagcagatcggtgacagtcgagcgtgtgacatgagcgcctgtgaaatccatcaccacatttgcagaattatcctcgctgtttttgctgttgatctcatcacgaagctggtcaaaattcgtatcctcaaggtctgcataagctgaaaactcttttggcgcataaagcgttgcaacagcgtgcatagcaatgaatacaaacctgaaatcttcgcaatcaaaggtgctgaaaggtatctcaaaaagcctcagcataccctcgtcggtctttttgcataaaacaggcttatatctgttctgagccagatcgtaggtgtatctgtcttcgtaagcttcatcggttaagctgccgtctggcataggcacaatctcaaaacgagaagtttcattgcacgtattgcaatagcctccgactatcacaaatctgaaaacatagtcggtatttttctcaagctttttgtcacagcatatctgcgtccagtcccaattccagtttccaatagaataggcaataacgttttcgccgtccttatcggtcacaaaatatttagctatgacattgttttcgcaggacttatctgccttaaaatctctaggatcaaaatctattactttactcatattatttacctccgtaacatccacggtcggcttatgagtatccaacattcttatagtacatttttcacagtcgcttgcatactctgcccgaccgttcttaacaagccccttagcccttttgggataagtagctccgattcgttttccgtttatgtctgtaacaacaacgtttttttctatgggtatctcccccttgcacagcaatattaaattagtgcctgcattacacaggcttgcgtttagctccgacgctgttattttctatgggtgtcgtccccagtctttgcttaggataagtttaacagacgtctccgaaagcacagcgtaggtttccgtgtatccgaactgcgtcgccataccatcggatttctgaacagagccgtactgctgatacttaccctttgaaacaacactgcttgtcattcggtaactcgaaacaaagtcatcttcggtgataccgctcatctgtgcggaggtctgtccgaagtaataatctccgaagttttcaaggatatattccatatcgtgatcaagatcactctgacttagatcaatacacagaacatctatcataccgccgccgtttgagcctttcaaagtaattttattcacaccgtttgagttatcaatttcgttctcaaaggaactgcctttcattgcttctgttaccaatgcgcttgtatctgcaaagcatatatttgaatcgaaaaattcggcaataaaggtgtccgtctttatcttttcatcctctaaactgctttcagcctccgaagaggcagccgagtcgtgtatggactcggctgtggtagtagctgttgttttcgtaacagcattttgaatcggcggactgatcgttccgcaagctgtcattgtcagcataatcgtcgctaaaattgcagtcattacttttgctttcatattcattttccccctatcagattatgctccagatgtacagcggacaggtcagagaaaagatcaaacagccgaaaatgatagcgatcggcgtccattcaagctgaccgtgtttgcgataatcgaggtatgcgagtgttatcttcacaaacagcagaaccgcaagtatcacgtctattacgggaaacaccacattgtttacgactgaaacgacctgcgatttcgccgcaccccaggtgcttgtcaccgcccctgcaacatcgcctgaagcataagcggttagcgacatcatagctgcaaagcacaccgaacttgctgctgcgatcaatttctttttagatctcatttcacatcatcctttctctgttccttatcgttctttttgtatatgaccataccgaaaaccataataaccgctgtggctacgagataaagctcagcactctaataatatgttctgccatctcatttataaactctttttcattcatactatcctcaccataatttgtagttatcatcgattgataaaaacagctcattgtatccattcataagatacaatgagccatttttcttattaacctctctgatacctcaccgccttttcaaaattaatgataccgttgatccgcttaacctcatctgtacacatagcacggagttttatcattgtatcgtcgtcaatgtcatgcactgcggcaagcatatgtgtaatcgcaccaagttcgacagcaaccttaaataaggcacgggacagcctctgttccgtgccttttacaattccctctgttatcgttgcaatctgcggagcaagataatccacaagctcaggcttgttctgcaaaagataaccgcagtaaaatctgattgccttttccataaactccgtgcgtgaagagcagttatccgacttgtataagatatcaaccgttttcatagtctcgggaaatacatacaacggaaacttgattttttctgctgtgacaccatcgttttcttctgcaacatcggtgctttttttcattttttgtacttttgactccatgactttcgtaaacctccttttttgactccattttatcaaggcttgtaaaacctcgcaaaatcggcgagctttgctcgttcgatgtgattgttttggcggctttgacgccaaaactttaaccagcaatatattaaatgcccctcaaacccacccgaaatcatctgatttctaccattctcaaactctgcgataagacttgttcttaacgctcgacaaaatgccccaaattcgctccgaccgttgttagggtaaagttatcccaccgacctcagaacctcgccacacaaggcgacacggcgcgaactgcggcgaattactgctcggactgcttttccggttcggcagaagcaggattcttcggctttctcgcaggctttctgtccgacatcatatcaataaaatctctcacattctgcggaacgaccttgccgtaaagc
